United States Patent 9,920,330 (ISOLATED POLYNUCLEOTIDES AND POLYPEPTIDES AND METHODS OF USING SAME FOR INCREASING PLANT YIELD, BIOMASS, GROWTH RATE, VIGOR, OIL CONTENT, ABIOTIC STRESS TOLERANCE OF PLANTS AND NITROGEN USE EFFICIENCY) - sequence listing, part 2

SEQ ID NO: 1520 - DNA, 1414 bp, Vigna unguiculata
gggaagcagagataagtgtgaagtgatatccaaaacatgtctctctgtgcttcactctccaccacaacttcgcgcctcgtttcccttccatcttcactcccttcaagttctccactttctctcagattttccttcactttccggggaaacagaatcccagttaaatctcagaaggagccgttttcagcaaggtatgcaagagtgttggtaaaggctcaggctacagcacctgcttcttccgaggctgtgaaactcacacctgtcccttctgagatgaaggcatgggtgtatggggaatatgggggtgtggaggttctgaaccttgactccaatgttgccgtgcctgatgtgaaagaggatcaggtccttgtcaaagttgctgctgctgctcttaaccccgttgatgccaagagaaggcagggaaagtttaaggccactgattctcctcttccgactgttccggggtatgatgttgcgggtgtggtggtgaaggtgggtagtgaagtgaaggactttaaagtgggtgatgaagtgtatggaaatgtaagtgagaaagctttagacgggccaaagcaattcgggtctttggctgagtacacagcggttgaggagaaactgttggcagcaaaacctaagaacttggacttttctcaggctgcttctcttcctctagcaattgagactgcttatgagggtttggagaggactggtttttctcctggtaaatctattcttgttctcaatggttctggaggagttggaagcctagccattcagctagctaagcaagtctttggagcttcaagagtagctgccacttctagcactagaaatttggagctattgaaaagcttgggagctgatttggctattgactacaccaaagaaaacttcgaagatttgtcagaaaagtttgatgtagtctttgatgccatagggcaatgtgagagggcagtgaaggctgtgaaagaagatggtggtgtggtggcattgacgggtgctgttaccccacctggtttcagatttgtggttacttcgaatggaagtgttcttaggaaactgaacccttacttagaaagtggaaaggtgaaggccattgtagaccccaaaggtccattctcctttgctcagcttgctgaagctttctcttatcttgaaaccaatcgagccactggaaaggttgttatacaccccatcccctgaatcagacaaaagggatagacaattttgctatgtctagtaaacatcatgttctatattaatcacactttttctacgttcatctattgccaccaattctaaaccaattacaagaacaaaattaggaaacaacaaatatcagtggaattgggtaggaaatccacacaaatattctgtaatcctagattgttacatgaattaagtaaacttccag

SEQ ID NO: 1521 - DNA, 1415 bp, Vigna unguiculata
gggaagcagagataagtgtgaagtgatatccaaaacatgtctctctgtgcttcactctccaccacaacttcgcgcctcgtttcccttccatcttcactcccttcaagttctccactttctctcagattttccttcactttccggggaaacagaatcccagttaaatctcagaaggagccgttttcagcaaggtatgcaagagtgttggtaaaggctcaggctacagcacctgcttcttccgaggctgtgaaactcacacctgtcccttctgagatgaaggcatgggtgtatggggaatatgggggtgtggaggttctgaaccttgactccaatgttgccgtgcctgatgtgaaagaggatcaggtccttgtcaaagttgctgctgctgctcttaaccccgttgatgccaagagaaggcagggaaagtttaaggccactgattctcctcttccgactgttccggggtatgatgttgcgggtgtggtggtgaaggtgggtagtgaagtgaaggactttaaagtgggtgatgaagtgtatggaaatgtaagtgagaaagctttagacgggccaaagcaattcgggtctttggctgagtacacagcggttgaggagaaactgttggcagcaaaacctaagaacttggacttttctcaggctgcttctcttcctctagcaattgagactgcttatgagggtttggagaggactggtttttctcctggtaaatctattcttgttctcaatggttctggaggagttggaagcctagccattcagctagctaagcaagtctttggagcttcaagagtagctgccacttctagcactagaaatttggagctattgaaaagcttgggagctgatttggctattgactacaccaaagaaaacttcgaagatttgtcagaaaagtttgatgtagtctttgatgccatagggcaatgtgagagggcagtgaaggctgtgaaagaagatggtggtgtggtggcattgacgggtgctgttaccccacctggtttcagatttgtggttacttcgaatggaagtgttcttaggaaactgaacccttacttagaaagtggaaaggtgaaggccattgtagaccccaaaggtccattctcctttgctcagcttgctgaagctttctcttatcttgaaaccaatcgagccactggaaaggttgttatacaccccatcccctgaatcagacaaaagggatagacaattttgctatgtctagtaaacatcatgttctatattaatcacactttttctacgttcatctattgccaccaattctaaaccaattacaagaacaaaattaggaaacaacaaatatcagtggaattgggtaggaaatccacacaaatattctgtaatcctagattgttacatgaattaagtaaacttccaga

SEQ ID NO: 1522 - DNA, 1288 bp, Lotus japonicus
catgtttctctcagctgcactctcctccacaacttcccacctcactatcctcccttctctcatcacttccacaacctctccactttctcgcagattttcctttactttcctagaaaacagaaacccaacaaccacaacaaccctcttcccttacaagcagagactcttggtaaagtctcaggctactgcacctgcttcttctgaggcagtgaaagtgtcacctgtaccttctgagatgaaagcgtgggtctatggggaatatggcggtgtggatgttttgaaatttgattccaatgttgctgtgcctgatttgaaggaggatcaggtccttgttagagttgttgctgcagctcttaaccctgttgatgccaagagaaggcaggggaagttcaaagccactgattctcctcttccgactgttccgggctacgatgttgccggtgtggtggtgaaggttggcagtgaagtaaaggagttcagagtgggtgatgaagtatatggagatgtaaatgagaaagcactagaagggcctaagcagtttggatctctggctgagtacacagctgttgaggagaaattgttggcaccaaaacctaagaatttggattttgctcaagccgcttctcttcctcttgcaattgagactgcttatgagggtttggagagaactggattttcttctggtaaatccattcttgtcctaaatggttcaggtggagttggaagccttgttattcagcttgctaagcaagtttttggagctgcaagagttgctgcaacttcaagcactagaaatttggagcttttgaaaagcctgggagttgatttagctattgactacacaaaggagaacttcgaagacttaccagagaaatttgatgttgtttatgatgccatcgggcaatgtgacagagcagtgaaggcgatcaaagaaggtggtagtgtggtagcactcacaggtgctgttacaccacctggcttcagatttgtagtaacttccaatggaactgttctgaggaaattaaacccttatttagagagtggaaaggtgaagccaattgtagactccaaaggtccattccctttcacccaactagctgaagccttctcttaccttgaaacaaaccgagctactggaaaggttgttatacatcccatcccatgaattaaataaaagtaatagtcaattttgctatgtgtcttgtagtgttcactgttcacactatgagtaaatgtaaatcagagttcagataacagctgcaaaatatatagcttcactcttacattc

SEQ ID NO: 1523 - DNA, 1418 bp, Cicer arietinum
cttcaaagggtggttgaagttgaagcagagacaacatacaactgataaggcaataacgaaaccatgtcactctcctccacaacttcccacctcactatccttccttcacttccttcaacttcaccactttctctccgattttccttcactttccgagaaaaagaaaccaaaccacacctctcacaacaaccctgttagcttcaccaaggactgccactgctagattcttggtgaagtctcaggccacaactactcctgcttcttccgaggctgcgaaagtgacacaagtgccttctgaaatgaaggcttgggtgtatggagaatatggaggtgttgatgttttgaaatttgattccagtattgctgtccctgatgttaaggaagatcaggttcttgttagagtttttgctgctgctcttaaccctgttgatggtaagagaagacaagggaagtttaaagccactgactctcctcttccgactgttcctggctatgatgtagctggagttgtggtgaaagttggtagtgaagtaaaggatttcaaagtgggtgatgaagtgtatggtgatgtaaatgagaaagcacttgaagggccaaaacagtttgggtctctggctgagtacacagctgttgaggagaaattgttggcactaaaacctaagaatttagactttgctcaagctgcttctcttcctcttgcaattgagactgcttatgagggtttggagaggactggtttttctgctggtaaatctattcttgttcttaatggttctggtggagttggaagtttagtgattcagctagctaaacaagttttcggagcttcaagagttgctgccactgcaagcactagaaatttggagttgttgaaaagtcttggagctgatttggctattgactacacaaaggagaactttgaagacttgccagaaaaatttgatgtagtttatgatgctattgggcaatgtgatagggcagtgaaggctataaaagaaggtggcagtgtagttgcacttacaggtgctgttacaccacctggcttcagatttgtagtaacttccaatggagcagttctgaagaaactaaacccttatttagagagtggaaaagtgaagccaattgttgatcccaaaggcccattcccttttgatcaggtggttgaagctttctcttacgttgaaacaaacagagctactggaaaggttgttatataccccatcccatgaatcaaataaaaattttaggcaattttgttatgtatccagtgattttcattgttcacactttatcggtaaataagagttcacaccctatgtatctagtgatggtcacattttctccctttaattgtatgtttgtttcaagagaaagataggtgagagactttgctacgacagatttaaacgagaaatgac

SEQ ID NO: 1524 - DNA, 1624 bp, Arachis hypogaea
aaataaataaatttaattcagacattggcactcacctgactagaaaattttctgttacaaaaacatgtaacattcacatggttagttataaagttagttgagagcagagataagtgataagccgttagaaaacaatgtccgtctcagctgcactctcctccacaccttcccacctcacctctctcccttccagttctccattttctctcagattttcccttcctttccgggaaaataacagggaccggttattcttcagtcctcagagtcggagacactcaggagttgtggtggtgaggtctcaggctacaaccacacctgcttcttctgaggcagttaaagccacggctgtgccgtctgagatgaaggcatgggtgtacggtgagtatggcggagttgacgtgttgaagtttgattccagtgttggtgtccctgatgtgaaggaggatcaggttcttgttaaggttgttgctgctgctcttaaccctgttgatgccaagagaaggcagggaaagttcaaggccactgattctcctcttccgactgttccggggtacgatgttgccggagtggtggtgaaggttggtagcaaagtaaaggatttcaaggtgggtgatgaagtatatggtgatgttaatgagaaagcacttgaagggcctaagcagtttgggtctttagctgagtacactgctgttgaggagagattgttagcaccaaaaccaaagaacttgaactttgctgaggctgcttctcttcctcttgcaattgagactgcttatgagggtttggagaggcttggattctcccctggtaaatccattcttgttctaaatggttctggtggtgttggaaccctagtcattcagctagctaagaaagtttttggggcttcaagagttgctgccacttcaagcaccagaaatttggagctgttgaaaagcttgggagctgatttggctattgactacacaaaggagaactttgaagacttgccagaaaaatttgatgttgtttatgatgccattgggcaatgtgagaaggcagtgaaggcagtgaaagaaggtgggagtgtggtggcactaacaggagcagttacaccacctgggttcagatttgtggttacttccaatggagctgttctcaggaaactgaacccttacttggagagtggacaagtaaagccagttgtggatcccaaaggtcccttctcctttgctcagcttgttgaagccttcacttaccttgaaacaaaccgtgctactggaaaggtcgtcataagtcccatcccataaagacagagaaaggggtaggaaattttgctgtctatctatttactagagatgttcactctcggtgtgagtaaatcagagttttgatttatacataaaaagcttcactgctaaatgttccttcaaactatccatgactattttcccaagaaaaatgtctgttttaaacttaagggaacatggacatgtccaaatgaaacaaattaatgagaaacagtcttaactcacaccttttaactactattctttatatgttcaccgcttaattttgagtttacatcccatttaataatagttgaatcaatatagtgtgtacaaaaaaagaaaaaacaaaa

SEQ ID NO: 1525 - DNA, 1286 bp, Trifolium pratense
  misc_feature (626)..(626): n is a, c, g, or t
tttggtcgaaattgaaacagaaacaactgataaggcattaaccaaaccatgtcactctccaccacaatttctcacctcaccattcttccttcacttccttcaacttcatcactttctcatagattttccttcactttccctgaaaaaagaaaccagaaaaattctcatacaactcttttctcttcttcatcaaggtctggtagattcttggtgaagtctcagacttctagtgtatcttcttctgaggctgtgaaagtaacttctgttccttctgaaatgaaggcttgggtgtatggagaatatggtgatgttgatgttttgaaatttgattccagtgttgctgttccagatgttaaagaagatcaggttcttgttaaggttgttgctgctgctcttaatcctgttgatggtaaaagaaggcagggaaaatttaaggctactgattctcctcttccgactgttcctggctatgacgttgctgggattgtagtaaaagttggaagtggagtaaaggaattcaaagtgggtgatgaagtgtatggtgatgtaaatgagaaagcacttgaagggcctaaacagtttgggtctctagctgaatacacagctgttgaggagaaattattggntctaaaacctaagaatttggactttgctcaagctgcttctcttcctcttgcaattgagactgcttatgaaggtttggagaggactggattttcttctggtaaatctattcttgttcttaatggatctggtggggttggaagcttagtgattcagctagctaaacaagtttttggagcttcaagagtagctgccacttcaagcactagacatttggagctgttgaaaagccttggagccgatttggctattgactacacaaaggagaactttgaagatttacctgaaaaatttgatgtagtttatgatgccattgggcaatgtgacagagcagtgaaggctataaaagaaggtggcagtgtagtagcactaacaggtgctgttacaccacctggattcagatttgtagtaacttccaatggagatgttctgaagaaactaaacccttatttagagagtggaaatgtgaagccaattattgatcccaaaggtccattcaactttgctcaagttgctgaagcattctcttacattgaaacaaacaaagctactggaaaagttgttatattccccatcccatgaattaaattaaaatgatgtgcaattttgttatgtatctagttaattatgttcataccctatgagtaaataaaagttcactt

SEQ ID NO: 1526 - DNA, 1325 bp, Cajanus cajan
ttatcaagagaatttatatgcttatcaaaatgtgtgacatttccaatgaaaaaagaagcttgacgaaagctagcaaacattaacaaaggacaaaatttatgtcgtatgataaacaaaaaaattggcttgcgtatgcaccattatattaaccctaattcagagtccttgacttccaaggtagcctcttcatttgagctttttttttttcctacctcaaacccttccaaagttccaactttttcttcttctgtcaaagagaactaagattctacagattattcctcgaagaaatgaacttgaaacaatgctgttgtttctttttagatgaaggacaaggcaaaatacagttcggattgccaacaggaagaacagtagggattatccatgggaaatgtacaccttgaaggagttgcttcgcgcaacaaaagactttcatcaagataataagatcggagagggtggatttggaagtgtttattttggtcgaacaagtaaaggcgttcagattgcagtgaagcggttgaagacaatgactgcaaaggcagagatggagtttgcagtggaagtggaagtgttaggaagagtgaggcataagaatttgttggggttgaggggattctatgcaggaggagatgaaaggttgattgtgtatgattacatgcctaaccatagcttgctcacccatttgcatggtccacttgctaaggaatgtcaactagattggcctagaagaatgagcatagcaattggagctgctgaaggtttagcgtatttgcaccatgagtcaactcctcacatcatacacagagatataaaggcaagcaatgttcttctagaccatgaatttcaagccaaggttgctgattttggttttgctaagctagtaccagatggtgtaactcatcttaccacgaaggtcaaaggaaccctaggatatttggcaccagaatacgcaatgtgggggaaagtttctgaaagttgtgatgtttacagctttggaattttacttttggagattattagtgccaagaaaccaattgagaaatttcctgggggagttaaaagggacattgttcaatggatcacaccgtatgtgaacaagggtctcttcaacaatgttgcggatccaaagttgaaggggaaatttgatttggagcaattgaaaactatgatcaccattgctcttagatgcaccgataatagtgcagacaaaaggcctagcatgaaagaggtggtggattggctcaagaatggtacaggaagcacttaggtcaagagattccaaattttagtaacaagaatagagatgaagaaaatgacaaaaa

SEQ ID NO: 1527 - DNA, 1408 bp, Glycine max
aagcttaacgaaagctagcaaacaatagcataggccacaatttaaggcatataatatacacatagcttgcgtttccaccattatattaaccttgactagcttccaaggatttgagcctatatttttattttctacttcaacccctcactttttcttcttctgtcaacgtgaactaagattctacagattcttcctagaaattatgcacttgaaacaatactgttgtttcctcaaagatgaaaggcaaagcaaaatacaggttgccaacaagaagaacaatagggactatccatgggaaatgtacacgttgaaggagttgcttcgtgcaacaaacaactttgatcaagataataagattggagagggtggatttggaagtgtttattttggtcgaacaagtaaaggcgttcagattgcagtgaagcggttgaagacaatgactgcaaaggcagagatggagtttgcagtggaagtggaagtattaggaagagtgaggcataaaaatttgttgggattgaggggattctatgcaggaggagatgaaaggttgattgtgtatgattacatgcctaaccatagcttgctcacccatttgcatggtccacttgctaagaaatgtcagctagattggcctagaagaatgagcatagcaattggaactgctgaaggtttagcgtatctgcaccatgaatcaactcctcacatcatacacagagatattaaggcaagcaatgttcttctagacgctgaatttcaagccaaggttgctgattttggttttgcaaagctggtaccagatggtgtgacccatcttaccacaaaagttaaaggcaccctaggatatttggcaccagaatacgccatgtgggggaaggtttctgagagctgtgatgtttacagctttggaattttacttttggagattattagtgccaagaaaccaattgagaaattccctggagaagtgaaaagggacattgttcaatgggtcacaccatatatcaacaaaggcctcttcaacaacattgctgatccaaagttgaaggggaaatttgatttggagcaattgaaaaacgttaccaccatagctcttagatgcaccgatagtagtgcggataagaggcctagcatgaaagaggtggtggattggctcaagaatggtgtagggaacacttaattaggagaagattttgagtatcaaagagtagacacgaagaaaatggcaagaatgatactgtgacaggagacttatgtaaaacaatctaagaagtttaaaaaatcacccagtgatctgtataaagtgatataaatttgtgttttttattttggtttatttgtgaaatgagactgacatttatttatatttgagaaaaattaaggtatctttacggcagtaatgacctttttg

SEQ ID NO: 1528 - DNA, 1491 bp, Phaseolus coccineus
taataattaagctcagattagcattgagttgagttgtttatcccaaaacttatataaaatgtgtgacatttccaatgaaaaaggaagcttaacgaggctagcaaacaatggcatatgccaaaatttaaggcataaaataacactgaatttgcttgcgtatacaccattatattaaccttcaaagtccttgacttccaagggtctgagttgagcctatctttcattttgttttatcttcaatcccttcaacccttccaactttctcttctgtcaaagtgaagtaggattctaaagattcctcctcaaaaaatgaacttcaaacaatactgttgtttcctcttagatgaagggcaaagcaaaattcagattgctaagaagaagaacagtaggggttatccatgggaaatgtataccttgaaggagttgcttagagcaacaaacaactttcatcaagataataagattggagagggtggatttggaagtgtttattttggtcgaacaagtaaaggcgttcagattgcagtgaagcgattgaagacaatgactgctaaggcagaaatggagtttgcagtggaagtggaagtattaggaagagtgaggcataagaatttgttgggattgaggggattctatgcaggaggagatgaaaggttaattgtgtatgattacatgcctaatcatagcttgctcacacatttgcatggtccacttgctaaggaatgtcagttagattggccaagaagaatgagcatagcaattggagctgctgaaggtttagtgtatttgcaccatgagtcaactcctcacatcatacatagagatataaaggcgagtaatgttcttctggactctgaattccaatccaaggttgctgattttggttttgcaaagctggtaccagatggtgtgacccatcttaccacaaaggttaaaggcaccctaggatatttggcaccagaatatgccatgtggggaaaagtttctgagagctgtgatgtctacagctttggaattttactgttggagattatcagtgccaagaaaccaattgagaaatttcctggaggagtgaaaagggatatcgttcaatgggccacaccatatgtcaacaaaggtctcttcagcaacattgcagatccaaaattgaagggcaaatttgatttgcagcaactgaaaaatgtgatcacaatagctcttagatgcactgataccagcgcggataagagacctaacatgaaagaggtggtggaatggctcaagaatggtgtaggcagcacttaggagaagagatcataattttgagtaacagaaatggagatgaagaaaatgacaaaattgatactatccaagctaagaaaagtaccaagtgatgtgtataaagtgatataatttatttgtttttattatatttaatatgcatcttcttcctgtttgagaaaatgagattgacattaactaaaattgtgagaattgaaggtatcttttcag

SEQ ID NO: 1529 - DNA, 1291 bp, Glycine max
gattttatcttctcacaacttctctctctattcccacttctcttctgtgttccttagaagaattaagatggctaccttgactgtacccccagttcctccttcccccagagatgatgccatgcagctctaccgtgcttttaagggatttggatgtgatactagtgctgttatcaatattcttgctcatcgagatgctacacagcgtgcctacatccaacaagaatacagatcaatgtattctgaggaactttccaaacgcttagcttcagagcttagtggaaagttagagactgcagttctgctctggttgcatgaccctgcaggacgtgatgcaacaatcattaggaagtctctaacagccgacaacagaagcattgaaggtgctactgaagttatatgttcacacactccatcacagctacaatatttaaaacagatctaccattctatgtttggtgtttatcttgagcatgatattcaaacaaacacgagccccggcgatcatcaaaagctcttgcttgcatatataagcacacctcgtcatgaaggccccgaggttaatagagaaattgctcagaaggatgcaaaggctctttacaaagcaggggagaagaaactgggaactgatgaaaagacttttatccacatattcagtgaacggagtgcggcacatttggctgccgtcagttcttattaccatgacatgtatggccattcactgaagaaggcagtaaagaatgaaacatctggggcctttgaacatgcacttttgacaataatccaatgtgctgttaatccaggaaagtattttgcaaaggtgttgcgtaaggcgatgaaaggtttggggactgatgattccacactcataagggtcattgtgacaaggactgaggttgatatgcagtatatcaaagctgcatatttaaagaaacacaagaagactctgaacgatgaagtacactcagaaacatccggtcactacaggacttttcttctctcacttttgggccctaatcactaaccaagatgttcaattatgtttcatgtggaataagttcaccctctgatgtttgactgtttatagagctttgtgatcgatctagccgacctcacctggtagaataaggcttttgttgatgttgttgtactagtgttttgtgagtattaatttgtcagcctgatgcacagatgaagatttgttgtgtatttaagtatgctaaactattttattttttttgtttcaacaaatcaagcattgacaagcaaatagaggtcagaagagctactattt

SEQ ID NO: 1530 - DNA, 1363 bp, Cajanus cajan
gtggtccaatggagtggttgggacgtactggattagaaaatgtaatcagtgttttctcattctggtggaccaagaaaaaacatggtatatttaattcaccacgtttactttttctactcataacttgtctctgttcccccttctcttcggtgtttttcaaagaggaagatggctaccttgagtgtacccccagttcctccttctccaagagatgatgccatgcaactttaccgtgctttcaagggacttgggtgtgatactagtgctgttatcaatattcttgctcatcgagatgccacacagcgtgcctacatccaacaagaatacagagcaatgtattctgaggaactttccaaacgcttagcttcggagctcagtggaaagctagagactgctgttctgctctggatgcatgaccctgcaagacgtgactcgacaatcattaggcagtctctaatagacagaactcttaaaggtgctactgaagttatatgttcacggagtccatcgcagctgcaatatttaaaacagatctaccattctatgtttggtgtttatgtagagcaagatattcaaataaacaccagccttggggatcatcaaaagcttttgcttgcatatttaagcacgcctcgtcacgaaggccctgaggttaatagagaaattgctgagaaggatgcaaaggttctttacaaagctggggagaagaaactaggaactgatgaaaagacttttatccacatattcagtgaacggagtgcagcacatttggctgctgtcagttcttattaccatgacatgtatggtcactctttgaagaaggcagtaaagaatgaaacatctgggcattttgctcatgcacttttgacaataatccaatgtgctgttaatccaggaatttattttacaaaggtgttgcgtaaggcaatgaaaggtttaggaactgatgattccacactcataagggtcattgtaacaaggactgaggttgatatgcagtatatcaaagctgaatatttaaagaaacacaagaagacactgaacgatgaagttcactcagagacatctggtcactacagagcctttcttctctcacttttgggccctaatcactaatcagtagccaagatgttcaatgatgtttcttgtggaatacattcactctctcatgtttaagtcctgacaacatgttaaatcttgcggtttctagtgttgtgattcatgtaacccatctcatttgcttttattgtgttgttatttttgtagtgctttgtgagtatgaaaactattgtcttttcttgtgcaatcaaatatgacaatcaaatagatgttaaaggagataatattttccattcaatcttac

SEQ ID NO: 1531 - DNA, 1227 bp, Cajanus cajan
aaaaacatggtatatttaattcaccacgtttacttttctactcataacttgtctctgttcccccttctcttcggtgtttttcaaagaggaagatggctaccttgagtgtacccccagttcctccttctccaagagatgatgccatgcaactttaccgtgctttcaagggacttgggtgtgatactagtgctgttatcaatattcttgctcatcgagatgccacacagcgtgcctacatccaacaagaatacagagcaatgtattctgaggaactttccaaacgcttagcttcggagctcagtggaaagctagagactgctgttctgctctggatgcatgaccctgcaagacgtgactcgacaatcattaggcagtctctaatagacagaactcttaaaggtgctactgaagttatatgttcacggagtccatcgcagctgcaatatttaaaacagatctaccattctatgtttggtgtttatgtagagcaagatattcaaataaacaccagccttggggatcatcaaaagcttttgcttgcatatttaagcacgcctcgtcacgaaggccctgaggttaatagagaaattgctgagaaggatgcaaaggttctttacaaagctggggagaagaaactaggaactgatgaaaagacttttatccacatattcagtgaacggagtgcagcacatttggctgctgtcagttcttattaccatgacatgtatggtcactctttgaagaaggcagtaaagaatgaaacatctgggcattttgctcatgcacttttgacaataatccaatgtgctgttaatccaggaatttattttacaaaggtgttgcgtaaggcaatgaaaggtttaggaactgatgattccacactcataagggtcattgtaacaaggactgaggttgatatgcagtatatcaaagctgaatatttaaagaaacacaagaagacactgaacgatgaagttcactcagagacatctggtcactacagagcctttcttctctcacttttgggccctaatcactaatcagtagccaagatgttcaatgatgtttcttgtggaatacattcactctctcatgtttaagtcctgacaacatgttaaatcttgcggtttctagtgttgtgattcatgtaacccatctcatttgcttttattgtgttgttatttttgtagtgctttgtgagtatgaaaactattgtcttttcttgtg

SEQ ID NO: 1532 - DNA, 1278 bp, Vigna unguiculata
gttgttaataataattgaaccccattgttgttatcttctcaacatttttctctgttttcccaattctcttctgagaatttcttaccggtaaagatggctactttgactgtgcccccagttcccccttctcctagagatgatgcactgcaactttaccgtgcttttaagggattgggttgtgataccagtgctgtcatcaatcttcttgctcatcgtgatgctacgcaacgtgcctacatccaacaagagtacaaaacaatgtattctgaggaactttccaaacgtttagcttcagagcttagtggaaagttagagagtgcagttcttctgtggttgaaagaccctgcaggacgtgatgcatcaatcattaggaagtctctggtagaggtgcgaagccttgaaggtgctactgaagttatatgttcacggactccatctcagctgcagtatttaaaacaggtctaccattcattgtttggtgtttatcttgaacatgatattcaagcaaacaccagccccgggagtgatcatcaaaagctgttgcttgcatatataagcacacctcgtcctgaaggtcctgaagttaacagagaaattgctcagaaggatgcaaaggttctttacaaagcaggggagaagaaactgggaactgatgaaaagacctttatccacatattcagtgaacggagtgctgcacatttggctgctgtcagtgcttattaccatgacatgtatggtcactctctgaagaaggcaataaagaatgaaacatctgggctgtttgaacttgcacttttgacaattgtccaatgtgccattcatccaggaaagtactttgctaaggttttgcataaggcaatgaaaggtttagggactgatgattccacactgataagagtgattgtgacaaggacagaggttgacatgcagtatatcaaagctgaatattcaaagaaacacaggaagactctgaatgatgcagttcactcagaaacatctggtcactacagggcttttcttctctcacttttaggccctaatatctagccaacaacatgttcaatgatgtttcatgtgcagtaaactcattctctgatggtttaagattggtttgtgatccatgtaatgtaaccgatctctgcttgtaaaataaggttgttcttgttgttgttgttgtacacttgtactagtgctttgagagtattagtttcaacctaatgcattgatgaagaactgttgtgtattaaatatgcataactatatgttttttcctgtttt

SEQ ID NO: 1533 - DNA, 1319 bp, Vigna unguiculata
  misc_feature (77)..(77): n is a, c, g, or t
  misc_feature (1287)..(1287): n is a, c, g, or t
  misc_feature (1289)..(1291): n is a, c, g, or t
  misc_feature (1293)..(1293): n is a, c, g, or t
  misc_feature (1295)..(1296): n is a, c, g, or t
  misc_feature (1298)..(1298): n is a, c, g, or t
gttgttaataataattgaaccccattgttgttatcttctcaacatttttctctgttttcccaattctcttctgagantttcttaccggtaaagatggctactttgactgtgcccccagttcccccttctcctagagatgatgcactgcaactttaccgtgcttttaagggattgggttgtgataccagtgctgtcatcaatcttcttgctcatcgtgatgctacgcaacgtgcctacatccaacaagagtacaaaacaatgtattctgaggaactttccaaacgtttagcttcagagcttagtggaaagttagagagtgcagttcttctgtggttgaaagaccctgcaggacgtgatgcatcaatcattaggaagtctctggtagaggtgcgaagccttgaaggtgctactgaagttatatgttcacggactccatctcagctgcagtatttaaaacaggtctaccattcattgtttggtgtttatcttgaacatgatattcaagcaaacaccagccccgggagtgatcatcaaaagctgttgcttgcatatataagcacacctcgtcctgaaggtcctgaagttaacagagaaattgctcagaaggatgcaaaggttctttacaaagcaggggagaagaaactgggaactgatgaaaagacctttatccacatattcagtgaacggagtgctgcacatttggctgctgtcagtgcttattaccatgacatgtatggtcactctctgaagaaggcaataaagaatgaaacatctgggctgtttgaacttgcacttttgacaattgtccaatgtgccattcatccaggaaagtactttgctaaggttttgcataaggcaatgaaaggtttagggactgatgattccacactgataagagtgattgtgacaaggacagaggttgacatgcagtatatcaaagctgaatattcaaagaaacacaggaagactctgaatgatgcagttcactcagaaacatctggtcactacagggcttttcttctctcacttttaggccctaatatctagccaacaacatgttcaatgatgtttcatgtgcagtaaactcattctctgatggtttaagattggtttgtgatccatgtaatgtaaccgatctctgcttgtaaaataaggttgttcttgttgttgttgttgtacacttgtactagtgctttgagagtattagtttcaacctaatgcattgatgaagaactgttgtgtattaaatatgcataactatatgttttttcctgttttaacagtcanannnangnnanaaaagctattactttcttcca

SEQ ID NO: 1534 - DNA, 1315 bp, Phaseolus coccineus
gggagtaaacttttctctattccctcttctcttctgagtttcttacaggaattaacatggctaccttgactgtgcccccagttcctccttcccctagagatgatgcagtgcaactttaccgtgcttttaagggaatgggttgtgataccagtgctgttatcaatattcttgctcatcgtgatgctacacagcgtgcctacattcaacaagagtacaaaacaatgtactctgaggaactttccaaacgtttagcttcagagcttagtggaaatttagagactgcagttctgatgtggttgaaggaccctgcaggacgtgatgcagcaatcattaggaagtctctaatagagatccgagacaatataggtgctactgaagttatatgttcacggactccatctcagctgcaatatttaaaacagatctaccattcattgtttggtgtttatcttgagaatgatattcaagcaaccaccagccccgggagtgatcatcaaaagctgttgcttgcatatataagcacacctcgtcctgaaggccctgaggttaatagagaaattgctcagaaggatgcaaaggctctgtacaaagcaggggagaagaaactaggaactgatgaaaagacttttatccacatattcagtgaacggagtgctgcacatttggctaccgttagtgcttattaccatgacatgtatggtcactccctgaagaaggcaataaagaaggaaacatctgggccgtttgaacatgcccttctgacaataatccaatgtgccattcatccaggaaagtattttgctaaggttttgcacaaggcaatgaaaggtttggggactaatgattccacactcataagagtcattgtgacaaggacagaggttgatatgcagtatatcaaagctgaatattcaaagaaacacaggaagactcttaacgatgaagttcactcagaaacatctggtcactacagggcttttcttctctcacttttaggccctaatatctagccaagatgtccaatggtgtttcatgtggaataaattcaccctctgatgatttaatattggtttgttgtagtttgtaattctaaatcctaaactctaaactgaaaataaggttttttgactgactgaaaatccttgtagaataagggtttgttgttgttgaacacttgtactaggatttagagagtattaatttcaacctaatgcattgatgaagaattgttgtgtattaaatataatataaaggctaggttcttcagttaagtgttcaaactatcatttttattgtaaatgaaagtttaattttc

SEQ ID NO: 1535 - DNA, 1429 bp, Phaseolus coccineus
aaattaatgtttttttaatggtagtgggccaagaagaacacgttttattcaatcattcatccttcttatcttctccaaaacttttctctattccaacttctcttctgagtttcttacaggaattaacatggctaccttgactgtgcccccagttcctccttcccctagagatgatgcagtgcaactttaccgtgcttttaagggaatgggttgtgataccagtgctgttatcaatattcttgctcatcgtgatgctacacagcgtgcctacattcaacaagagtacaaaacaatgtactctgaggaactttccaaacgtttagcttcagagcttagtggaaatttagagactgcagttctgatgtggttgaaggaccctgcaggacgtgatgcagcaatcattaggaagtctctaatagagatccgagacaatataggtgctactgaagttatatgttcacggactccatctcagctgcaatatttaaaacagatctaccattcattgtttggtgtttatcttgagaatgatattcaagcaaccaccagccccgggagtgatcatcagaagctgttgcttgcatatataagcacacctcgtcctgaaggccctgaggttaatagagaaattgctcagaaggatgcaaaggctctgtacaaagcaggggagaagaaacttggaactgatgaaaagacctttatccacatattcagtgaacggagtgctgcacatttggctactgttagtgcctattaccatgacatgtatggtcactccctgaagaaggcaataaagaaggaaacatctgggccgtttgaacatgcacttctgacaataatccaatgtgccattcatccaggaaagtattttgctaaggttttgcacaaggcaatgaaaggttttgggactaatgattccacactcataagagtcattgtgacaaggacagaggttgatatgcagtatatcaaagctgaatattcaaagaaacacaggaagactcttaacgatgaagttcactcagaaacatctggtcactacagggcttttcttctctcacttttaggccctaatatctagccaagatgtccaatggtgtttcatgtggaataaattcaccctctgatgatttaatattggtttgttgtagtttataattctaaatcctaaactctaaactgaaaataaggttttttgactgactgaaaatccttgtagaataagggtttgttgttgttgaacacttgtactaggatttagagagtattaatttcaacctaatgcattgatgaagaattgttgtgtattaaatataatataaaggctaggttcttcagttaagtgttcaaactatcatttttattgtaaatgaaagtttaattttcagacattgctactaagtatgaaatcttgtataccatccgaaac

SEQ ID NO: 1536 - DNA, 1101 bp, Cicer arietinum
atggctacacttgttgtccctccaattcctccttctcctagagatgatgccactcacctttatcgtgctttcaaaggatttgggtgtgacacaagtgctgtaatcaatatccttgctcatcgagacgctacaatgcgcgcctacatccaaatggaatacaaaactacatattccgaggaactctcgaaacgcttagcttcggagctcactggaaagttagagactgcagttctactttggatgcatgaccctgctggacgcgacgcagaaatcattagaaagtctctaattgtggacagaaaccttgaagctgctactgaagtaatatgttcgcgcacgccatcgcagctacagtttttaaaacagctctatcattcaaagtttggcgtttatctcgagcacgaaatcgaattaaacacttctggtgatcatcaaaagatcctgcttgcatttataagtactcctcgccacgaaggcccggaggttaatagagaaatttctcagaaggatgcaaaggttctctacaaagcaggggagaagaaacttggaaccgacgaaaagacttttgtccacatattcgctgagcggagcgcagcacatttggccgcagtcagttcttattatcacgacatgtatggtcactcattgcagaaggctgtaaagaatgaagcgtcggggaatttcggtcacgcacttttgactataattcaatgtgctactaatccaggaaagtattttgcaaaggtgttgcataaggcaatgaaaggtttagggacaaatgatagcacactgataagggtgattgtaacaaggactgaaattgatatgcaatatatcaaagctgaatattcaaagaaatacaagaagacactaaatgatgctgttcattctgaaacatctggtcactataggacttttcttctctcacttttgggtcctaatcactagtcaagaagatgtttttaatcatgtttcatttggaatgtttttcaaactatgatgtttaaatgttttaatttagttgtttggtgttatttgtaaggcatttgaaaggattatcatgaacatgcatttcaatttcagttagaacgtgtttggaag

SEQ ID NO: 1537 - DNA, 1262 bp, Lotus japonicus
cttcttcttcttcttcttcttcttcttctctgttttcaaagtggaaaatcaatggctacactcactgtaccccctgttcctcctaccccaagagatgatgccatgcaactttaccgtgctttcaaaggatttgggtgtgacactactgctgtgatcaatattcttgctcaccgagatgctacacagcgtgcgtacctccaacaagaatacaaagcaacatatgctgaggagctgtccaagcgtctaatttcagagcttagtggaaagttagagactgcagttctgctttggatgcatgaccccgcaggacgtgatgcaacaatcattagacagtgtctagccgtcgacatgaacttcgaaggtgctactgaagtcatatgttcacgcactccatcccagctacaatatttaaaacagatctaccattctaagtttggggtttaccttgagcatgatattgaagcaaccacatcaggggatcttaaaaagatcttgcttgcatatgttagcacacctcgtcctgaaggccctgaggtcaatagggaaattgctcagaaggatgcaaaggttctctacaaagcaggggagaagaaactaggaactgatgagaaggcttttgtccacatattcagtgaacgaagcggagcacatttggctgccattagttcttattaccatgacatgtatggtcacaagctgaacaaggcaataaagaatgaaacgtcagggattttcgctcatgcacttttgacaatattccaatgtgctgttaatccagcaaagtattttgcaaaggtgttgcataaggcgatgaaaggtttggggactaatgataccactctcataagggtcattgttacaaggactgagattgatatgcagtatatcaaagctgaatacttaaagaaatacaagaagactctgaacgatgcagttcactcagaaacatccggccactacagggcttttctcctcgcacttttgggccccaatcactagccaaaatgttcaataatgtttaatgtgagattaatccacctgtgatgtttggtcaattttaagtgttataaaatttggtcgtttgtggtgctttgtaagtgttttgaacatacactccagtttcagatagggacttgtgtaagcataatgcattgtgtgaaaactgaaaagtaagtatgactattattttgtctcgacaatattcaaatgctagattgtgattgtgcgtagaatttattatatcaatagaagggatgtaattt

SEQ ID NO: 1538 - DNA, 1286 bp, Trigonella foenum-graecum
ctatacagaggaagaagaagaagaagatggctacactaactctacctccagttccaccttctcctagagatgatgctatgcaactttaccgtgctttcaaaggatttggttgtgatacaactgctgtgatcaatattcttgctcatcgagacgccacacagcgtgcctacctccaacaagaatacaaagcaacatattctgaggagctttcgaaacgcttagtttcggagctgaaaggaaaattagagactgcagttctactttggttacatgaccctgcgggacgcgatgcagaaatcattaggaagtcgctagttgtggacagaaaccttgaagctgccaccgaagtaatatgttcgcgtactccatcccaactacaatacctgaaacagttataccattcaaagtttggcgtttatctcgagcatgaaatcgaattaaacacttccggggatcatcaaaagatcttgcttaggtatttaagcacccctcgccacgaaggcctcgaggtcaatagagacattgctcagaaggatgcaaaggttctgtacaaagcaggggaaaagaaactgggaactgatgaaaagacatttatccaaatattcagtgaacggagcggcccgcatctggctgccgtcagttcgtattatcatgacatgtatggtcactcattgaagaaggcagtaaagaatgaagcatccgggaatttcggtctcgcacttttgacaataagtgaatgtgctactaatccagcaaagtattttgcaaaggtgttgtataaggcaatgaaaggaatggggactaatgatagcacactcataagggtcattgtaacaagaactgagattgatatgcagtatatcaaagctgaatatagaaagaaatacaataaaacattgaacgatgcggttcactctgaaacatctggcaattacagggattttcttctcgcacttttgggtcccaatcactagtcaaagatgctcaatcatgtttaatttgggatatttttatcaaactatgatgtttaaatgtttaaaatttggtagtttgttgtgctttgtaagacatttctaagcattatcacgaacttgcattcgagtttcaattagggacttgtgtatttcttgtgtgtgaacatagtcatttgatatattgtttcactttatattagggactgttataataattttgttcaagttgtgtgtttatatacgaattcatgatatatgtttgagtacattgcaatttgaaactatgctgcaatttgacatgtggtgagattc

SEQ ID NO: 1539 - DNA, 1166 bp, Medicago truncatula
gagaaagaagaagaagaaaaaaaaatggctacactaattttacctccaattcctccttctcctagagatgatgccatgcaactttaccgtgcttttaaaggatttgggtgtgacacaactgctgtgatcaatattcttgctcatcgagacgctacacagcgtgcctacctccaacaagaatacaaagcaacatattctgaggagctatcgaaacgcttaatttcagagctgaaaggaaaattagagactgcagttctactttggttgcctgaccctgccgcacgtgatgcagaaatcattaggaagtcgctagttgtggacagaaaccttgaagctgccaccgaagtaatttgttcacgtactccgtcccaacttcaatatctaaaacagttataccattcaaagtttggcgtttatctcgagcatgaaattgaattaaacacatccggggatcatcaaaagatcttgcttaggtatttaaccacccctcgccacgaaggcctcgaggttaatagagaaattgcacagaaggatgcaaaggttctgtacaaagcgggggaaaagaaactgggaaccgatgaaaagacatttgtccaaatattcagtgaaaggagcagcgcgcatttggctgccgtcagttcatattatcatgacatgtatggtcactcattgaaaaaggcagtaaagaatgaagcatccgggaatttcggtctcgcacttttgacaataactgaatgcgctactaatccagcaaagtattttgcaaaggtgttgtataaggcgatgaaaggtatggggactaatgatagcacactcataagggtcattgtaacaaggactgagattgatatgcagtatatcaaagctgaatatgcaaagaaatacaagaagacactgaatgatgcagttcactctgaaacatcaggcaactacagggattttcttctcgcacttttgggtccgaatcactagtcaaagatgttcaatcatgttttcaaactatgatgtttaaatgtttaaaatttggtagtttgctgtggtttgtaagcattatcacaaacttgcatttgagtttcaattagggacttacgtatttcttggttgtgaacataatcatttgattgtttcactttatatagtatttcaaaggcctttgtggccatttc

SEQ ID NO: 1540 - DNA, 1232 bp, Medicago truncatula
cggccggggagttgacagatactcattttctttccatcgagaaagaagaagaagaaaaaaaaatggctacactaattttacctccaattcctccttctcctagagatgatgccatgcaactttaccgtgcttttaaaggatttgggtgtgacacaactgctgtgatcaatattcttgctcatcgagacgctacacagcgtgcctacctccaacaagaatacaaagcaacatattctgaggagctatcgaaacgcttaatttcagagctgaaaggaaaattagagactgcagttctactttggttgcctgaccctgccgcacgtgatgcagaaatcattaggaagtcgctagttgtggacagaaaccttgaagctgccaccgaagtaatttgttcacgtactccgtcccaacttcaatatctaaaacagttataccattcaaagtttggcgtttatctcgagcatgaaattgaattaaacacatccggggatcatcaaaagatcttgcttaggtatttaaccacccctcgccacgaaggcctcgaggttaatagagaaattgcacagaaggatgcaaaggttctgtacaaagcgggggaaaagaaactgggaaccgatgaaaagacatttgtccaaatattcagtgaaaggagcagcgcgcatttggctgccgtcagttcatattatcatgacatgtatggtcactcattgaaaaaggcagtaaagaatgaagcatccgggaatttcggtctcgcacttttgacaataactgaatgcgctactaatccagcaaagtattttgcaaaggtgttgtataaggcgatgaaaggtatggggactaatgatagcacactcataagggtcattgtaacaaggactgagattgatatgcagtatatcaaagctgaatatgcaaagaaatacaagaagacactgaatgatgcagttcactctgaaacatcaggcaactacagggattttcttctcgcacttttgggtccgaatcactagtcaaagatgttcaatcatgttttcaaactatgatgtttaaatgtttaaaatttggtagtttgctgtggtttgtaagcattatcacaaacttgcatttgagtttcaattagggacttacgtatttcttggttgtgaacataatcatttgattgtttcactttatatagtatttcaaaggcctttgtggccatttcatttctggatatttcacaggtctttcct

SEQ ID NO: 1541 - DNA, 1343 bp, Medicago truncatula
agatggctacacttgttgtacctccaattccaccttctcctagagatgatgccatgcaactttaccgtgctttcaaaggatttggctgtgacacaagtgctgtgatcaatattcttgctcatcgagatgcgacgcagcgcgcctatatccaacaagaatatcgaacaacatacgcggaggagctttctaaacgcctaatttcagagctgagcggaaagttagagactgcagttctgctttggatgcctgaccctgcaggacgtgacgcagaaatcattaggaagtctctaattgtggacaaaaaccttgaagctgctaccgaagtattatgttcgcgtgctccatcccaactccaatatctaaaacagttataccattcaaaattcggtgtttatctcgagcatgaaatcgaatcaaacacttctggggatcttcaaaagatcttgctcgcatatgtaagcacccctcgcctggaaggccccgaggtcaatagagaaatcgctgagaaggatgcaaaggttctctacagagccggggaaaagaaactcggaactgatgaaaagacttttatccaaatattcagtgaacgaagcggcgcacatttggttgccgtcagtgcttattatcatgacatgtacggtcactcattgaagaaggcagtaaagaatgaaacatcggggaattttggtcacgcacttcggacaataatacaatgtgctcataatccagcaaagtattttgcaaaggtgttgtataaggcaatgaaaggtttagggactaatgataccacactcataagggtcatcgtaacaaggactgagattgatatgaaatacatcaaagctgaatatgccaagaaatataagaagacattgaatgatgcagttcactctgaaacatctggcaactatagggcttttcttctcgcacttttgggtccgaataattagtcaaagatgttcaatcatgtttcgttatgggatattttcaaacttcgatgtttagatgttctcaacttggtagttttatgttctttgtgttgcatttgtaagcattatcatgaacttgcattcgagtttcagttagggacgtgtattgtcagcataatttacatattgaagtgttgttatttattgagtggaacaatattttcaaaacctaccggagatcgagatcgaattggcgacgccttcaagtgatggttcaatcgattgaatcacagttcgatttggttccgatttggttccgatttctgacaaagtaaaaaccatctatgcgttgaaccaatcggtggagtaacctgttcaattagttgattgtcataatataaaaaaaaaaaaaaa

SEQ ID NO: 1542 - DNA, 1310 bp, Medicago truncatula
ctgttttcactgtgagaagaacaagaagatggctacacttgttgtacctccaattccaccttctcctagagatgatgccatgcaactttaccgtgctttcaaaggatttggctgtgacacaagtgctgtgatcaatattcttgctcatcgagatgcgacgcagcgcgcctatatccaacaagaatatcgaacaacatacgcggaggagctttctaaacgcctaatttcagagctgagcggaaagttagagactgcagttctgctttggatgcctgaccctgcaggacgtgacgcagaaatcattaggaagtctctaattgtggacaaaaaccttgaagctgctaccgaagtattatgttcgcgtgctccatcccaactccaatatctaaaacagttataccattcaaaattcggtgtttatctcgagcatgaaatcgaatcaaacacttctggggatcttcaaaagatcttgctcgcatatgtaagcacccctcgcctggaaggccccgaggtcaatagagaaatcgctgagaaggatgcaaaggttctctacagagccggggaaaagaaactcggaactgatgaaaagacttttatccaaatattcagtgaacgaagcggcgcacatttggttgccgtcagtgcttattatcatgacatgtacggtcactcattgaagaaggcagtaaagaatgaaacatcggggaattttggtcacgcacttcggacaataatacaatgtgctcataatccagcaaagtattttgcaaaggtgttgtataaggcaatgaaaggtttagggactaatgataccacactcataagggtcatcgtaacaaggactgagattgatatgaaatacatcaaagctgaatatgccaagaaatataagaagacattgaatgatgcagttcactctgaaacatctggcaactatagggcttttcttctcgcacttttgggtccgaataattagtcaaagatgttcaatcatgtttcgttatgggatattttcaaacttcgatgtttagatgttctcaacttggtagttttatgttctttgtgttgcatttgtaagcattatcatgaacttgcattcgagtttcattaggacgcgtattgtcagcataatttacatattgaagtgttgttatttattgagtggaacaatattttcaaaacctaccggagatcgagatcgaattggcgacgccttcaagtgatggttcaatcgattgaatcacagttcgatttggttccgatttggttccgatttctgacaaagtaaaaaccatctatgcgttgaacca

SEQ ID NO: 1543 - DNA, 1146 bp, Trigonella foenum-graecum
atttcattgaaaggaagaacacgaaaatggctacacttgttgtacctccagttcctccttctcctagagatgatgccatgcaactttaccgtgctttcaaaggatttggctgtgacacaagtgctgtgatcaatattcttgctcatcgagatgcgacgcagcgatcctacatccaacaagaatatcgaacaacatacgcggaggagctttctaaacgcttagtttcagagctgagtggaaagttagagactgcagtcctgctttggatgcctgaccctgcaggacgtgacgtagatatcattaggaagtctctaattgtggacaaaaaccttgaagctgctaccgaagtaatatgttcgcgtactccatcccaactacaatatctaaaacagatataccattcaaaatttggtgtttatctcgagcatgaaatcgaatcaaacacttctggggatcttcaaaagatcttgctcgcatatgtaagcacccctcgcctggaaggccccgaggttaatagagaaatcgctgagaaggatgcaaaggttctctacagagccggggaaaagaaactcggaactgatgaaaagacttttgtcgaaatatttagtcaacgaagtggcgcacatttggttgccgtcagttcttattatcatgacatgtacggtcactcattgaagaaggcagtaaagaatgaaacatctgggaatttcggtctcgcacttctgacaataattaaatgtgctactaatccaccaaagtattttgccaaggtgttgtataaggcaatgaaagggttagggactaatgataacacactcataagggtcattgtaacaaggactgagattgatatgaaatacatcaaagctgaatatgcaaagaaatacaagaagacattgaatgatgcagttcactccgaaacatctggccaatacagggcttttcttctcgcacttttgggtccgaataattagttaagatgttcaatcatggttcattatggaatctttacaaactttgatgctttaatgttttaaacttggtagttttttgtgctttgtaatgcatttgtaagcattgtaataaacttgcattcaagtttcagttagggacttgtgtattgtctgcataattcacatattgaag

SEQ ID NO: 1544 - DNA, 1333 bp, Arachis hypogaea
gggaacataaataaacttatctaatcaaagagagtttttcctacctaattcctttgccttcgtcctcttctctaaaaagaactattttttctttattcttgtgtggtgtattcactttccatagaagaagaagaagaacatgtctactttgattgtacccccaattcctccttccccaagagatgacgccatgcaactttaccgtgctttcaagggatttgggtgtgacactagtgccgttatcaatatccttgctcatagagatgcgacacagcgagcctacatccaacaagaataccgaacaatatattccgaggaactttctaaacgcctcgagaaggaacttcgtggaaagttagagactgcagttctgctttggatgcatgatcctgcaggacgcgatgcaacaatcgttaggaagtgtctaactgtggatgcaaacatccaaggtgctaccgaagtaatatgttcacgcactccatcccagctgcaacatttaagacagatctatcattccaaatttggtacctatatggagcatgatattgaagcaaccaccttcggtgaccataaaaagatcttgctcgcatttttaactacacctcgacatgaaggctatgaggttaatagagaaatagctcagcaagatgccaagtttctctacaaggcaggggaaaagaaacttggcaccgacgagaaggcttttattcgcattttcagtgaacggagtgcagcacatttggctgctatcagctcttattaccacgatatgtatggtcactcactcgagaaggcagtaaagaatgaaacatcaggacattttgcttatgctcttttgacaatagtccgatgtgctgagcatcctggaaagtattttgcaaaggtgttacataaggcgatgaaaggtttggggacgaatgatgccacgcttataagggtcattgtaacgaggactgagattgacatgcagtatatcaaagctgaatatttgaagaaatacaggaagacactgaacgatgcagttcattctgagacatctggtcactacagggattttcttctccaacttttgggtccaaatgtgtagttaacaattcaacatgttcgatgcccctatgatgttgaactaataagaagctacaaccttgtattttattttatgtttaaagaacaatgattcagttaggcaatgtgtagtgctttgtaaggattatgtacatcatgatccagtttgagtgaaggatttgtgtttgtaaacatatgatgggcttttgtgaattgtgtaactaatgttgcttttcatattgaccataaccaactttgcatgatgcta

SEQ ID NO: 1545 - DNA, 1233 bp, Glycine max
aaaactcggatcccctttatgttgtttattttgatttggagtggttccatcgggagtttggatggccaccttgaatgttccccctcttcctccttcaccgagagacgatgccatacaactttacgctgctttcaaaggatttggatgcgatactagcgttgtgatcaatatacttgctcatcgagatgctacccagcgtgcctacatccaacaagaatacaaagcaatgtattctggggatcttctcaaacgcttatcttcagagctttctggcaagttggagactgcactactgctttggatgcacgaccctgccggacgtgatgcaatcatccttaggcagtctctaaccctgcccaaaaatcttgaagctgccactcaacttatatgttctcgaactccatcccagcttcattatttaagacagatttatcattctaaatttggtgtttatcttgagcatgacattgaaacaaacacctccggggatcataaaaagattttgcttgcatatgtaaccacaccacgtcatgaaggccctgaggtaaatagagagatggctgagaaggatgcaaaggttctctacaaagcaggggagaagagactgggaaccgatgagaagacttttgtgcaaatattcagcgaacggagtgcggctcatttggctgctataacttcttattaccatagcatgtatggacactcgttgaaaaaggcagtaaagaaggaaacatcaggaaattttgctcttgcacttctgacaatagttcaatgtgctgagaatcctgcaaagtattttgccaaggtcttacgcaaggcaatgaaaggtttggggactgatgacacaaaacttataagggtgatagtaacaagggctgagattgatttacagtatatcaaagctgaatatttaaagaaatacaaaaagacgcttaacgatgcagttcactcagaaacatccggccactacagggcttttcttctctcactcttaggtcccaaccagtagtaaaaaatgttcaacgatgttttgtgtggaatgaattcagcgtatgatgtttgaatatatgagcagtaccaatattttctgtattgatattgtaaattaggtagtgcgtggtgctttttatgtaatatgtacacacaatttggtttcagcatgcatttgcttgtcatcagagttgaaaatgtgtatgatttttgcaagtttcataaaaacttggaatgacgatg

SEQ ID NO: 1546 - DNA, 2010 bp, Glycine max
aaagaaaaatctaatagtatactagcatagttatttccttccacaccaacagttttgtgagtgaagcctttccagtgtgcagctgcatctgcagccggttcaatcattcaaaattgtcaagttgtttggtttggagcaatcatcattgtccaaattgcaattttttcagaaggatagcaagaatttgggaagttgctgaagcaatagggagtagtggatacggtttaggatcattgttataataggcaaaattgatggtaatcgtacatagtggctaggaagggatataatggctactgctgcagttattggactcagtggaggaaagaggctcttgagttcatcataccattactctgatattatagaaaagctttcttatggcagtgattttggatccacacactaccaaattgttcctacaaaatctttaatagttgccaagaagtcatccaactatactccaacttttccagcatcgaaccagcagaatcagtccattaaggctcttaaggagcatgttgatgatgcccctaccattgcggatccatggtttcagagttacaactctaatgacttagaggtggaaagctctgaaatgggttattctgtggaggctcttcttttgctgcagaagtcaatgctggaaaagcaatggaacctttcctttgaaagagaagtgcttactgaaaattcgagtaagggaaaaaaatgtaggaaagtggcggtgacttgttctggggtgtctgcaaggcaaagaagaatgaataccaagaggaagaccgctattaaaacttgtggtgctatgcagctgaagtccaaaatcagtccagagctgcttcaacaccgtttgaagggctacgtaaaaggtctagtgagtgaggaattgctctctcatgcagaagttgtaaacctatcggagaaaataaaagttgggctttccttagaggaacataaatccagactgaaggaaaaactaggatgtgaaccctctgatgatcaaatggcaacttctttgaagatttctcgcactgaactacgagcaagaatgatagagtgctctctggcaagagaaaagttggctatgagcaatgtacgcttagttatgtctattgcccaaaagtatgataacctgggtgcagaaatgggtgaccttgttcagggtggcttgattggattactgcgtggtattgaaaagttcgattcttcaaaagggtttaagatttcaacttatgtttattggtggatacgtcagggtgtttcaagagctttagttgagaattcaagaacattaagattgcctgctcatttgcatgagagattatctctaatccgcaatgcaaagtttagactagaagagagaggcattactccaactattgataggattgcaaaataccttaacatgtctcaaaagaaagtcagaaatgctactgaggcaatcagcaaaattatctcgcttgatagagaagcattcccctctctgaatggtctacaaggagaaactcatcatagttatattgcagataatcgagtggagaacatcccatggaatggagtagacgagtgggcactaaaggatgaagtgaacagactcattaatgtgacccttgtggaacgagagagagaaattattcgactttattatggactggaaaaagaatgtcttacgtgggaagacataagcaaacggataggtttgtcaagagaaagagtaaggcaagttggacttgttgcattggagaaactaaaacatgctgcgaggaagagacaaatggaagccatgctattgaaacattaaatttggactcatcatagaaatatgttacaatgtatatatacagagaggaagtatgtacctagaaatttgacttcccgattcaaaaagaggacaatcatataagggaacattgaagatttgtaaatccctttaaatatggtgttagtaccaataaatatgggtaatttttgttttaatactccaaaagaaattgttgctttaagttctca

SEQ ID NO: 1547 - DNA, 2178 bp, Cajanus cajan
atacaaataataacaaataatatgataataaaaggagggaaaaataaagaagaaaaaaaatctaatagtagtagcacagttatttccttccacaccaacagttttgtgagtgaagcctttcagtgtaaagctgcagctgcagctgattcaaaaattgttaagcttttcgttttggagcaataatcattgtccagattgtgatttgttcagaaggtaagcaacaatttgggaagtttctgaaggcaataggagtagaagacacggtttaggatagtttttataataaggaaatttgatggtaaatggtaatcatacacagtggctaggaaggaatataatggctactgctgcagttattggactgagtggaggaaagaggctcttgagctcatcatatcattactctgatattatagaaaagctttcttgtggcagtgattttggatccacacactatcagattgctcctacaaaatctgtgatagtttctaagaaatcatccaactacacttctacttttccagcatccaacaggcagaatgagtccattaaggctcttaaggagcatgttgatggtgcccccaccactgctgatccatggtttcatagttgcaattctaatgaattggaggtggaaagttctgaaatgggttattctgtggaggctcttcttttgttgcagaagtcaatgctggaaaagcaatggaacctttcctttgagagggaagtgctaacggagcattcaagtaaagaaaaaaactgtaggaaagtggcagtgacttgttctggggtgtctgctaggcaaagaagaatgaatctcaagaggaagactgcagttaaaaccggctcgtcaatggtgcaaccttgtggtgctgtgcagctgaagtcaaaaatcagtccagagctgcttcaaaatcgtttgaagggctatgtgaaaggtgtagtgagtgaggagttgctgtctcatgcagaagttgtaaacctatcagagaaaataaaagttgggctttccttagatgagcacaaatccagactgaaggaaagactaggatgtgaaccctctgaggatcaaattgcaacttcattgaagatttcgtgcactgaactacgagaaagaatgttagagtgctctctggcaagagaaaagttgactatgagcaatgttcgcttagttatgtctattgctcaaagatatgataacctgggtgcagaaatggctgaccttgttcagggtggcttgattggactactgcgtggtattgaaaagtttgattcttcaaaagggtttaagatttcaacttatgtttattggtggatacgtcagggtgtttcaagagctttaattgagaattcaagaactttaagattgcctgctcatttgcatgagagattatctttaatccgcaacgcaaagtttagactagaagagagaggcattactccaactattgagaggattgcaaaacaccttaacatgtctcaaaaaaaagttagaaatgctactgaggcaatcagcactgttatctcatttgacagggaagcattcccctctctgaatggtatacaaggagaaactcatcatagttatattgcagataatcgtgttgagaacatcccttggaatggagtagatgagtgggccctaaaggatgaagtgaacaaactcattaatgtgacccttgtggaacgagagagagaaattattcgtctttattatggactggataaagaatgtcttacgtgggaagacattagtaaacggataggtttgtcaagagaaagagtaaggcaagttggacttgttgcattggagaaactaaaacatgctgcgaggaagagagaaatggaggccatgcttttgaaacattaaatttggacttatcatagagatatttacaatgtatatatacagagaggaagtatgtacctagaaatttgacttcctgattcaaaaagaggacagtgatataagggaacattgaaaatttgtaaatccctttaaatgtggttttagtccaataaatatgggtaaatttggttttaatactcaaaaaaaaatgttgctgagatggttctcataaatttttatatttttttaaatggtttttatcatcatctgagtatttgacagtaacatgatatgtattttgttatatcaatagtcattttgagatgata

SEQ ID NO: 1548 - DNA, 2013 bp, Phaseolus coccineus
cacaccatcaagaacaaataaaaggagggaaaaagaaagagaaaaaaaatctaactgttctgtgagtgaagccttttcaattggtgcagctgattcaatgattcaaattccaaattaaggattgagagaatttgggaagcttctgaaggaagtagtggagacggtttaggatcattgttacagtaggaaaatatgaattgatggtaatcttagggatataatggctagtgctgcagttattggactcagtggagggaagagattgttgagttcatcttatcattactctgatattatagaaaagctttcttatggaagtgattttggatccacacactatcagattgtttcaacaaaatctgtgatagttgccaagaagtcatccaactacactccaacttttccagcaccgaaccggcagaatcagtccattaaggttcttaaggagattgttgatgatgctgctaccgttgcggatgcatggtttcagagtttgagttctaatgacttggaagtggaaagctctgaaatgggttattctgtggaggctcttcttttgctgcagaagtcaatgctggaaaagcaatggagcctttcctttgaaggggaaggggtaacagaacattctagtaaagaaaaaaactgcaggaaagtggcagcggtgacctgttctggggtgtctgcaaggcaaagaagaatgaatgccaagcggaagaccgcggttaaaaccggtggtgctgtgcagctgaagtccaagatcagtccagagctgcttcaaaaccgtttgaagggctatgtgaaaggagtagtgagtgaggaattgctctctcatgcacaagttgtaagcctatcagagaaaatcaaagttgggctttccttagaggagcataaatccaggatgaaggagagactaggatgtgaaccctctgacgatgaaattgcaacttcattgaagatttctagtactgaactacgagaaaaaatgctagagtgctctctggcaagagaaaagttggctatgagcaatgttcgcttagtgatgtctattgctcaaagatatgaaaacgctggtacagaaatgggtgaccttgttcagggtggcttgattggactacttcgtggtattgagaagtttgattcttcaaaagggtttaagatttcaacttacgtttactggtggatacgtcagggtgtttcaaaagccttaattgagaattcaagaacattaagattgcctgctcatttgcatgagagattatctttaatccgcaatgcaaagcttagactagaagagagaggcattactccaactattgataggattgcacagcaccttaacatgtctcaaaagaaagtcagaaatgctactgaggcaatcagcaaaactatctcgcttgatagagaagcattcccctctctgaatggtctacgaggagacactcatcatagttacattgcagataatcgcgttgagaacatcccctgggagggagtagatgagtgggcattaaaggatgaagtgaacagactcatcaatgtgacccttaaggaacgagagagagaaattattcgactttattatggactgggtaaagaatgtcttacatgggaagacattagtaaaaggatgggtttatcaagagaaagagtaaggcaagttgggcttgttgcattggagaaactaaaacatggtgcaaggaatagagaattggaggccatgctattgaaacattaaatttggactcatcacagaaatttgatacaatgtatatatacagagcggaagaatgtacctagaaatttcacttcctcattcaaaaagaggacaacgatataagggaacatgcaagatttgtaaatcccccttcaaatatggttttagtaccaatgaatatgggtaattttggttttaggcaaattctccctacacaaaataatgctccctaaaccctaaatataccctacataattttaagtttttgaaaatgcttttcatttttaaatgaaaatttg

SEQ ID NO: 1549 - DNA, 1911 bp, Phaseolus coccineus
  misc_feature (118)..(118): n is a, c, g, or t
  misc_feature (147)..(147): n is a, c, g, or t
  misc_feature (186)..(186): n is a, c, g, or t
  misc_feature (893)..(893): n is a, c, g, or t
  misc_feature (898)..(899): n is a, c, g, or t
  misc_feature (1591)..(1591): n is a, c, g, or t
  misc_feature (1615)..(1615): n is a, c, g, or t
cacaccatcaagaacaaataaaaggagggaaaaagaaagagaaaaaaaatctaactattttgtgagtgaagccttttcaattggtgcagctgattcaatgattcaaattccaaattanggattgagagaatttgggaagcttctganggaagtagtggagacggtttaggatcattgttacagtangaaaatatgaattgatggtaatcttagggatataatggctagtgctgcagttattggactcagtggagggaagagattgttgagttcatcttatcattactctgatattatagaaaagctttcttatggaagtgattttggatccacacactatcagattgtttcaacaaaatctgtgatagttgccaagaagtcatccaactacactccaacttttcctgcaccgaaccggcagaatcagtccattaaggttcttaaggagattgttgatgatgctgctaccgttgcggatgcatggtttcagagtttgagttctaatgacttggaagtggaaagctctgaaatgggttattctgtggaggctcttcttttgctgcagaagtcaatgctggaaaagcaatggagcctttcctttgaaggggaaggggtaacagaacattctagtaaagaaaaaaactgcaggaaagtggcagcagtgacctgttctggggtgtctgcaaggcaaagaagaatgaatgccaagcggaagaccgcggttaaaaccggtggtgctgtgcagctgaagtccaagatcagtccagagctgcttcaaaaccgtttgaagggctatgtgaaaggagtagtgagtgaggaattgctctctcatgcacaagttgtaagcctatcagagaaaatcaaagttgggctttccttagaggagcataaanccagnntgaaggagagactaggatgtgaaccctctgacgatgaaattgcaacttcattgaagatttctagtactgaactacgagaaaaaatgctagagtgctctctggcaagagaaaagttggctatgagcaatgttcgcttagtgatgtctattgctcaaagatatgaaaacgctggtacagaaatgggtgaccttgttcagggtggcttgattggactacttcgtggtattgagaagtttgattcttcaaaagggtttaagatttcaacttacgtttactggtggatacgtcagggtgtttcaaaagccttaattgagaactcaagaacattaagattgcctgctcatttgcatgagagattatctttaatccgcaatgcaaagcttagactagaagagagaggcattactccaactattgataggattgcacaacaccttaacatgtctcaaaagaaagtcagaaatgctactgaggcaatcagcaaaactatctcgcttgatagagaagcattcccctctctgaatggtctacgaggagacactcatcatagttacattgcagataatcgcgttgagaacatcccctgggagggagtagatgagtgggcattaaaggatgaagtgaacagactcatcaatgtgacccttaaggaacgagagagagaaattattcgactttattatggactgggnaaagaatgtcttacatgggaaganattagtaaaaggatgggtttatcaagagaaagagtaaggcaagttgggcttgttgcattggagaaactaaaacatggtgcaaggaatagagaattggaggccatgctattgaaacattaaatttggactcatcacagaaatttgatacaatgtatatatacagagcggaagaatgtacctagaaatttcacttcctcattcaaaaagaggacaacgatataagggaaaatccaagatttgtaaatcccccttcaaatatggttttagtaccaatgaatatgggtaattttggtttt

SEQ ID NO: 1550 - DNA, 1668 bp, Lotus japonicus
gggagtaatggctactgctgcagttattggactcagtggagggaagaggctattgagttcatcttactattactctgatattatagaaaagctttcttgtagcagtgactttgggtccacacactatcagattgttcctgcaaaatcggtaacggttgccaagaagtcatccgactacacacaagcttttccggcatctgatcggccgaatcagtctatcaaggctcttaaggaacatgttgatggtgtccctgctgctgcagagacatggtttcaagaatgcgattctaatgacttagaggtggaaagctctgacttgggttactctgtggaggctcttcttttgctgcagaagtcaatgcttgaaaagcagtggagcctttcatgtgagagagaagttcttacggagcatccgaggcaagagaaaagcagtaagaaagtggcagtaacttgttccggggtgtctgcgaggcaaagaagaataaataccaagaggaagatccctggtaaaactggctctgcgatgcaagcttgtgatgctatgcagatgaggtccttgatcagtcctgaactgcttcaaaaccgttcgaagggctatgtgaaaggtgtagtgagtgagcaattgctctctcatgctgaagttgtaaagctatcggagaaaattaaagttggcctttccttagatgagcataagtccagactgaaggaaaaattaggatgtgaaccctcagatgatcaaattgcagcttcattgaagatttctcgatctgaactacgagcaaaaacgatagagtgtactttggcaagagaaaggctggctatgagcaatgttcgattagttatgtctattgctcaaagatatgataatatgggggctgaaatggctgaccttgttcagggtggcttgattggactacttcgtgggattgagaaatttgattcttcaaaagggtttaagatttcaacttatgtttattggtggatacgtcagggggtttcaagagctctagttgagaattcgagaacattaagattgcctactcatttgcatgagaggttatctttgatccgcactgcaaagtttagactggaagagagaggcattactccaactattgatagaattgcaaaaagccttaacatgtcccaaaagaaagtcagaaatgctacagaggctatcagcaaagttttctcgcttgatagggaagcattcccctctctgaatggtcttccaggagatactcatcattgttacattgcagataatcgactggagaacatcccatggcatggagtagatgagtggacactgaaggatgaagtgaacaaactcatcaatgtgacccttgtggaacgagagagagaaattattcgtctttattatggattagataaagaatgtcttacgtgggaagacattagtaaacggataggattgtctagagaaagagtaaggcaagttgggcttgttgcattggagaaactaaaacatgccgcaaggaagagagagatggaggccatgctattgaaacattgatataactcttcatgaagacatattacagtgtatatatacagaaaggaaggatgtacctagaaaattgtcttccttgtccaaaatagatgaaagaggacgatacaagggaacattgaagatttgtaaacctt

SEQ ID NO: 1551 - DNA, 1964 bp, Medicago truncatula
cctcgtgccgaatcggcacgaggggaacaaagagagcagagaaacactatgcatcacacaccatctcaactccggtccccatatctgtttcaaccaataacatctcttctttccatatctttatctattcatttttctccttttctatttaatttaatttttcctttcatctcttctttcccctaaccaaatttaaccttccactctatattaataataaataataaaaagcagaaaaaaaataaaaaaaataaaatctagtaatagctagcagcaagaaggttttttccagtgtgcagctggatagcttattcagtggttctaaaagttctaaactatacatttttgcatagttgcaattttttaagaacttgggaagtttctgaaagaaataggttcagttgatttatagtataataggaaaaattgatggtataataatggctactgcagcagttattggattaagtggaggaaagaggctattgagttcatcttatcattattcagatattatagaaaagttttctcatgcatgtgactttggttccacacagtatcaacttcctccttcaaaatctgtaatagttgcaaagaaatcatcaaaatacactccaacttttccaccagaaaggaagaatcagtctatcaaggcacttaaggaacacgttgtcgatagcgcgcaagctgattcggaacaatggtttcagggatacaattctaatgactttgaggttgaaagctctgacatggattattcattggattcacttcttttgctgcagaagtcaatgttggaaaagcaatggagtctttcgtttgaaaggaaagtgttgagtgagaattcgaggagagaaaagatccggaggaaggtatcggtgacttgttctggagtgtctgcaaggcaaagaagaatgacaaccaagaggaaggttgctgctaaaagtggttctgcagtgatgcagctgaggtctacaatcagtcccgaacttattcaaaaccgtttgaagggatatgtgaaaggtgtcgtgtgtgacgaattgctctctcatgctgaagttgtaaagctatcggagaaaattaaagctggcctttctttagatgagcataaatccagactgaaggaaagattaggaagtgaaccttccgatgatcaagttgcaacttcgttgaagatttctcgagctgatctacgagctaaaataatagagtgctctttagcaagagaaaagttaactatgagcaatgttcgcttagttttgtcgattgctcaaagatatgataatatgggtgctgaaatgggcgaccttgttcagggtggcttgattggactacttcgtgggattgagaagtttgattcttcaaaagggttcaagatttcaacttatgtttattggtggatacgacagggtgtttcaagagctctagttgagaattcaagacattaagattgcccgctcatttgcatgagaggttatctctgatccgcaatgcagagtataaactcgaagagagaggcatcactccaactattgatagaattgcaaaaagccttaatatgtctcaaaggaaagtcagaaatgctactgaggctacaagcaaagttttctccttagatagggaagcattcccctctctgaatggtcttccaggagacactcatcatagctttattgcagataaacaaaatgagaacatcccatggaatgtagtagatgagtgggctctaaaggaagaagtgaacagactcattaatctgacccttgtggaacgagagagagaaattattcgtctttattatggattggataaagaatgtcttacatgggaagacattagtaaacggataggtttgtcgagagaaagagtaaggcaagttggacttgttgcattggagaaactaaaacatgccgcaaggaaaagggagatggaaaccatgcttttgaaatattgatatgatggac

SEQ ID NO: 1552 - DNA, 1963 bp, Medicago truncatula
cctcgtgccgaatcggcacgaggggaacaaagagagcagagaaacactatgcatcacacaccatctcaactccggtccccatatctgtttcaaccaataacatctcttctttccatatctttatctattcatttttctccttttctatttaatttaatttttcctttcatctcttctttcccctaaccaaatttaaccttccactctatattaataataaataataaaaagcagaaaaaaaataaaaaaaataaaatctagtaatagctagcagcaagaaggttttttccagtgtgcagctggatagcttattcagtggttctaaaagttctaaactatacatttttgcatagttgcaattttttaagaacttgggaagtttctgaaagaaataggttcagttgatttatagtataataggaaaaattgatggtataataatggctactgcagcagttattggattaagtggaggaaagaggctattgagttcatcttatcattattcagatattatagaaaagttttctcatgcatgtgactttggttccacacagtatcaacttcctccttcaaaatctgtaatagttgcaaagaaatcatcaaaatacactccaacttttccaccagaaaggaagaatcagtctatcaaggcacttaaggaacacgttgtcgatagcgcgcaagctgattcggaacaatggtttcagggatacaattctaatgactttgaggttgaaagctctgacatggattattcattggattcacttcttttgctgcagaagtcaatgttggaaaagcaatggagtctttcgtttgaaaggaaagtgttgagtgagaattcgaggagagaaaagatccggaggaaggtatcggtgacttgttctggagtgtctgcaaggcaaagaagaatgacaaccaagaggaaggttgctgctaaaagtggttctgcagtgatgcagctgaggtctacaatcagtcccgaacttattcaaaaccgtttgaagggatatgtgaaaggtgtcgtgtgtgacgaattgctctctcatgctgaagttgtaaagctatcggagaaaattaaagctggcctttctttagatgagcataaatccagactgaaggaaagattaggaagtgaaccttccgatgatcaagttgcaacttcgttgaagatttctcgagctgatctacgagctaaaataatagagtgctctttagcaagagaaaagttaactatgagcaatgttcgcttagttttgtcgattgctcaaagatatgataatatgggtgctgaaatgggcgaccttgttcagggtggcttgattggactacttcgtgggattgagaagtttgattcttcaaaagggttcaagatttcaacttatgtttattggtggatacgacagggtgtttcaagagctctagttgagaattcaagaacattaagattgcccgctcatttgcatgagaggttatctctgatccgcaatgcagagtataaactcgaagagagaggcatcactccaactattgatagaattgcaaaaagccttaatatgtctcaaaggaaagtcagaaatgctactgaggctacaagcaaagttttctccttagatagggaagcattcccctctctgaatggtcttccaggagacactcatcatagctttattgcagataaacaaaatgagaacatcccatggaatgtagtagatgagtgggctctaaaggaagaagtgaacagactcattaatctgacccttgtggaacgagagagagaattattcgtctttattatggattggataaagaatgtcttacatgggaagacattagtaaacggataggtttgtcgagagaaagagtaaggcaagttggacttgttgcattggagaactaaaacatgccgcaaggaaaagggagatggaaaccatgcttttgaaatattgatatgatggac

SEQ ID NO: 1553 - DNA, 1300 bp, Glycine max
gtacttgggagctctcggctcgctaaccccagctacttctccctcatccactcacaaaatgtgccaggccctctccgccccatcgcctccgtgtacggctcttctctccttccttttcttcctcctcacggtggtgggcccggtctcggtctcggcatggcggccgtggccccagaaaaacaatatgaacaccaccgattacgccttcggggactccaagaaatacgaggggtcctcggagttcgtgaagctgaggtaccacatgggaccggtcctcacgaccaacatcactgtccacaccatctggtacggcaagtgggagcggaaccagaagaagatcatccgcgagttcataaactcaatatccgcggcgaactcggcgcacccctccgtggccgggtggtggcgcaccgtacagctctacacggaccaaaccggggccaacatttcaaaatcggttcgactcggcgaggagaagaacgaccggttctattcccacgggaaatccctgacccgcttatccatacagactgtgataaagagcgccatcacagccaaaacgaggccgttgccgatcaaccctaggagtgggttgtacctcttgctcacggccgatgacgtgtacgttcaggatttctgcacgtcggtgtgtgggttccactacttcacgtttccctcgttggttgggtatactcttccgtacgcttgggtgggtaactccgctaagttctgccccggtcagtgtgcttatccctttgcggtgcccgcgtatatccctaaccggaaaccgtttaagtccccgaacggcgacgttggggtcgacggcatgattagtgtgattggacacgagatggctgagctggccacaaaccctttggccaatgcttggtatgcgggtcaggacccttctttccccgtcgagattgccgatctgtgtgaggggatttacggcactggcggcggtggatcctacaccggtcaggttttggacgctcgagatggcgccacgtataacatgaatgggatcagacggaggttccttgttcagtgggtgtggagccacgttctcaattactgtactggacctaatgcgcttgatcattgatcatctcgtcaggaccagatatttcttcttctcttcttttaacctttgctttgggctttgttcttgtgggttttgtgggagtctggtaattttgttaaggtagttaagtttgttcattgatgcaaataatgtaattttattgttattgttatatcatagttattataagccttttttggtgtcacggtcaccgta

SEQ ID NO: 1554 - DNA, 1311 bp, Vigna unguiculata
ctcggctcactaaccccagcttctgttctaccacctcctcatactctcaaaatgtgccagggtctctccgccgcatcgccgccgttcgcggcgtttctatcccttaccctcgttgttttctccctccttgccggaggtccggtcgcggcttggcggccctggccccagaacggtaaaatgaacgtcacggactacgccttcggagactccaagaaatacgaggggtcctcggagttcgtgaagctcaggtaccacatggggccggttctcaccaccaacatcaccgtccacacaatctggtacggcaagtgggaccggagccagaagaagataatccgcgagttcataaactcaatctccgccacgaactcgccgcacccctccgtcgcggggtggtggcggaccgtacagctctacacggaccagaccggagccaacatttcgaaaactgttcgactcggggaagagaagaacgaccggttctactctcacgggaaatcgctgacccggttatccatacagtctgtgataaaaagcgccatcaccgcgaaaacccgtccattgccgatcaacccgaggagcgggttatatctcctgctgaccgcggatgacgtgtacgttcaggatttctgcacttcggtgtgtgggttccactatttcacgtttccgtcgttggttgggtatactcttccgtacgcgtgggtgggtaactccgcaaagctctgccccgggcagtgtgcttacccttttgccctgcccgcctacatccctaaccagaaaccgttcaagtccccaaacggcgacgttggcgtggatggcatgataagtgtgattgggcacgagatggctgagctggcatccaaccccttggccaatgcttggtacgccggtcaggacccctctttcccggtggagatcgccgatctctgcgagggcatttacggcaccggcggcggtggatcctacaccggtcaggttttggacgctcgtgatggtgccacctataacatgaacgggatcagacggaggttcctggttcagtggctgtggagccacgttctgaattactgtaccggacctaatgcgcttgatcactgatctgtgctctacaatcagcaccacctctttcttcctttttttactctgtttttctttgctccctttgctttggtcttgtgggtctgtgggaatctgctaattttgttaaggtagttaagtttgttcattaatgcaaataatgtaattttattattgttatatcatagtatatggattatgaagaacctttttgttgtgaaaaaaaaaaaaaaa

SEQ ID NO: 1555 - DNA, 1291 bp, Phaseolus coccineus
aaccaccacgtttcgtacttcggagctctctcctcacacactacttccaaaatgtgcctgggcctctccgccccagcgccgccgtccacggtggttttgtttttctccctcttccttttcgccctcctcgccggggggcccgtcgcggcatggcggccctggccgcagaccgcccaaatgaacgtcacggactacgcctttggggactccaagaaatacgaggggtcctcggagttcgtgaagctccggtaccacatggggccggttctcaccaccaaaatcaccgtccacacaatctggtacggcaagtgggagcggtcccagaagaagataatccgcgagttcataaactcaatctccgccgcgaactcgccgcacccctccgtggcggggtggtggaggaccgtgcagctctacacggaccagaccggcgccaacatttcgaaaacggttcggctcggggaagagaaaaacgaccgtttgtattctcacgggaagtcgctgacccggttatccattcagtccgtgataaaaagcgccatcacggcgaggactcggccgttaccgatcaaccccagaagcgggttgtatctgctgctgaccgccgatgacgtgtacgttcaggatttctgcacttcggtgtgtgggttccactacttcacgtttccctcgttggttgggtacactcttccgtacgcttgggtgggtaactccgccaagctctgccccgggcagtgtgcttatcccttcgccgtgcccgcgtacatccctaacctgaaaccgttcaagtccccaaacggcgacgttggggtggacggcatgataagcgtgattggccacgagatggcggagctgaccaccaaccccttggccaatgcctggtacgccggtcaggacccctctttcccggtggagatcgccgatctctgcgagggcatttacggcaccggcggcggcgggtcctacaccggtcaggttctggacgctcgtgatggtgccacgtataacatgaacgggatcagacggcggttccttgttcagtggctctggagccacgttctgaattactgcactggacccaatgcgcttgatcactgatcaacttgtcttctacgatcacctaccgttttttttttttcctttctgtttttctttgctccgttcgttctggggtttgtgggaatctgctaattttgttaaggtagttaagtttgttgattaatgcaaataatgtaattttattattgttatatgatagtatatggattatgaaagtgtttttttgggtaaa

SEQ ID NO: 1556 - DNA, 1297 bp, Vigna unguiculata
ctcggctcactaaccccagcttctgttctaccacctcctcatactctcaaaatgtgccagggtctctccgccgcatcgccgccgttcgcggcgtttctatcccttaccctcgttgttttctccctccttgccggaggtccggtcgcggcttggcggccctggccccagaacggtaaaatgaacgtcacggactacgccttcggagactccaagaaatacgaggggtcctcggagttcgtgaagctcaggtaccacatggggccggttctcaccaccaacatcaccgtccacacaatctggtacggcaagtgggaccggagccagaagaagataatccgcgagttcataaactcaatctccgccacgaactcgccgcacccctccgtcgcggggtggtggcggaccgtacagctctacacggaccagaccggagccaacatttcgaaaactgttcgactcggggaagagaagaacgaccggttctactctcacgggaaatcgctgacccggttatccatacagtctgtgataaaaagcgccatcaccgcgaaaacccgtccattgccgatcaacccgaggagcgggttatatctcctgctgaccgcggatgacgtgtacgttcaggatttctgcacttcggtgtgtgggttccactatttcacgtttccgtcgttggttgggtatactcttccgtacgcgtgggtgggtaactccgcaaagctctgccccgggcagtgtgcttacccttttgccctgcccgcctacatccctaaccagaaaccgttcaagtccccaaacggcgacgttggcgtggatggcatgataagtgtgattgggcacgagatggctgagctggcatccaaccccttggccaatgcttggtacgccggtcaggacccctctttcccggtggagatcgccgatctctgcgagggcatttacggcaccggcggcggtggatcctacaccggtcaggttttggacgctcgtgatggtgccacctataacatgaacgggatcagacggaggttcctggttcagtggctgtggagccacgttctgaattactgtaccggacctaatgcgcttgatcactgatctgtgctctacaatcagcaccacctctttcttcctttttttactctgtttttctttgctccctttgctttggtcttgtgggtctgtgggaatctgctaattttgttaaggtagttaagtttgttcattaatgcaaataatgtaattttattattgttatatcatagtatatggattatgatgaacctttttgttgtga

SEQ ID NO: 1557 - DNA, 1308 bp, Cajanus cajan
ctcacctcacccaaaaaatgtgcccaaccccatcgccgctcctcccccttctcctcctcctcctcgccgtggctccggcctcggcatggcgtccgtggccgccgcgcaacaacaaaatgaacaccaccgattacgccttcggagactccaagaaatacgagggttcctcggagttcgtgaagctgaggtaccacatgggaccggttctcaccagcaacatcaccgtccacaccatctggtacggaaaatgggagaaaaggcagaagaagatcatccgcgagttcatcaactcaatctcggcaacggcggcgccgcacccatcggtggccgggtggtggcgcaccgtggagctgtacacggaccagaccggatccaacatttcgaaaacggtccggctgggggaggagaaaaacgaccggttgtactcgcacgggaaatccctgagccgtctctggatccagtcggtaataaagagcgccatcacagcgaaaacgaggcccttgccgattaaccctcggagcgggttatatcttgtgctgacagccgatgacgtgtacgtgcaggacttctgcacgtcggtgtgtgggttccactacttcacgtttccctcgctggtgggttacacgctcccctacgcctgggtgggtaactccgccaggttctgccccgggcagtgcgcctaccccttcgccgtccccccctacatccccaaccgaaagcccttcaagtcccctaactccgacgttggagtcgacggcatgatcagcgtcattggccacgagatggctgagcttgccaccaaccccctcgccaacgcttggtacgccggccaggacccctctttccccgtcgagattgccgatctctgcgagggcatttacggcaccggcggcggtggctcctacaccggccaggtcctcgacgctcgagatggcgccacgtataacatgaatggcatccgacggcgcttcctcgttcagtgggtgtggagccacgttctcaattactgtactggacctaatgctcttgatcactgatcacttatcactctctgcaccctatttttctttttctttttctttttctttttctttttggtacctttcctttgggcttgtggcttttctggtaattttgttaagctagtagttaagtttgtccatttatgcaaataatgtaatttattgttacttcatatcatatatcttatatcatatatcttatatcatatggaaggggaatcttgaatcacacggagattgtgtgttatgaatcatgattggaatgggggaattaaataggattagg

SEQ ID NO: 1558 - DNA, 1232 bp, Cajanus cajan
tcgcccactcaaacatcacgtttcgtactcacctcacccaaaaaatgtgcccaaccccatcgccgctcctcccccttctcctcctcctcctcgccgtggctccggcctcggcatggcgtccgtggccgccgcgcaacaacaaaatgaacaccaccgattacgccttcggagactccaagaaatacgagggttcctcggagttcgtgaagctgaggtaccacatgggaccggttctcaccagcaacatcaccgtccacaccatctggtacggaaaatgggagaaaaggcagaagaagatcatccgcgagttcatcaactcaatctcggcaacggcggcgccgcacccatcggtggccgggtggtggcgcaccgtggagctgtacacggaccagaccggatccaacatttcgaaaacggtccggctgggggaggagaaaaacgaccggttgtactcgcacgggaaatccctgagccgtctctggatccagtcggtaataaagagcgccatcacagcgaaaacgaggcccttgccgattaaccctcggagcgggttatatcttgtgctgacagccgatgacgtgtacgtgcaggacttctgcacgtcggtgtgtgggttccactacttcacgtttccctcgctggtgggttacacgctcccctacgcctgggtgggtaactccgccaggttctgccccgggcagtgcgcctaccccttcgccgtccccccctacatccccaaccgaaagcccttcaagtcccctaactccgacgttggagtcgacggcatgatcagcgtcattggccacgagatggctgagcttgccaccaaccccctcgccaacgcttggtacgccggccaggacccctctttccccgtcgagattgccgatctctgcgagggcatttacggcaccggcggcggtggctcctacaccggccaggtcctcgacgctcgagatggcgccacgtataacatgaatggcatccgacggcgcttcctcgttcagtgggtgtggagccacgttctcaattactgtactggacctaatgctcttgatcactgatcacttatcactctctgcaccctatttttctttttctttttctttttctttttctttttggtacctttcctttgggcttgtggcttttctggtaattttgttaagctagtagttaagtttgtccatttatgcaaataatgtaatttattgttacttcatatcatatat

SEQ ID NO: 1559 - DNA, 1446 bp, Arachis hypogaea
tttgtacttgggagctctctcagcttctgagctcactccttcactcccctcagctacctcattttcccattcactaaaacaaatttaaaatgaacacggcggttcactccaatgtcgccatcttggtgttggtggttctgttcgcggcggatccggcggcggcgtggaggccgtggccgcagaacgccaacagaatgaacgtctccgattacgcattcggcgactcaaagaagtacgaaggttcatcggagttcgtgaagctccggtaccacatgggccccgtcctcaccaccaacatcacggtgcacacaatctggtacggccgctgggagcgcaaccagaagaagatcatccgcgagttcatcaactcgatctccgccgtgaactcccctcacccctccgtggcggcgtggtggcgcaccgtccaactctacacggaccaaaccggcgccaacatctcaaaatccgttcggctcggccaggagaagaacgaccggttctactcccatggcaagtccctgacgcggctgtcgatccagtccgtcatcaagagcgccataactgccagaactaaaccgttaccgatcaaccctcgcagcggactgtacctcctcctaaccgctgatgacgtgtacgttcaagatttctgcacgtcagtgtgcggtttccactacttcactttcccctctttggttggttacacacttccctatgcttgggttggaaactccgagaagctctgccccgggcagtgtgcctacccgttcgccgtgcccgcctacattcccaacatgaaaccgtttaagtcccctaacagcgacgttggagttgacggaatgatcagcgtgattggacatgagatggcggagcttgcaacgaacccgttagctaatgcttggtatgcgggtcaggacccgacgttccccgttgagattgcggatctctgcgaggggatctacggtactggagggggaggatcttacacgggtcaggtattggacgctcacgatggtgccacgtataacatgaatgggatcaggcgtaagtatctggttcagtgggtgtggagccacgttctcaattactgtactggccctaatgctcttgatcactgattcaaaagtataaattctaaaacaacagaacaaaaccgtgatcatctcgatctaattgaatcctcttcctctctttggatgtatgtagaatgagattatctcttcttcctttttgggtttcttttttaattttggggtttaatgaaattattattgctgtcatgaggtcaggttttaatttttgtttgcagggttgtgggcttgtgtggggggagcttggtaatttagttaaggtagttaagtttgttcattaatgcaaataatgtaattttattactttttaattataattatatgaccatgatggatgagggtctttgacccttaacta

SEQ ID NO: 1560 - DNA, 1105 bp, Phaseolus coccineus
gcccaaatgaacgtcacggactacgcctttggggactccaagaaatacgaggggtcctcggagttcgtgaagctccggtaccacatgggaccggttctcaccaccaaaatcaccgtccacacaatctggtacggcaagtgggagcggtcccagaagaagataatccgcgagttcataaactcaatctccgccgcgaactcgccgcacccctccgtggcggggtggtggaggaccgtgcagctctacacggaccagaccggcgccaacatttcgaaaacggttcggctcggggaggagaaaaacgaccgtttgtattctcacgggaagtcgctgacccggttatccattcagtccgtgataaaaagcgccatcacggcgaggactcggccgttaccgatcaaccccagaagcgggttgtatctgctgctgaccgctgatgacgtgtacgttcaggatttctgcacttcggtgtgtgggttccactacttcacgtttccctcgttggttgggtacactcttccgtacgcttgggtgggtaactccgccaagctctgccccgggcagtgtgcttatcccttcgccgtgcccgcgtatatccctaacctgaaaccgttcaagtccccaaacggcgacgttggggtggacggcatgataagcgtgattggccacgagatggcggagctgaccaccaaccccttggccaatgcctggtacgccggtcaggacccctctttcccggtggagatcgccgatctctgcgagggcatttacggcaccggcggcggcgggtcctacaccggtcaggttctggacgctcgtgatggtgccacgtataacatgaacgggatcagacggcggttccttgttcagtggctctggagccacgttctgaattactgcactggacccaatgcgcttgatcactgatcaacttgtcttctacgatcaccaccgttttttttttttttcctttctgtttttctttgctccgttcgttctggggtttgtgggaatctgctaattttgttaaggtagttaagtttgttgattaatgcaaataatgtaattttattattgttatatgatagtatatggattatgaagg

SEQ ID NO: 1561 - DNA, 1313 bp, Lotus japonicus
tggtacttcaccacacctagctagctcactaaccccactccactacaccccggcccggaaaaataatgtggaagggtttctccaccccgtcgccgccgtcctcggtggtacttctgtccctaaccattgtcctttcatccctcctcccactcgccgccgcgtggcggccgtggcctcaaaacaacaaaatgaacgcgactgactacgtcttcgaggactccaagaaattcgaggggtcatcggagttcgtcaagctccgctaccatatgggaccagtcctcacctccaggatcaccgtccacacaatctggtacggcaaatgggagcggagccagaagaagatcatccgcggcttcatcaactcaatctccgccacggaagtcccccgcccctccgtcgccggctggtggcgaaccgtccagcaatacaccgaccagaccaggtccaacatctccagaacagtccagctcggcgaggagaagaacgaccggttctactcccacgggaaatcgctgacccgcctcacgattcagtcagtaatcaaaagcgccataaccgccaccacaaaaccgttaccgatcaacccgaaaagcgggctctacctgctactcaccgccgatgacgtgttcgttcaggatttctgcacgtcggtgtgtgggttccactacttcacgttcccgtcgctggtcgggtacaccttaccctacgcttgggtgggtaactcggcgaaactgtgcccggggcagtgcgcgtacccgttcgccgtgccggcgttcattccgaaccggaaaccattcaagtcaccaaacggcgacgttggggtggatgggatgataagcgtgatcgggcacgagattgcggagctggcaacgaacccgttggcgaatgcttggtacgcgggtcaggacccgacatttccggtggagatcgccgatctgtgcgaggggatttacggcaccggtggaggtgggtcatacaccgggcaggtgttggacggtggagatggtgccacgtttaacatgaagggaatccgacggaggttcttggttcagtgggtgtggagccacgtcctgaatttctgtactggtcctaatgctcttgatatctgattatctcattatatcacttcttctacttcttccgtctataatgtaaaatcagatttttctatttcttttgttggccttttctcttgtttgtggggttgtggtgctgctagtaattttattcagatacttaagtttcttcattaatgcaaataatgtagtatttttattgtcacgtgatagtgtgatactgatactattactact

SEQ ID NO: 1562 - DNA, 1352 bp, Medicago truncatula
acaatttacatttacacttggagctccaagctcatctactctcactctctctcatcactcactctttcccaaaaatgttgaaaacctcacccacccaaccaccaccgtacacggtggctctccccctcaccatcctcctcctctccctcctcacggtggatccagtaaccgcctaccgtccttggccacaaaaccctacaaaaaacattacagactacgccttcggaacttccaagaaatacgaaggttcatctgagtttgtaaaactaaggtaccacatgggacctgttttaacaaacatcataactgttcatacaatctggtacggtaattggcaaaaaaaaccaaaagaaaattatacgagagtttataaactcaatctcagccaaaaacacacctcatccttcagtttccggttggtggaaaaccgttatgctttacactgatcaaaccgggtctaatatctcaaacacggttcatctaggtcaagaaaaaaacgaccggttttattctcatggtaaaaccctaactcgtttatctattcaatccgttattaaaagtgctattagagctaaaacaaaaccattacctataaaccctagaagtggtttatatctcttgttaacttcagatgacgtgtacgttcaagatttctgcacgtcagcatgtgggtttcattactttacatttccatcactagttggttacaccttaccttatgcttgggttggtaatagtgagaaattctgtgcgggacagtgtgcttatccctacgctgtaccacagtttatgcctaatgtgaaaccttttaaatcacctaatggtgatgttggagttgatggtatgataagtgtgataggacatgaacttgctgagctggcaagtaaccctttggctaatgcttggtatgctggtggagatccaagttttccagtggaaatagctgatttgtgtgagggtatttatggaactggtgggggtggatcttatacgggacaggttttagatgatcatgatggtgccacgtataatatgaatgggattagaagaaagtttttggttcagtggctttggagtcatgttttgaattattgtactggtcctaatgctcttgatcattgatattctcatcaatgtatgtatgtacgtacaatgagatatttttatatttatattatttttggtatcactcttttagtaacttgtgttttgggtttgttttgtgggtttgtggtggtggttacgtttgggttttgtaatttttttttgtttacggtagctaagcttgatcattgtgcaaataatgtaattttgattgcatatgatatatgaaagtatataattataaatca

SEQ ID NO: 1563 - DNA, 1267 bp, Cicer arietinum
tgaaacatcacgtttcgtacttaaggcccctcagctcggtaaccccaaacctcatctactctcagtctctcaaaatgtcgaaactatttccaccgccgtccatggttgttctaaccctcacgatcacccttttctcattcctcctcacggcggctccaactaccggctaccgtccgtggcctcaaaatccccaaacaaagaacctaaccgattatgccttcggaacttccaaaaaatacgaaggctcatcggaattcgtaaaacttaggtaccacatgggacctgtcttaacaaacatcataaccgtccacacaatctggtacggtaactggcaacgcagccagaaaaaaataatccgtgagtttataaactcaatctccgctaaaaactcaccgaatccttcggtttccggttggtggaaaactgttatgctttacacggaccaaaccgggtccaacatctcaaacacggttcaactcggttcagaaaaaaacgaccggttttactcacacggaaaaaccctcacacggttaacaatacagtcggttatcaaaagcgctatcaccgcaaaaacgaaaccgttaccgattaatcctcgtagcggtctttatcttttattaacatctgatgacgtgtacgttcaagatttctgcacgtcagcatgtgggttccactatttcacattcccttcacttgttggttacacgctaccttacgcgtgggtgggtaattctgcaaaactatgtccaggtatgtgtgcatatcccttcgctgtacctgaatatatccctaatgttaaaccgtttaagtcacctaacggtgacgttggagtagacggaatgataagtgttattggacatgagattgctgagctggcaagtaatccgttagcgaatgcttggtatgctggttcggatcctagttttcccgttgagattgcggatttgtgtgagggtatttacggtactggtggtggtggttcatatacgggtcaagttttggacgctcgagatggtgccacgtataatatgaatggaatcagacggaagtttttggttcagtggctttggagtcatgtgcttaattactgtactggtcctaatgctcttgatcattgatgatccatcttgagtcatcagtgtatgtagaatgagatatttctttatttattttatttacttttgttcgtactcttgttgtcttgtggtgttgtgtggtggtgttagttattgtagcccgtggcggcgacgagcacaggaggtagtgc

SEQ ID NO: 1564 - DNA, 1404 bp, Medicago truncatula
aatttacatttacacttggagctccaagctcatctactctcactctctctcatcactcactctttcccaaaaatgttgaaaacctcacccacccaaccaccaccgtacacggtggctctccccctcaccatcctcctcctctccctcctcacggtggatccagtaaccgcctaccgtccttggccacaaaaccctacaaaaaacattacagactacgccttcggaacttccaagaaatacgaaggttcatctgagtttgtaaaactaaggtaccacatgggacctgttttaacaaacatcataactgttcatacaatctggtacggtaattggcaaaaaaaaccaaaaagaaaattatacgagagtttataaactcaatctcagccaaaaacacacctcatccttcagtttccggttggtggaaaaccgttatgctttacactgatcaaaccgggtctaatatctcaaacacggttcatctaggtcaagaaaaaaacgaccggttttattctcatggtaaaaccctaactcgtttatctattcaatccgttattaaaagtgctattagagctaaaacaaaaccattacctataaaccctagaagtggtttatatctcttgttaacttcagatgacgtgtacgttcaagatttctgcacgtcagcatgtgggtttcattactttacatttccatcactagttggttacaccttaccttatgcttgggttggtaatagtgagaaattctgtgcgggacagtgtgcttatccctacgctgtaccacagtttatgcctaatgtgaaaccttttaaatcacctaatggtgatgttggagttgatggtatgataagtgtgataggacatgaacttgctgagctggcaagtaaccctttggctaatgcttggtatgctggtggagatccaagttttccagtggaaatagctgatttgtgtgagggtatttatggaactggtgggggtggatcttatacgggacaggttttagatgatcatgatggtgccacgtataatatgaatgggattagaagaaagtttttggttcagtggctttggagtcatgttttgaattattgtactggtcctaatgctcttgatcattgatattctcatcaatgtatgtatgtacgtacaatgagatatttttatatttatattatttttggtatcactcttttagtaacttgtgttttgggtttgttttgtgggtttgtggtggtggttacgtttgggttttgtaatttttttttgtttacggtagctaagcttgatcattgtgcaaataatgtaattttgattgcatatgatatatgaaagtatataattataaatcatccgggtcacgatgtccggccttacaatttttgacatttatcagataagctag

SEQ ID NO: 1565 - DNA, 1320 bp, Trigonella foenum-graecum
cggccgggggtacttaagacctctcacctcagctacttccacactctctcactcacacaacttcaacaaaaatgttgaaaacctcacccaccaaacaaccgccgtacacggcggctctacccctcaccatcctcctcctcctctccctcctcacggttgctccggtcaacgcctaccgtccatggccacaaaaaccccacaaaaaacatcaccgattacaccttcggaaattccaaaaaatacgaaggttcatcggagtttgttaaactacgttaccacatgggacctgtcttaacaaacatcatcaccgtacacacaatctggtacggtaattggcaaaaaaccaaaagaaaattattcgtgagtttatcaactcaatctcagccaaaaacacacctcacccttcagtttctagttggtggaaaaccgttatgctttacacggaccaaaccgggtccaacatctccaacacggttcatctaggccaagaaaaaaacgaaccggttttattctcatggtaaaaccctaactcgtttatcgattcaatccgttattaaaagtgctattagagctaaaacaaaaccattaccaataaacgctagaagtggtttatatcttttgttaacttctgatgacgtgtacgttcaggatttctgcacgtcagcatgtgggtttcattacttcacatttccatcacttgtcggttatactttaccttacgcttgggttggaaatagtgagaaattctgtgcgggacagtgtgcttatccctacgctgttccacagtttatgcctaacgtgaaaccgtttaaatcacctaacggtgacgttggagttgacggaatgataagtgtgataggacatgaacttgctgagctggcaagtaaccctttggctaatgcttggtatgcaggtggggatccaagttttccagtggaaatagctgatttgtgtgagggtatttatggaactggtggtggtggatcttatacgggtcaggttttggacgatcgtgatggtgccacgtataatatgaatgggattagaaggaagtttttggttcagtggctttggagtcatgttttgaattattgtactggtcctaatgctcttgatcattgatattctcatcagtgttgttgtacaatgagatatttttatttatattatttttcttatgactcttttagtaacttgtgttttggggttgttttgtggtggtggtggtgctactgttggggttttgtaattttgttagcttgatcattgtgcaaataatgtaattttgattgcatatgatatataattataaacctctca

SEQ ID NO: 1566 - DNA, 1603 bp, Glycine max
aaacacacaaacctcttcagttcacaaaccacacaacctcttctaatattcgttttctgatctacgcaaggttaaggttaatttgcttctatctacatggacattaacgagatcgatgttccttcattctttctctgccccatttcgttagaaatcatgaaggatccagtgacggtctcaacaggcatcacctacgaccgtgaaagcatcgaaacatggctgttctcgaagaaaaacacgacatgccccatgaccaaacagcccttgatagattacaccgatctcacaccaaaccacacccttcggagactcatccaagcgtggtgtaccatgaacacttctcacggcatcgaaaggatcccaacccccaaaccccccattaacaaaaatcaaatttccaagcttctcaaggacgcttctcattcccctctcacatgcctcaggagactcaaatccatcgcttcaggaagcgaaacaaataagcggtgcatggaagcttctggtgttgttgaatttctagcatcaattgtaatcaacaacaacaacatcgtttcttcaaatgaggctgactcaaatgagggatctggattcgagttgagaacaagtgcaagcgatgaagcgttgagtttgcttcataatcttcatttatctgatcaagggttgaagactctcttgagcttcaaaaccggcgactttattgagtctttaacaagagttatgcaaaaggggttctttgaatcacgcgcttatgcagtgttcttgttgaaatccatgtccgaagtggctgagccagtgcaattattgcatctaagacaagacctttttgtcgaactagtacaagtcttgaaggatcaaatttctcaaaagacatcaaaagcaacacttcaaaccctgatccaattctctccttgggggaggaacaggatcaaagctgtggaagcaggtaccgttcctgttttggtagagcttcttctcgattgcaaggagagaaagccttgcgagatgatgctggtgttgttggaaattctatgccagtgtgctgagggaagagcagaacttttgaatcatgcagcaggtcttgccattgtgtccaaaaagattctaagggtttcgactttggccaatgatagagctgttaagattcttctgtctgtttcgagattctctgcgactccacatgttgttcaagaaatgcttaaacttggtgtggtcgcgaaattgtgcttggtgcttcaggtggatagtggaaacaaggctaaggaaaaggcaagagagattctcaaattgcatgctcgtgcgtggaggaattctccatgcataccgaacaatttgcttaattcatacccgaactatgtgtgaaatgatacgagaattttgaatggtacctcttttagaaattttaatgtacataaattatttggaaaggacacagttaggtgtaagttataaatatgagcagcaactatatatattgattgccccacaaaaagcataggtgggtagtgagatttcaggttttgatttgtatttcctgacaattgtgtgatggatttttgttttgctaattaagctagctgacacagaaatgagaaaagggttaatc

SEQ ID NO: 1567 - DNA, 1755 bp, Cajanus cajan
aactccaatcttttcacaagaccactacctcttcaacttcgatctttacctgtctattaaccttaatttcttcaagatcgacatggacaatgagattgatgttccttcattcttcgtctgccccatttcattagaaattatgaaggatccggttactgtctccaccggcatcacttacgaccgtgaaagcatcgaaacctggttgttctcaaagaaaaacaccacatgccccgtcaccaaacaacccttgttggattacaccgatctcacccctaaccacactcttcggagactcattcaagcctggtgtaccatgaacgcttctcacggcatcgaaaggatcccaactcctaagcctccggtaaacaaaacccagatttccaagcttctcaaagacgcttctcattcccctctcatatgcctccgaaggcttaaatccatcgcttcaggaagcgaaactaacaaaagatgtatggaagcttctggggccgttgagttccttgcatcgattgtaatgaacaacaacgttgactcttccaatctaccacaggcggatccaagatatggatctggattcgatttgagaaccagtgcaagcgatgaagcgttgggcctgcttcataatcttggtttatctgaacaaggcttgaagactctcttaagcttaaaaaacggagagttcattgagtctttaactagggttatgcagaaggggttctttgaatcacgcgcttacgcagttttcttgttgagatcgatggccgaagtggcggatccagtgcaactgttgcatctaaggcaagaactgttcgtggagctagtgcaagttttgaaggatcagatttcactcaagacatcaaaagcgacccttcaaaccctgatccaattctctccttgggggaggaacaggatcaaagctgtggaagcaggaacggttcctgttttggttgaacttcttctcgattgcaaggagagaaagccttgtgagatgatgctggtgctgttggagactttgtgccagtgtgctgaaggaagagcagaactattgagccatggagcgggacttgccattgtgtccaaaaagattctgagagtttctacgttggcgaatgatagggccgttaggattcttttctttgtttccaaattctctgcgactccacacgttcttcaggaaatgctgaaactgggtgtggtggcgaaactgtgcttggtgcttcaggtggacagtggaaacaaggccaaggaaaaggcacgagagatactcaagttgcatgctcgcgcgtggaagaattctccatgcataccaaacaatttgcttggttcatacccgggttatgtgtgaaaccagaattttgagacagtccctttatgtacagaattatttggaaaggataattaggtctaagtcataaatatgggcagcaacaattgattgctcacaaatggtgtagatttagggtttgatgtgtatttcctgacaagttggtgcactgtgtaatggatttttggttttggtaataagctgacacaaaaggttaattgatcatacgggttttcttccagattttttagttcatttctcttcttttttgtttcttccctttacattcaattgcttgaaatgctccaagaaaattactgtaacacatagcatggcgaggcctaatctcgattgagataaattacacaccagctctttcaagtaatttacttccatttaagcaactgattcaaatttgaagaacttattta

SEQ ID NO: 1568 - DNA, 1588 bp, Phaseolus coccineus
aactccaaaaccattcaaaccctcacaaaccattcaacaatcacaaccttcttcttcaattccttttccctctcatcaaggttaggctctacacttcctctacaacatcgccatggacaacgacatcgatgttccttcattcttcctctgccccatttctttacaaatcatgaaggacccggtcacggtttcaacgggcatcacctacgaccgtgaatgcatcgaaacgtggctcttttctaggaaaaataccacatgccccatcaccaaacaacccttgacagattacaccgatctcacccccaaccacactcttcggagactcatccaagcctggtgtacaatgaacgcttctcacggcatcgaaaggatcccaactccaaaacctcctgtaaacaagactcagatttcgaagcttctcaaagacgcttctcactcccctctcacatgcctccgaagactcaaatccatcgcttcgggaagcgagacaaataagcgatgcatggaagctgcgggtgctgttgagttcctagcatcgattgtagtcaataacaacaacgattcttcaaatggggttgacccaaatgatggatctggattcgagttgaaaacaactgcaagcgatgaagcattgagcctgcttcacactcttgatttatctgaacaagggttgaagactcttattagcttcagaaacggagactttattgagtctttgacgagagtcatgcagaaggggttttttgaatcacgcgcttatgcagttttcttgttgaaatctatgtctgaagtggctgatccagtgaaactgttgcatctaagacaagaacttttcgtggaactagtacaagtcttgaaggatcagatttcaacaaagacatcaaaggatatcattcaaaccttaatccaattctctccttgggggaggaacaggatcaaggctgtggaagccggaacagttcctgttttgatagagcttcttctggattgcaaggatagaaagccttgtgagatgatgctggtgctgttggagatactgtgccagtgtgccgaaggaagagcagaactattgagtcacggagcgggtcttgccattgtttcaaagaagattttaagagtttcgacattggcgaatgatagggctgttaggattcttctttgtgtttccaagttctctgcgactccacatgttgttcaagagatgctgaaactgggtgtggtggcgaaactgtgcttggtgcttcaggtggatagcggaaacaaggccaaggaaaaggcaagagagatactcaaattgcatgctcgggtgtggaagaatactccatgcatacccaacaatatgctttcttcatacccggcttatgcgtgaaatgatccatagagaattttgaaccatatatacctcttttacaattttttatgtacagaattatttggaaaggacacaacacagttaggttcaagttatagatacattcactgcccacaaaaaatattggtgggtagcgatttaggttttgatttgtgtttcctcacaattgacacagaaaaagttaatcaatcatacattcataccgattttgttcca

SEQ ID NO: 1569 - DNA, 1572 bp, Phaseolus coccineus
  misc_feature (112)..(112): n is a, c, g, or t
ccctcacaaaccattcaacaatcacaaccttcttcttcttcaattccttttccctctcatcaaggttaggctctacacttcctctacaacatcgccatggacaacgacatcnatgttccttcattcttcctctgccccatttctttacaaatcatgaaggatccggtcacagtttcaacgggcatcacctacgaccgtgaatgcatcgaaacgtggctcttttctaggaaaaataccacatgccccatcaccaaacaacccttgacagattacaccgatctcacccccaaccacactcttcggagactcatccaagcctggtgtacaatgaacgcttctcacggcatcgaaaggatcccaactccaaaacctcccgttaacaagactcagatttcgaagcttctcaaagacgcttctcactcccctctcgtatgcctccgaagactcaaatccatcgcttcgggaagcgagacaaataagcgatgcatggaagctgcaggtgctgttgagttcctagcatcgattgtagtcaacaacaacaacgattcttcaaatggggctgacccaaatgatggatctggattcgagttgaaaacaactgcaagcgatgaagcattgagcctgcttcacactcttgatttatctgaacaagggttgaagactcttattagcttcagaaacggagactttattgagtctttgacgagagtcatgcagaaggggttctttgaatcacgcgcttatgcagttttcttgttgaaatctatgtctgaagtggctgatccagtgaaactgttgcatctaagacaagaacttttcgtggaactagtacaagtcttgaaggatcagatttcaacaaagacatcaaaggatatcattcaaaccttaatccaattctctccttgggggaggaacaggatcaaggctgtggaagccggaacagttcctgttttgatagagcttcttctggattgcaaggatagaaagccttgtgagatgatgctggtgctgttggagatactgtgccagtgtgccgaaggaagagcagaactattgagtcacggagcaggtcttgccattgtttcaaagaagattttaagagtttcgacattggcgaatgatagggctgttaggattcttctttgtgtttccaagttctctgcgactccacatgttgttcaagagatgctgaaactgggtgtggtggcgaaactgtgcttggtgcttcaggtggatagcgggaacaaggccaaggaaaaggcaagagagatactcaaattgcatgctcgggtgtggaagaatactccatgcatacccaacaatatgctttcttcatacccggcttatgcgtgaaatgatccatagagaattttgaaccatatatacctcttttacaattttttatgtacagaattatttggaaaggacacaacacagttaggttcaagttatagatacattcactgcccacaaaaaatattggtgggtagcgatttaggttttgatttgtgtttcctcacaattgacacagaaaaagttaatcaatcatacattcataccgattttgttcca

SEQ ID NO: 1570 - DNA, 1638 bp, Vigna unguiculata
gactccaaaactttcaaacgctcacaaaccattcattcacaagtcacaaccttcttcttcttcttcttcgattcattttcccatctaatcaaggtttgttctacaagatcgccatggacaacgagatcgatgttccttctttcttcgtctgccccatttccttagaaatcatgaaggatccggtgacggtctcgacgggcatcacctacgaccgtgaaagcatcgaaacgtggctgttttccaagaaaaataccacatgccccgtcaccaaacaacccttgatggattacaccgatctcacccctaaccacactctccggagactcatccaagcctggtgtaccatgaacgcttctcacggcgtcgaaaggatcccaaccccaaaacctcctgttaacaggaatcagatttctaagcttctcaaagacgcttctcactcccctctcgtttgcctccgaagactcaaatccatcgcttcaggaagcgagacaaataagcgatgcatggaggctgccggtgctgttgagttcctagcatcgattgtaatgaacaccaacagcaacgattcttcaaatggggttgaaccgaatgaaggatctggattcgagttgaaaacaactgcaagcgatgaagcattgaacctgcttcacactcttgatttaactgaacaagggttgaagactcttctaggcttcagaaacggagagtttatcgagtctttgacgagagtcatgcagaaggggttctttgaatcacgcgcttatgcagttttcttgttgaaatctatgtcagaagtggctgatccagtgcaactgctgcatctaagacaagaaattttcgtggagctagtacaggtgttgagggatcagatttcaacgaagacatcaaaggatatccttcaaaccttaatccagttctgtccttgggggaggaacagggtgaaggctgtggaagcaggagccgttcctgttttgatagagcttcttctggattgcaaggaaagaaagccttgcgagatgatgctggtgctgttggaggtactgtgtcagtgtgcggagggaagagcagaactattgagtcacggagcaggtcttgccattgtttcaaagaagattctaagagtttcgacattggcgaatgatagggctgtcaggattcttctttctgtctccaaattctctgcgactccgcatgttgttcaagagatgctgaaactgggtgtggcggcgaaactgtgcttggtgcttcaggtggatagcggaaacaaggcgaaggaaaaggcaagagagatactgaaattgcatgctcgggcgtggaagaataccccatgcatacccaacactttactttcttcatacccggcttatgcgtgaaaccaatgatagagaattttgaaacatatatacctcttttagaaattttgatgtacagacacaacacagttaggttcaagttatacatattagcagcaaactatacatttattgcccgcaaaaaaatataggtgggtagcgatttaggtttttctttgtgtttcctcacaattgtgcaatgaatttttgtttttgatagactgacacagaaaggattaatcattcatacattcataccgattttgttccaaaaaaaaaaaaaaaa

SEQ ID NO: 1571 - DNA, 1623 bp, Vigna unguiculata
gactccaaaactttcaaacgctcacaaaccattcattcacaagtcacaaccttcttcttcttcttcttcgattcattttcccatctaatcaaggtttgttctacaagatcgccatggacaacgagatcgatgttccttctttcttcgtctgccccatttccttagaaatcatgaaggatccggtgacggtctcgacgggcatcacctacgaccgtgaaagcatcgaaacgtggctgttttccaagaaaaataccacatgccccgtcaccaaacaacccttgatggattacaccgatctcacccctaaccacactctccggagactcatccaagcctggtgtaccatgaacgcttctcacggcgtcgaaaggatcccaaccccaaaacctcctgttaacaggaatcagatttctaagcttctcaaagacgcttctcactcccctctcgtttgcctccgaagactcaaatccatcgcttcaggaagcgagacaaataagcgatgcatggaggctgccggtgctgttgagttcctagcatcgattgtaatgaacaccaacagcaacgattcttcaaatggggttgaaccgaatgaaggatctggattcgagttgaaaacaactgcaagcgatgaagcattgaacctgcttcacactcttgatttaactgaacaagggttgaagactcttctaggcttcagaaacggagagtttatcgagtctttgacgagagtcatgcagaaggggttctttgaatcacgcgcttatgcagttttcttgttgaaatctatgtcagaagtggctgatccagtgcaactgctgcatctaagacaagaaattttcgtggagctagtacaggtgttgagggatcagatttcaacgaagacatcaaaggatatccttcaaaccttaatccagttctgtccttgggggaggaacagggtgaaggctgtggaagcaggagccgttcctgttttgatagagcttcttctggattgcaaggaaagaaagccttgcgagatgatgctggtgctgttggaggtactgtgtcagtgtgcggagggaagagcagaactattgagtcacggagcaggtcttgccattgtttcaaagaagattctaagagtttcgacattggcgaatgatagggctgtcaggattcttctttctgtctccaaattctctgcgactccgcatgttgttcaagagatgctgaaactgggtgtggcggcgaaactgtgcttggtgcttcaggtggatagcggaaacaaggcgaaggaaaaggcaagagagatactgaaattgcatgctcgggcgtggaagaataccccatgcatacccaacactttactttcttcatacccggcttatgcgtgaaaccaatgatagagaattttgaaacatatatacctcttttagaaattttgatgtacagacacaacacagttaggttcaagttatacatattagcagcaaactatacatttattgcccgcaaaaaaatataggtgggtagcgatttaggtttttctttgtgtttcctcacaattgtgcaatgaatttttgtttttgatagactgacacagaaaggattaatcattcatacattcataccgattttgttcca

SEQ ID NO: 1572 - DNA, 963 bp, Glycine max
actcaaatccaattccactcccaccgaccaaaacgcgcaacacgttgtaattaaaacgacaccgaaactaatgggcgtcttcagcgaaaacccgaatccggacccggttgtgatccgccaggtttgggcttcaaatctcgaatccgaattccaactcatccgcgaactcatcgaccactatccttttatctcgatggacacagaattccccggtgttgttttccgaccacacctggaccccacaaaaccctacaaccaccgcaacaacaatcgcaaccgccactccgaccactaccgcctcctcaagtccaacgtcgacgctctcaacctcatccaggtcggcctcactctcaccgacgccgccggcaaccttcccgatctcgccggaaaccgctccatctgggaattcaacttccgtgacttcgacgttgcgcgtgacgcctacgcgctggactccatcgatctcctccgccgtcaaggaatcgatttcgcgcgtaacgccaccgacggcgtagagtccacgcgcttcgctgaactcatgatgtcttcgggactcgtctgcaacgattccgtgagctgggtgacgtttcacagcgcgtacgatttcggttacttggtgaagatcttgacgcgccgtaacttaccgacgcggttggaagaattcttgaaaaccgtgaaggtgttttttggggacaacgtttatgatgtcaagcacatgatgaggttctgtgacacgctctacggcggattggaccgcgtcgcacggtcgcttaacgtggaacgcgccgtagggaagtgccaccaggctgggtcagacagcttgctgacgtggcacgcgttccagaagattgttgacatttattttgtaaaggatgagcaccgaaaacacgccggtgtattgtatggactagaggtcttctgttaattacaaaaattattaaagcataaaaataataaaaattc

SEQ ID NO: 1573 - DNA, 952 bp, Vigna unguiculata
aaaacaaaattcaaaacccacttccaaagctagtgattctcaaagctcaaatcttgaattatgggtgtgttcagtgaagaccccaatccaattgtgatccgtgaagtatgggcatcgaatatagaatctgaattcgaactcatccgggagctgatcgatcgctaccctttcatctccatggatactgagtttcctggagtgattttccggccgcatgtggaccctaccaaaccctacaaccaccgcacgcgccgccctgctgaccactaccgcctcctcaagtccaacgttgattcgctcaacctgatccaggtcggtctcacgctctctgactctgctggaaaccttcccggcgacgacaggaatcgcttcatctgggagtttaacttctgtgactttgatgtggcgcgtgatgcctacgcgccggactctatcgcgctcctccgccgccaggggattgacttcgagcgcaacgccaccaacggtgtagactccacgcgctttgcagagctgatgatgtcttcaggactcgtgtgcaacgacgcggtgagctgggtcacctttcacagtgcttacgatttcgggtatttggttaagatccttacccgacaggatttaccgacccggttggaggaatttttaaatgttgtgaaagtgttctttggagataatgtttatgatgtgaagcacatgatgaggttctgtgatacactctacggtggtttggatcgggttgcacggacgcttaacgtggaccgcgccgtagggaagtgccaccaggctgggtcagacagcttactgacctggcacgcgttccagaagattgtggatctttattttgtcaaggatgaacaccaaaaacatgctggtgtgttgtttggattagaagttctttgttaattaaaaaaatattataaacataaataataaagattcaattgattgattattt

SEQ ID NO: 1574 - DNA, 974 bp, Vigna unguiculata
acccttaaccaaaacaaaattcaaaacccacttccaaagctagtgattctcaaagctcaaatcttgaattatgggtgtgttcagtgaagaccccaatccaattgtgatccgtgaagtatgggcatcgaatatagaatctgaattcgaactcatccgggagctgatcgatcgctaccctttcatctccatggatactgagtttcctggagtgattttccggccgcatgtggaccctaccaaaccctacaaccaccgcacgcgccgccctgctgaccactaccgcctcctcaagtccaacgttgattcgctcaacctgatccaggtcggtctcacgctctctgactctgctggaaaccttcccggcgacgacaggaatcgcttcatctgggagtttaacttctgtgactttgatgtggcgcgtgatgcctacgcgccggactctatcgcgctcctccgccgccaggggattgacttcgagcgcaacgccaccaacggtgtagactccacgcgctttgcagagctgatgatgtcttcaggactcgtgtgcaacgacgcggtgagctgggtcacctttcacagtgcttacgatttcgggtatttggttaagatccttacccgacaggatttaccgacccggttggaggaatttttaaatgttgtgaaagtgttctttggagataatgtttatgatgtgaagcacatgatgaggttctgtgatacactctacggtggtttggatcgggttgcacggacgcttaacgtggaccgcgccgtagggaagtgccaccaggctgggtcagacagcttactgacctggcacgcgttccagaagattgtggatctttattttgtcaaggatgaacaccaaaaacatgctggtgtgttgtttggattagaagttctttgttaattaaaaaaatattataaacataaataataaagattcaattgattgattaaaaaaaagaaaaaaa

SEQ ID NO: 1575 - DNA, 1135 bp, Phaseolus coccineus
aaacccattaaccgaaaatcaaaactcaagatccacttccaaaggtcaccttctcaattttctgaaacggcatcgaactatgggcgtgttcagcgaagaccagaatccaattgtgatccgtgaagtatgggcttccaatatagattccgaattcgaattcatccgcgaactcatcgatgactaccctttcatctcgatggatactgagtttcctggtgtgattttccggcctcatgtggactccaacaaaccctacaaccaccgcacgcgccgccctgctgaccactaccgcctcctcaagtccaacgttgacgccctcaacctcatccaggtcggcctcactctcactgactctgccggaaacctccccagcgacgccgggaatcgcttcatctgggagttcaacttctgcgacttcgacgtggcgcgtgacgcctacgcgccggattccatcgcgctcctccgccgccaggggatcgacttcgagcgcaacgccgctgacggtgtggactccacgcgcttcgcggagctgttgatgtcttcaggactcgtgtgcaacgacgcggtaagctgggtcacgttccacagcgcttacgatttcgggtatttggttaagatccttacccgacaggatttaccgacccggttggaggattttttaaacattgtgaaagtgttatttggagataacgtgtatgatgtgaagcacgtgatgaggttctgtgatacactctacggtggtttggaccgggttgctcggacgcttaacgtggaccgtgctgtagggaagtgccaccaggctgggtcagacagcttgctgacctggcacgccttccagaagattgtggatatttattttgttaagggtgaacaccaaaagcatgctggtgtgttgtttggattagaagttctgtgttaattacaaatttataaatcataaataataaagattcaattgattgattagttattcgtttgttgttgtcgaatgtctaacatgtggtttgaatgcaaattaaaactttacaattaagcaaattacagcgcgaagcaaggtattgtcagtggcataattgcatgtgggaagttgtcaaaaaaatgaaaacttagcaattaagtactttacagtgttacg

SEQ ID NO: 1576 - DNA, 977 bp, Phaseolus coccineus
  misc_feature (972)..(972): n is a, c, g, or t
aattcggaacgaggaaaatcaaaactcaagatccacttccaaaggtcaccttctcaattttctgaaacggcatcgaactatgggcgtgttcagcgaagaccagaatccaattgtgatccgtgaagtatgggcttccaatatagattccgaattcgaattcatccgcgaactcatcgatgactaccctttcatctcgatggatactgagtttcctggtgtgattttccggcctcatgtggactccaacaaaccctacaaccaccgcacgcgccgccctgctgaccactaccgcctcctcaagtccaacgttgacgccctcaacctcatccaggtcggcctcactctcactgactctgccggaaacctccccagcgacgccgggaatcgcttcatctgggagttcaacttctgcgacttcgacgtggcgcgtgacgcctacgcgccggattccatcgcgctcctccgccgccaggggatcgacttcgagcgcaacgccgctgacggtgtggactccacgcgcttcgcggagctgttgatgtcttcaggactcgtgtgcaacgacgcggtaagctgggtcacgttccacagcgcttacgatttcgggtatttggttaagatccttacccgacaggatttaccgacccggttggaggattttttaaacattgtgaaagtgttatttggagataacgtgtatgatgtgaagcacgtgatgaggttctgtgatacactctacggtggtttggaccgggttgctcggacgcttaacgtggaccgtgctgtagggaagtgccaccaggctgggtcagacagcttgctgacctggcacgccttccagaagattgtggatatttattttgttaagggtgaacaccaaaagcatgctggtgtgttgtttggattagaagttctgtgttaattacaaatttataaatcataaataataaagattcaattgattgattagttaanaaaaa

SEQ ID NO: 1577 - DNA, 2952 bp, Cajanus cajan
tttcgacgcaacatcttcccccactcgtataaagcctcactccaccctcgctcatttcccacaggccacagggaaaacaacaaaccaaaacgtgaaagcaaaacgacagcgaatcaatgggcgtgtccaccgaagaaccgaacccggtcgccatccgcgaggtttggggctccaatctagaatcggagttccaactcatcggggaactcatcgatcgcttccctttcatctccatggacacggaattccccggcgtgattttccgcccgcacgtggaccccaccaaaccctacagccaccgcagcaagcgcccctccgaccactaccgcctcctcaagtccaacgtggacgcgctcaacctcatccaggtcggcctcacgctctccgacgccgccggaaacctccccgacgtcgccgggacccgctgcatctgggagttcaacttccgcgacttcgacgccgcgcgtgaccgctacgcgccggactccgtggcgctgctccggcggcaggggatcgacttcgagcgcaacgccgccgagggcgtggactcgtcgcggttcgcggagcttgtgatgtcgtcggggctggtgtgcaacgacggcgtgagctgggtgacgttccacagcgcctacgatttcgggtacttggttaagatcttgacccggcgcgatttgccgacccggttggaggagtttctggaagccgtgaggatattctttggggagaacgtttacgatgtgaagcacatgatgaggttctgcgacacgctctatggcggcttggaccgcgttgcacggacgcttaacgtggaccgcgccgtggggaagtgccaccaggccgggtcagacagcttgctgacgtggcacgcctttcagaagattgttgacacttattttgttaaggatgagcaccagaaacatgctggtgtgttgtatggattagaggttttctgttaattataaaatcattataaagctttaaaataatgataattcatttcattcgttggttaatcttgttttgttctattctcaatttctcatcacaaaatttggtaggatattgcgctcatcaactttgatcatggatgccttattgttgttggacctctaaattctggcttaagcttaaattaaaacttgacaattaagtaaattacggtgttaagcaaggtattggaattgccagatatgactcgtaatcaatctatgcaaggaccactcaaattggtgaatattattctttggtaggttgattctcgtggatcagtcaaagcagatgcttgcgtaacgatcacgcacttaaggcaggtgcacaaaagcattgtgattgaagcctattatagccagagctttaatagcggattggtgttgcctgaatagagttcccggaatgtaagggttcttgtggccgtaagtacattttactttaatttttttatctgttcaattattccttcgttcttacttttttaatggagttcatctcatgacttgatagacataaataaatattctgtgtaaaatgtggtgttaaactgcattcattttacatatactgatggattgttttttagtttttacacttgggtgcagttcttgcaaattatttttctcccaggccatttttaaggaagcaaaacttgctgggtaatctgtttatttgacataaatgtaaaaagaaaaatgtttgacttataatataatatgccttttaatttagtagtatttcgatttttaaattggtgtgatatttagcaattggttaagttatatattaaggatatctataactactttccaggcatgtgatatgtatagacgtatgggatttgtattatttaatacacgcagctttctattcgtttatctgattatctccttatatgtcaaaatatttgtggcactaaaacttacaaagcaagtatacattcatatgattcttttatgatattgaagatgtttatgcttatgagacaaagaatctactgatattgtcacacaggctctcaagtaagtttaccttcaagggtccttttaaagattgcctagtttcatggactaattggcttatgtatgttattttgtgtcatgctcttttagaaccacgtacttccttgaatcttgcaacttgtaactttgatttgttttaattggattccatttctctctcccatttttctaaattagtactgtcagtattttcttgatgatgttgcaatgatgactgctcaatggcttgaacaagagagtaatgtagttgcttttttttttttctcctgatattcatataatggattcattgatcttctctataatgatttggctgcagattcttaatttagatgtttggaaaattagtcattgatttccagtgttattctctttaacaatttagttggattaaaggaacaaaagctatacttaaggaatggtgtgaagaggtattactatttattcctggtgattagcttttgatgcttttacttgctgttcattgacaggggaattgaatcatagtttcccattcaggacacttttgatagtattctcgatggctaagtacgttttggttttgtctggaccggttcggtctggtcttatctgatttggttcagtctgattttggtctggtctgaaccagttcagtttggtttggtctagttcagtatagtcaaatccggtttggtctggtgcagttcgttctggcttggtttaatctggtctggttcggttcaatttggtccaatctggtctggtatgagtcttgtttgatctagtctagtttggtatgattaggtctaactggtccgattaagtctgattcggttcggtccagtgtggtatggttctgtcgggtatagtttggtcttgtttggtcattctagtcagatgtatcttcacgctaaaagaacgaaaacttagatttattatacaaaaactgataatttga

SEQ ID NO: 1578 - DNA, 1092 bp, Cajanus cajan
ggtggcccgtactagcaggatcagccggtaccaatttaacaacaaaacgtgaaagcaaaacgacagcgaatcaatgggcgtgtccaccgaagaaccgaacccggtcgccatccgcgaggtttggggctccaatctagaatcggagttccaactcatcggggaactcatcgatcgcttccctttcatctccatggacacggaattccccggcgtgattttccgcccgcacgtggaccccaccaaaccctacagccaccgcagcaagcgcccctccgaccactaccgcctcctcaagtccaacgtggacgcgctcaacctcatccaggtcggcctcacgctctccgacgccgccggaaacctccccgacgtcgccgggacccgctgcatctgggagttcaacttccgcgacttcgacgccgcgcgtgaccgctacgcgccggactccgtggcgctgctccggcggcaggggatcgacttcgagcgcaacgccgccgagggcgtggactcgtcgcggttcgcggagcttgtgatgtcgtcggggctggtgtgcaacgacggcgtgagctgggtgacgttccacagcgcctacgatttcgggtacttggttaagatcttgacccggcgcgatttgccgacccggttggaggagtttctggaagccgtgaggatattctttggggagaacgtttacgatgtgaagcacatgatgaggttctgcgacacgctctatggcggcttggaccgcgttgcacggacgcttaacgtggaccgcgccgtggggaagtgccaccaggccgggtcagacagcttgctgacgtggcacgcctttcagaagattgttgacacttattttgttaaggatgagcaccagaaacatgctggtgtgttgtatggattagaggttttctgttaattataaaatcattataaagctttaaaataatgataattcatttcattcgttggttaatcttgttttgttctattctcaatttctcatcacaaaatttggtaggatattgcgctcatcaactttgatcatggatgccttattgttgttggacctctaaattctggcttaagcttaaatta

SEQ ID NO: 1579 - DNA, 952 bp, Glycine max
cgattcgaaatgggcgtgatcgtagaaaaccctaatagttccaagccaatcgtgatccgcgaggtctgggcctccaacctcgaatccgaattcgaggtgattcgtgaagtgatcgatgattaccctttcatctcaatggacaccgaatttcctggcgttgttttccgcccccacgtggtggaccccacaaaaccctacctcttccgcctccgcccctccgaccactaccgtttcctcaagttcaacgttgacgccctaaacctaatccaggttggtatcactctctccgacgccgacggtaatctccctcacctcgaaaccggtaaccgcttcatctgggaattcaactttcgcgacttcgacatcgaccgtgacgactacgcgtcggactccatcgatctcctccgccgccaggggatcgacttccgccgcaacacggcggaaggcatcgactctaaccttttcgctgaactggtgatgtcttcgggactcgtctgcaatgactcggtgagttgggttacgtttcacagcgcgtacgatttcgggtacttggttaagatcctgacccggcggaacctgccaaacgggttggaagagttcttgaagatgttgagggcgtttttcgggaacaacgtttatgacatcaagcacatgatgcagttttgtgatactctctatggcggtctggaccggctcgcgcgaaccctcaacgtggaccgggccgttgggaagtgccaccaggccgggtccgatagcctgctgacatggcacgtgtttcagaaaatgagggatatttatttcgtgaaggatggaccccataagcatgtcggtgttttgtttggattggaactcacttgttctgccccttgaaaaaactcataatgggaaaacagacaattgctattatatatacataaataaaaatttcattcattatttgatggataaatca

SEQ ID NO: 1580 - DNA, 1540 bp, Glycine max
gtcgaatccaattctctctctctctcttttcttgattcattttgttgtctcaattaaacctttgttttggtctgaattgaaaagggttgtgaattaatagtgatgtttatctctagatcaattctctttgtgtttgtgttctcagcttgcttgcttctatttccagccaatggaattcgatcatttgccacaacaaatggttatgaaactgaggttgaagaagttgatccttttgtgcaattcagagaggccccagaatacagaaaccagcaaaagtgcactctaattgacacaaccaatgttcaattagtatgtgatccttcacttgttcatgttgccatgaccattgattggcactacttaagagggtccattgctgcagtgcattctgttgtgaaacacacttcctgccctcagaacctgttctttcatttcattgcatcagatgcaagattggagagcaaggatgtgtttgaaaggattgttcacacttccttcccttcattgggattcaaagtttatgtgttcagggaaagtcttgttggcaatctcatatctccttcaattagggaggcacttgacaaccctcttaactatgcaagaagttaccttgctgatttgcttgatcaatgcattgaaagggtcatatacttggactcggatgttgtagtagttgatgatgtccaagagctttggaaggtttctttgacagggtcaagggtcattggtgctcctgaatattgtcatacaaacttcaccagatacttctcctatgagttttggtcaagtgctgagttttctgaggtctttcaagggaaaaggccttgttatttcaacactggggtgatggtgatggacttggtgaggtggagagagggtggctacacaaggaagattgagaagtggatggagattcaaaaggagagaaggatctataagttaggttcactccctccctttttgttggcttttggcggtgatgttgaagccattgaacatagatggaaccaacatggtcttggaggagataatgtgagaaatagttgtaggactttgcatcctggtccagttagtttgttacattggagtggtaaagggaaaccatggactaggcttgatgccaagatgccttgctcagtggactttctttgggcaccttatgatctctatataccccatcaccatacacatcatcaacaccaccaccatcagagaattgctattggctcaacacattcatcattttaggacatagttttatattggttgattttgattcatttgttctgaatattttattttttttggtatagacagaacaatcaaaagattttgtaatgtttgttgatacatcttaatagtatagtaacagagaatatcatgcggaacatgctgatgcacaattattggataaagtatgagtttaattttcatgtttaaagatatttacactcaaaaccagtcagaaataacccataagacagatgttcctgagttgttgcttgtgtcattctccaatcataattttaccttgataaac

SEQ ID NO: 1581 - DNA, 1387 bp, Phaseolus coccineus
gtcaaatccaattctctcagtttttcttttctcgattcattttgttctctcaattgaaaagggtagtggtgaatagtgatgtttctctctagatcatttgtgcttgtgttctcagcttgctttcttctctgtcaagccaagggaattagatcttttgccagagaaaatggttatgaaactgaggttgaagttgcttcctttgtgcaattcagagaggccccagaatacagaaaccagaaaaagtgttctctgcttgatacaagcaatgtggcaatggcatcatgtgacccttcacttgtgcatattgcaatgaccattgattggcactacttgagagggtctattgctgccctgcactctgttgtgaaacacacttcctgccctcagaatctgttctttcacttcattgcatcagatgcaagattggagagcagggatgagtttgaaaggattgttcacacctcctttccttccttgagatttgaagttcatgtgtttgaggaaagtctagttggcaatctcatatctccttctattaggcaagcacttgacaaccctcttaactatgcaagaagttacctggctgatttgcttgatccctgcattgagagggttatatacttggactctgatgttatagttgttgatgatgttcaagagctttggaaggttccattgtcagggtcaagggtcattggtgctcctgaatattgccatgcaaacttcaccagatacttctcctatgagttttggtccagtgctgagttttctgaggtgtttcaagggaaaaggccttgctacttcaacactggggtgatggtggtggacttgttgaggtggagagagggtgactacacaaggaagattgagaagtggatggagattcaaaaggagagaaggatctatatgttagggtcactccctccctttttgttagtttttggtggtgatgttgaggctattgagcatagatggaaccaacatggcctaggaggggacaatcttagaaacagttgtaggactttgcatcctggttctgtgagtttgctacattggagtggtaaagggaaaccatggacaaggcttgatgctaagaagccttgctcagtggacttcctttgggcaccttatgatctctatataccccctcaacagaagagaattgctgctactggcacaataaattcatccttttagcacataattttatattggttcatctcattcatttgttctggtttttttatagacagaacaaaaagattttgtaatgtttgttcatacttttctatagtatagtcacagagaatgcaattggataaactgagttttgttttcaggagttatgctactaatgctctgaaccaataaatatagcactgtttag

SEQ ID NO: 1582 - DNA, 2789 bp, Cajanus cajan
gtaccatgtccaatccaattctcttttcttcattcactttgttctctcaattcaccttcttgtggtctaaagaaaaaagggtagtcatgtttctttgtagatcaatatcaaaatcaattctctttgtgtttgggtttgtgttgcttctctctggagccaatggtattcgatctattgccacagagaaaggttatgatgaaagtgaggttcaagttgatccctttgtgcaattcagagaggccccagaatacagaaaccaacgaaagtgcagtctagttgacacaaacaatgtgaaaatggtctgtgacccttcacttgtgcatattgccttgaccattgattggcagtacctaagagggtccattgctgcagtgcactctgtggtgaaacacacttcatgccctcagaatctcttctttcacttcattgcatcagatgcaagattggagagcagggatgagtttgtcaggattcttcattcctcatttccttccatgagattcaaagttcatgagttcaaagagagtctagttgaaaacctcatatctccttcaattagggaagcacttgacaaccccctcaactatgcaagaacttatctggctgatttgcttgatcactgcattgagagggttatatacttggactctgatgtcatagttgttgatgatgttcaagagctgtggaaggtttctttgacagggtcaagagtcattggtgctcccgagtattgtcatgcaaacttcaccagatatttctcctatgagttttggtcaagtgaagaattttctgaggtctttgcagggaaaaggccttgttacttcaacactggggtgatggtaatggacttggtgaggtggagggagggtgactacacaaggaggattgagaagtggatggagattcagaaggagagaaggatctatacattaggatcactccctccttttttgttggtttttggtggtgatgttgaggccattgaacatagatggaaccaacatggattaggtggggataatgttagaaatagttgcaggactttgcatcctggtcctgttagtttgttgcattggagtggcaaagggaaaccatgggataggcttgatgccaagaggccttgttcagtggactttctttgggcaccttatgatctctacataccccatcaccacaagagaattgctattggcactacacattcatcattttaggataaaattttatatattggttcattccgattcttttgttctgaatattttttgtgtatagacagaacactcaaaagattttgtaatgtttgttgatacatattcaatagtttactaagagagaacatcatgaggaacacgatgatacacaattggataagatatgagttatgttttcatgtgttatccctgtaaagatatttattgaatgaaaaggaatagcagagcaaacaaaacatgtcaaaaattaaatcaaccccaaaagtaaaccaactctttggactcctagaaaatacgatctgatttcaacgatctgattcaaattttcactcaattaagcacatctagcatactttttcacagaatcatgtttgaactggatatgactactataaacaataaatttcttcatacaagtgccatgtatgatttctatggacaataaagttcttcatccaaatgccaaatatgactactatgagtagcaaaactttcctctccactttggttatattagaacaatcttgtatcagttaatcaatgttcatgattatttttttgatattacccttgaaaaggaacattggttccaacaatttcatcccatttgcccaaacaattacagatattttaaataaagtacgtaggcatacaaaagtacaaaaagttcacaccccttttatctctaaagatgaaatgtcccaaccagacagttgttctatctttattgtccattcaatctgctctaaatgaccccctttatgctggattgttgccaggtaatcataaaaaaattaatttttcgggaattttaaaccaagttaatgatcaacttttggactagttattatcactgtggttctctgttaaactttaattttgcgaataaagatatttacagtgtttctcttgtaaactttgatttttgagaataaagatatgtatgacaatcagaccatcagacatgtgtttaccatttactattaaagaaaaaatattattgcattaagaatgtgaatttttatccaattcaatcttataaaactcattttttaagtaaagattgttttctcttatatattatattttagtcattttattagtcattgtgaagtctcataacacagccactgaaattgtattacttagctgtaagtcatagagaaaagagaagagggaggggaagccaacatgaagataaaaatgttgcaagaacaattatgattaaacaacattatgttcctacaatcaagtatagcatgtgaaaaattagaatattggaccaatgtctagctggctaagcaaaacaaaagctaaagaaaatacacatcacgtgctaaatttggaaaatatcaattttgtgtgcatctgtgaagttagcataccgaagtataactaagatgaatttcgatcaggacaaataagttccaaagttcaatcagtttagaactaaaaatatacacaaaaaaaatatgaaaataaaatggtctataatctaaaatgtttatccaaattctagtgtcgataaaattcgagatttctcaatatgcattggtttggaaacattagtacatt

SEQ ID NO: 1583 - DNA, 1269 bp, Phaseolus coccineus
  misc_feature (18)..(18): n is a, c, g, or t
  misc_feature (406)..(406): n is a, c, g, or t
caattctctcagtttttnttttctcgattcattttgttctctcaattgaaaagggtagtggtgaatagtgatgtttctctctagatcatttgtgcttgtgttctcagcttgctttcttctctgtcaagccaagggaattgatcttttgccagagaaaatggttatgaaactgaggttgaagttgcttcctttgtgcaattcagagaggccccagaatacagaaaccagaaaaagtgttctctgcttgatacaagcaatgtggcaatggcatcatgtgacccttcacttgtgcatattgcaatgaccattgattggcactacttgagagggtctattgctgccctgcactctgttgtgaaacacacttcctgccctcagaatctgttctttcacttcattgcatcanatgcaagattggagagcagggatgagtttgaaaggattgttcacacctcctttccttccttgagatttgaagttcatgtgtttgaggaaagtctagttggcaatctcatatctccttctattaggcaagcacttgacaaccctcttaactatgcaagaagttacctggctgatttgcttgatccctgcattgagagggttatatacttggactctgatgttatagttgttgatgatgttcaagagctttggaaggttccattgtcagggtcaagggtcattggtgctcctgaatattgccatgcaaacttcaccagatacttctcctatgagttttggtccagtgctgagttttctgaggtgtttcaagggaaaaggccttgctacttcaacactggggtgatggtggtggacttgttgaggtggagagagggtgactacacaaggaagattgagaagtggatggagattcaaaaggagagaaggatctatatgttagggtcactccctccctttttgttagtttttggtggtgatgttgaggctattgagcatagatggaaccaacatggcctaggaggggacaatcttagaaacagttgtaggactttgcatcctggttctgtgagtttgctacattggagtggtaaagggaaaccatggacaaggcttgatgctaagaagccttgctcagtggacttcctttgggcaccttatgatctctatataccccctcaacagaagagaattgctgctactggcacaataaattcatccttttagcacataattttatattggttcatctcattcatttgttctggtttttttatagacagaacaaaaagattttgtaatgtttgt

SEQ ID NO: 1584 - DNA, 1308 bp, Vigna unguiculata
tgaacagtgaataatagtgatgtttctgtgtagagtttttgtgcttgtgttctcagcttgctttcttctgtttccagccaatggaattagatcttttgctggttatgaaactgaggttgaagttggttcctttctgcaattcagagaggccccagaatacagaaaccagaaaaagtgtactactctgcttgattcaagcaatgttccaatggcatcatcatgtgatccttcacttgtgcatattgcaatgaccattgattggcactacttgagagggtccattgctgcagttcactctgtgttgaaacacacttcctgccctcagaatctgttctttcacttcattgcatcagatgcaagattggagagcagggatgagtttgaaaggattgttcagacctcctttccttccttgagatttgaagtccatgtgtttgaggaaagtcttgttagcaacctcatatctccttccattagggaagcacttgacaaccctcttaactatgcaagaagttacctggcggatttgcttcatccctgcattgagagggtcatatacttggactctgatgttatagttgttggtgatgttctagagctttggaaggttccattggcagggtcaagggtgattggtgctcctgaatattgccatgcaaacttcaccagatacttctcctatgagttttggtccagtgctgagttttctgaggtgtttgaagggaaaaggccttgttacttcaacactggggtgatggtgatggacttgtggaggtggagagagggtgattacacaagaaagattgaaaagtggatggagattcaaaaggagagaaggatctacaagttagggtcactccctccttttttgttagtttttggtggtgatgttgaggctattgatcatagatggaaccagcatggtcttggaggggacaatgttagaaacagttgcagaactttgcattctggttctgtgagtttgctgcattggagtggtaaagggaagccatggacaaggcttgatgctatgaagccttgctcagtggactttctctgggaaccttatgatctctatataccctctcagcataagagaattgcttctgctacaatgcattcaacattttagcacataattttatattggtttatctgattcatttgttctgatatatattttttgtatagacagaacaatcaaaagattttgtaatgtttgttcatactttttcaatagtttagtcacagagaatgtatcacagaacatgttgatgcaattggataaactgagtttagttttctggg

SEQ ID NO: 1585 - DNA, 1308 bp, Vigna unguiculata
  misc_feature (690)..(690): n is a, c, g, or t
  misc_feature (908)..(908): n is a, c, g, or t
tgaacagtgaataatagtgatgtttctgtgtagagtttttgtgcttgtgttctcagcttgctttcttctgtttccagccaatggaattagatcttttgctggttatgaaactgaggttgaagttggttcctttctgcaattcagagaggccccagaatacagaaaccagaaaaagtgtactactctgcttgattcaagcaatgttccaatggcatcatcatgtgatccttcacttgtgcatattgcaatgaccattgattggcactacttgagagggtccattgctgcagttcactctgtgttgaaacacacttcctgccctcagaatctgttctttcacttcattgcatcagatgcaagattggagagcagggatgagtttgaaaggattgttcagacctcctttccttccttgagatttgaagtccatgtgtttgaggaaagtcttgttagcaacctcatatctccttccattagggaagcacttgacaaccctcttaactatgcaagaagttacctggcggatttgcttcatccctgcattgagagggtcatatacttggactctgatgttatagttgttggtgatgttctagagctttggaaggttccattggcagggtcaagggtgattggtgctcctgaatattgccatgcaaacttcaccagatacttctcctatgagttttngtccagtgctgagttttctgaggtgtttgaagggaaaaggccttgttacttcaacactggggtgatggtgatggacttgtggaggtggagagagggtgattacacaagaaagattgaaaagtggatggagattcaaaaggagagaaggatctacaagttagggtcactccctccttttttgttagtttttggtggtgatgttgaggctattgatcatngatggaaccagcatggtcttggaggggacaatgttagaaacagttgcagaactttgcattctggttctgtgagtttgctgcattggagtggtaaagggaagccatggacaaggcttgatgctatgaagccttgctcagtggactttctctgggaaccttatgatctctatataccctctcagcataagagaattgcttctgctacaatgcattcaacattttagcacataattttatattggtttatctgattcatttgttctgatatatattttttgtatagacagaacaatcaaaagattttgtaatgtttgttcatactttttcaatagtttagtcacagagaatgtatcacagaacatgttgatgcaattggataaactgagtttagttttctggg

SEQ ID NO: 1586 - DNA, 1557 bp, Phaseolus coccineus
ctctaacaatacaggcaaactcgtccacactgtagaattcgtcttcaacagagaaattgcagaaagagtggaactttaagctttgtgtgtgagtggtgagaggcagtaaccgaagaaagtgaagatggcgctgtggatggaaaagggttcggagcccttaacagaaagcgagaaggctgaccttgaagccattgctgcactcaaagagtctgctgcttttgaattcaaggaaaagggtaaccaatatgtgaagatgggtaagaagcattacactgatgccattgattgctacacaagggcaattgatcagaaggccttgagtgactctgagacctctattcttttttcaaatcgagcccatgtgaatttgctgctaggaaatcttagacgtgctctcatagattctcaagatgccctcaagttgtgcccttcaaatataaaggcaatttatagagctgccaaagcttccctttcactaaatatgttggctgaagcaagagagtactgcctgaagggtcttcagtttgaccccaataatgaggatttgaagaagcttgacagacagattggtctgaagatatcagagaaggaaaagcatgaggctcaagtctcgaaggctgctgcagagacaaaggaacttgtgtctgcaatagaatatagaggcttgaagatcggaaaggcaatgtatcgagaacttactggattaaggaaacctgtgttggataaaagcaatatccttcattggcctgttgttcttctgtatgcagaggttatgtctagtgacttcattgaggatttctgcgagactgacatgttttctgttcaccttgatatgatatttgcagaagatcagcctttgtcatgggatgttgaaaacaactacaaacgtgaatttattgaattatactatgaggctggttctggactttgtctatcaaaggaaaaacttctcggttgtctattagaaggaactgcagcttttcacagtgatggtgttggtgatgaagagaaagacgcagatgaggattataagcaacaaaagggttccccaaaatggatcaaagtgaatgaaaggaggacactccacgatgttctcaaagagcctaatttcatcattcctgggatcccagtcttctatgttctttcgaagcgatccagcttttacagcaagtttaaagctggaaagtgggctcctccaagtgcatgaaggaagaggaaagaagcatggtttaaagttaaatgcctcaaattgcaagtcttgaagattgcttgtagttcttccaactgttttgacttccttttaaactagagttaccttctaattattgcagtttttttggtgagtgaaagatgttagcaaggtctagtgtagtgaccaatgatatatagtactagaatacgaggaacctcccttgaatgagtccaattcttttctcttgtaacctagtcaacaaagtataatgttatgtaggttgtatttttttggtacacatgtataatttgataagttttgttatagactttgatcaagttcttggtgcataatagttttcaata

SEQ ID NO: 1587 - DNA, 1679 bp, Glycine max
ccatggtaacatagtaacacatagtttcaggtgggttctaaaacaaaagaaaaaccgagaaagagttctaagctttgtctgtgactggtgagagccagtagcgaaagaaagtgaagatggcgctatggatggaaaagggttcagagccattaaccgaaagcgaaaaagcagaccttgaagccattgctgcactcaaagagtctgctgcttttgaattcaaggaaaagggtaaccaatatgtgaagatgggtaagaagcattactctgatgccattgattgctacacaagggcaattgatcagaaagccttgagtgactctgagacctctattctttttgcaaatagagcacatgtgaatttgcttctagggaatcttagacgtgctctcacagattctaatgaggccctcaagttgtgcccttcaaatattaaggcaatttatagagcttccaaggcttctctttcgctagatatgttggctgaagctagagagtattgcttgaagggtcttcagtttgatcccaataatgaggacttgaagaagcttgaccggctgataggtctcaagatatcagagaaggagaagcacgaggctgaattctccaaggccgttgcggagacaaaggaacttgcgtctgtgatagaacatagaggcttgaagattggaaaggcaatgtatcgggaacttattggattacggaaacctgtgttggataaaagtaatatccttcactggcccgttgttcttctgtatgcagaggttatgtccagcgacttcattgaggatttctgtgagactgacatgttttcggttcaccttgatatgatatccttttctctatcaaacgtatttgcagaagatcagccgttgtcatgggatgttgaaaccaactacaaacgtgaatttgttgaattatactatgaggctggttctggagttagtctatcaaaggaaaaacttattcattgtctattagagggaactgcagctgctcacagggaaggtgttggtgatgaagagaaagacacaattgaggattataagcaacacacgggtccccctaaatggatcaaagtgaacgaaaggagaacactccacgatgttctcaaagagcctaatttcatcattcctgggatcccagtcttctatgttgtttcaaagcaatccagcttttatggcaagttcaaagctgggaagtgggcacctccaagtatatgagggaagcaacatgtagctgatgtccaaacagacatgttttgcaataactagattcaagagttaatgtctcaacctggaagtcttgaagattgccctgagttcttccaactttttgcacttccttttaaattagagttacctgctaattgcaattgtttggtgagtgaaagatttcaggcaggtcatagtgtgtgccaatgatagtgttagaatacaaggaacctagtgaacaaagtataatttgatatagcttgtgattttttggtacatgtataatttgataagttttgttctagacttttatcaagctctaggtgcataatgtttttcaatcttcaatacgtagaatgtcctatttactttttcacgtagacacacccttggcaagggataattggtgcattctagtttccaaacgttttctttataaatataccttgttacaatcatttgcacgct

SEQ ID NO: 1588 - DNA, 1675 bp, Cajanus cajan
catagtacatggtaagtgtttctggtgtgttctaaaatctggagaaaaaaccgtggaaaagagtttaaggctttaagctttgtctgtgattggtgagaggcaatagccgaaggaggtgaaaatggcgctatggatggaaaagggttcggagcccttaaccgaaagcgagaaggcagaccttgaagccattgctgcaatcaaagagtctgcagcctttgaattcaaggaaaagggcaaccaatatgtgaagatgggtaagaagcattactctgatgccattgattgctacacaaaggcaattaatcagaaagccttgagtgattctgagacctctattcttttttcaaatagagcccatgtgaatttgcttctaggaaatcttagacgtgctctcacagatgctcaggaggccctcaagttgtgcccctcaaatttaaaggcaatttatagagctgccaaagcttctctttcactaaatatgttggttgaagctagagagtattgtctgaagggtcttcagttggacttggaccccaataatgaggaattgaagaagcttgaacaacagattggaattaagatatcagaaaaggaaaagcatgaggctgaggtctccaaggctgttgcagaggcaaaagaacttgtgtctgcgatagaatatagaggcttgaagattggaaaggcagtgtaccgagaacttactggattacggaaacctgtgttggataaaagtaatattcttcactggcctgtaattcttctgtacgcagaggttatgtccagtgacttcattgaggatttctgcgagactgacatgttttcggttcaccttgatatgatatttgcagaagatcagcctttgtcatgggatgttgaaaacaactacaaacgtgaatttgtagaattatactatgaggcttgttctgggatttgtctatcaaaggaaaaacttcttcattgtctgttagagggaactgcagcttctgacagggaaggtgttggtgatgaagagaaagatgtagttgaggattttaagcaacatggcggctcccctaaatggatcaaagtgaatgaaaggagaacacttcatgacgttcttaaagagcctaatttcatcattcctggaatcccagttttctatgttgtttcaaagcgatccagcttttacagcaagttcaaagctggaaagtgggctcctccagttatgtgaaggaagcaacaggcaggatttgaaggtatctgatgtctaaacattctctttgtagtcatgagcagatggcgtccagttcttccatcttttttgacttccttttaaaccagagttacctgctaattgcaactattttggtgagtgaagatttcaatgatagttctaaaatacgaggaacctcccttgcttgagtctgattcttctctcttgtaacttagtcaccaaagtatattttgatatagcttgtgtttttttttggtacatgtataattatttgatttattggttttgtctagacttttatctagttttaggtacttaatattttttaatacgtacaatatcctctttttatttttatttttttcacttagatggtgcattccagtttcctatcttatgtgtgtgtatatacaccttattgttatatttatttacacaatggtccctcttttcagtcttcct

SEQ ID NO: 1589 - DNA, 1624 bp, Cajanus cajan
ccgtggaaaagagtttaaggctttaagctttgtctgtgattggtgagaggcaatagccgaaggaggtgaaaatggcgctatggatgaaaggttcggagccttaaccgaaagcgagaaggcagaccttgaagccattgctgcaatcaaagagtctgcagcctttgaattcaaggaaaagggcaaccaatatgtgaagatgggtaagaagcattactctgatgccattgattgctacacaaaggcaattaatcagaaagccttgagtgattctgagacctctattcttttttcaaatagagcccatgtgaatttgcttctaggaaatcttagacgtgctctcacagatgctcaggaggccctcaagttgtgcccctcaaatttaaaggcaatttatagagctgccaaagcttctctttcactaaatatgttggttgaagctagagagtattgtctgaagggtcttcagttggacttggaccccaataatgaggaattgaagaagcttgaacaacagattggaattaagatatcagaaaaggaaaagcatgaggctgaggtctccaaggctgttgcagaggcaaaagaacttgtgtctgcgatagaatatagaggcttgaagattggaaaggcagtgtaccgagaacttactggattacggaaacctgtgttggataaaagtaatattcttcactggcctgtaattcttctgtacgcagaggttatgtccagtgacttcattgaggatttctgcgagactgacatgttttcggttcaccttgatatgatatttgcagaagatcagcctttgtcatgggatgttgaaaacaactacaaacgtgaatttgtagaattatactatgaggcttgttctgggatttgtctatcaaaggaaaaacttcttcattgtctgttagagggaactgcagcttctgacagggaaggtgttggtgatgaagagaaagatgtagttgaggattttaagcaacatggcggctcccctaaatggatcaaagtgaatgaaaggagaacacttcatgacgttcttaaagagcctaatttcatcattcctggaatcccagttttctatgttgtttcaaagcgatccagcttttacagcaagttcaaagctggaaagtgggctcctccagttatgtgaaggaagcaacaggcaggatttgaaggtatctgatgtctaaacattctctttgtagtcatgagcagatggcgtccagttcttccatcttttttgacttccttttaaaccagagttacctgctaattgcaactattttggtgagtgaagatttcaatgatagttctaaaatacgaggaacctcccttgcttgagtctgattcttctctcttgtaacttagtcaccaaagtatattttgatatagcttgtgtttttttttggtacatgtataattatttgatttattggttttgtctagacttttatctagttttaggtacttaatattttttaatacgtacaatatcctctttttatttttatttttttcacttagatggtgcattccagtttcctatcttatgtgtgtgtatatacaccttattgttatatttatttacacaatggtccctcttttcagtcttcctaac

SEQ ID NO: 1590 - DNA, 1686 bp, Cicer arietinum
aaacccaaagagacacactccatcgtactgcacagtgcacacacttatagtttctttccattgaaattgcggcaaagctaactgcgtctccgaccaaccaataaccacaaaaaagttaacgatggcgcttttgatggaaaagggttccgagcccttgacggaaaacgaaaaggcagaccttgaagccattgctgcactcaaacaatcttcagccttagaattcaaggaaaagggtaaccaatatgtgaagatgggtaagaaacattactctgatgccattgattgttacacaagggcaatcaatcagaaagctttgagtgattctgagacatctattcttttttcaaatagagcccatgttaatttgttgcttggaaatcttaggcgtgctcttatagatgctaatgatgcaatcaagttgctcccttcaaatataaaggcgatttatagagctgccaaagcttccctttcattgaatttgttggatgaagcacaagactattgtcaaaagggtcttcagttggatcctgataacgaggaattgaagaagcttcacaagcagattggtctaaagatattcgagattaaaaagcatgaggctgaagtctctaaggctatttcagaggcaaaggaaattgtatctgcaatggaaaatagaggcttgaagattggaaaggccatgtatcgagaacttactgggttaaggaaacctgtgttagacaaaagtaacatccttcattggcctgttcttctcctgtatgcagaagttatgtccagtgacttcattgaggatttctgtgagactgacatgttttcggttcaccttgatatggtatttgcagaagatcagccgcttccatgggatgataaaaacaattacaaacgcgaatttattgagttatactatgaggctggttctggacctcgtctgtctaaggaaaaactccttcattatcttttagagggaactgcagcagcttctaatggcgaagatgaagagaaaaatgcagttgaggatcttaagcaaaacacaagctctcctaaatggatcaaagtaaatgaaaggagaacactccatgatgttctgaaagagcctaatttcatcattcctgagatcccagtcttctacgttgtttctaagaaatccagcttttatggaaagttcaaagctggaaagtgggctcctccaagtgtatgaaggaaacaacaagaagctgggatgttttgcaataatagactcaggagctgatgtctcaatcttgaagtcttgaagattggacaccgatttcggccacgttttagacttcttttaaacttgagttattattacctgcaaatttcaatggtttgatgagtcgagatttcaggctgtcctagttgtgccaatgataatgctagaattggaggaacctaacttgaatatatctattttccccttctcctgtaacctagtcaacaaggatagcttgagctgttttggtacatgtataatttgatagctttagttttatatttttatatcaagttataggtgcatgatacctttaatatgtggactgttctattttcatttttcacttggacaggcacagccaagggataactgtccattccagtttacattttgtatttcagtacttacaatttgtaaaatgatcctttgttatccaatgcaaacacaattct

SEQ ID NO: 1591 - DNA, 1456 bp, Medicago truncatula
gttattgtttgtgtactgtctcagagcaagaaaaagagaaaaagggcaacgatggcgctatggatggaaaagggttcggagcctttaaccgaaaacgagaaagcagaccttgaagccattgctgctatcaaagaatcttcagctttagaactcaaggaaaagggtaaccaatatgtgaagatgggtaagaagcattactctgatgccattgattgctacacaagggcaattgatcagaaagctttgactgattctgagacttctgttcttttttcaaatagagcccatgttaatttgctacttggaaactttagaagggctcttaatgatgctaatgattcaatcaagttgtccccttcaaatataaaggcaatttatagagctgctaaagcttccttttcgttgaatttgttggatgaagcacaagactattgtcaaatgggtcttcatttggaccccaagaatgaggaattgaagaggcttgataagcagattgaaactaaaatactggagaatgaaaaacatgaggctgaagtttctaacgccattgcagaggcaaaggaacttgcttctgcgatagaaaatagaggcttgaagattgggaaggctatgtatcgagaacttactgggttaaggaaacctgtgtttgacaaaagtaacatccttcattggcctgttcttcttttgtatgcagaagttatgtccagtgacttcattgaggatttctgcgagaccgacatgtttacggttcaccttgatatggtattttcagaagatcaaccgcttccatgggatgttaaaaacaattacaaacgtgaatttattgagttatactacgaggctggttctggacctcgtctatctaagcaaaaactccttcattatctattagagggaactccagcagcttccagtggggaagttattggcgatgaagtaaaagatgcagttgaggattttaagcaaaacaaaagctccccgaaatggatcaaagtcaatgagaggagaacactccatgatgttctgaaagagcccaatttcatcattcccgagatcccagtcttctatgttgtttttaagcaatccagcttttatagcaaattcaaagatggaaagtgggctcctccaagtgtatgaaaggaagcaacaagaatctgacatgttttgcagtagctagattcaagatttctggctgtagtttttctatcaaatataatgctagaattggaggaaccttgcatggatgtatctattccttttctcctgtaatttgggatgttttggtacatgtataatttggtagctttgatttcagatttttataaggttacaggtgcatactacttctaatattagagttttcaaatttcattttcactagggacacacagataagggataactgaccattttagttcccgttttgatatcaatccttacaatttgcctttttagc

SEQ ID NO: 1592 - DNA, 1152 bp, Glycine max
aaggtaagggcgagagagtccagtgagtgagtgttagcggttctggaaattgattgagtcgaaaagaatcctaacataaaatggattctcaggttgccgtagctcttgctctttcacttgttggtggtgtcagcacttctatcggtgcactttttgtaattgttaataaaacgcccagtttgaagatgcttgggctattacagggttttgctgctggtttgatgcttagcatatcgttctttgatttggcccacaatgctttgaactcactgggcttcttgaaaggaaacctttggttttttgccggggtaatattctttgctgttgttgccagttttatcccagagccaacacttactcccacttctgatgtgaagggcagaaagaaaaatggggatgaaggagacaaggatattatgaaaaagcatcgtcggcaagttttattcagtggaattgttacagctgtaggcataagtttgcacaattttccagaaggaatggcagtgttccttggatccttaaagggcctccgtgttggcctcaatttagcattagccattgctctgcacaatatcccagagggtgttgctgttgcacttcctgtttattttgcgacacaaagtaaatggcaggcattcaaattagcatcactttctggctttgctgaacccctgggagttataatcgtagcctatctattccctagcagcttaagtcctgagattctggaaggtttacttggatcagttggtggagttatggcttttctgacccttcatgaaatgctgccattggcttttgattatgcgggacagaagcaatctgttaaggctgtctttttggggatggctttcatgtctgcaagcctgtattttctaagtatcagcttacctgaggacttaagcttgtagcaaagttccttcagaaggggtctcacatagtgtccaaggacaataatgcaccgccatgtgtttaggaaaataatcaatcagacatcaattttgagggatgcattccacctatgattgtggttcccctatagactaatgtacaaaaaaaataagagtataactcctttaaattctttaactgacccaccttgtatactgtatcatcaacgataatggactttaaattgcacaatttgctgat

SEQ ID NO: 1593 - DNA, 1204 bp, Vigna unguiculata
gggagtccagtgagtgggtgtgtcatcatcatcactggcttctgtttctgaaaattagttcataagaatcgtttaattaggtcacccaatcgaatagaaccctaacgctaaattcacccgacattgttgaggttgaggcatggattctcaggttgcagtagctcttgctctttcacttgttggtggtgtcagcacttctctcggtgcgctttttgtgattgtcaatcaaactcccaatttgaagatgctcgggctactacagggttttgctgctggtttgatgctcagcatatcgttctttgatttggctcacaatgctttgaactcactgggcttcttgaaaggcaacctttggttttttgctggggtgatattctttggtgttgtggccagttttatcccagagccaactcttgctcccacttctgatgtcaagggcagaaagaaaaatggagatgaaggaggcaaggatactatgaaaaagcatcgccggcaggttttattcagtggaattgttacagccgtaggcataagtttgcacaattttccagaaggaatggcagtgttccttggatccatgaagggcctccgtgttggcatcaacttggcattggccattgctttgcacaatatcccagagggtgttgctgttgcactacctgtttattttgcgacacaaagtaaatggcaggcattcaaattagcatcactttctggcttcgctgaacccctgggagtgataattgtagcctatctattccctagcagcttaagccctgagattctggaaggtttactcggatcagttggtggagttatggcttttttgacgcttcatgaaatgttgcctctggcttttgattatgccggacagaagcaatctgttaaggctgtctttttggggatggctttcatgtctgcaagcctgtattttctaagtatcagcttacctgaggacttgagcttgtagcaaaattccttcagaaggggtctgagagtgcgaaaggaacagtaatgcacagttaatctgtctaggatagcaatcaatcagacatcagtgtagagggatgcattccacctatgattgtggattttcctatagactaatgtacaaaaaaacaagaataagattatccccctttgattctttaaccgaaccaccttgtatactgtgtatcatcaacgaagattggacttttaaaat

SEQ ID NO: 1594 - DNA, 1204 bp, Vigna unguiculata
  misc_feature (254)..(254): n is a, c, g, or t
gggagtccagtgagtgggtgtgtcatcatcatcactggcttctgtttctgaaaattagttcataagaatcgtttaattaggtcacccaatcgaatagaaccctaacgctaaattcacccgacattgttgaggttgaggcatggattctcaggttgcagtagctcttgctctttcacttgttggtggtgtcagcacttctctcggtgcgctttttgtgattgtcaatcaaactcccaatttgaagatgctcgggntactacagggttttgctgctggtttgatgctcagcatatcgttctttgatttggctcacaatgctttgaactcactgggcttcttgaaaggcaacctttggttttttgctggggtgatattctttggtgttgtggccagttttatcccagagccaactcttgctcccacttctgatgtcaagggcagaaagaaaaatggagatgaaggaggcaaggatactatgaaaaagcatcgccggcaggttttattcagtggaattgttacagccgtaggcataagtttgcacaattttccagaaggaatggcagtgttccttggatccatgaagggcctccgtgttggcatcaacttggcattggccattgctttgcacaatatcccagagggtgttgctgttgcactacctgtttattttgcgacacaaagtaaatggcaggcattcaaattagcatcactttctggcttcgctgaacccctgggagtgataattgtagcctatctattccctagcagcttaagccctgagattctggaaggtttactcggatcagttggtggagttatggcttttttgacgcttcatgaaatgttgcctctggcttttgattatgccggacagaagcaatctgttaaggctgtctttttggggatggctttcatgtctgcaagcctgtattttctaagtatcagcttacctgaggacttgagcttgtagcaaaattccttcagaaggggtctgagagtgcgaaaggaacagtaatgcacagttaatctgtctaggatagcaatcaatcagacatcagtgtagagggatgcattccacctatgattgtggattttcctatagactaatgtacaaaaaaacaagaataagattatccccctttgattctttaaccgaaccaccttgtatactgtgtatcatcaacgaagattggacttttaaaat

SEQ ID NO: 1595 - DNA, 1568 bp, Cajanus cajan
acgcatacgtcgtcgttcctgggtaagggtgagtccagtgagtgttggtttggtttggtgtgctatcaatatcaactgcttctggttctggaaatcgattcacaagaatcgttttttatttaatgtaattgtaggtcactcaatcgacgagaaccctaattgttgagccatggattctcaggtggccgtagctcttgctctttctcttgttggtggcgccagtacttctatcggtgcactttttgtgattattaatcaagctcccaatttgaagatgcttgggttgttacagggttttgctgctggtttgatgcttagcatatcgttctttgatttggctcacaatgctttgaactcactgggcttcttgaaaggcaacctttggttttttgctggggtaatattctttgctgttgttgccagttttatcccagagccaacacttactcccatttctgatgtgaagggcagaaaggaaaatggggatgatgggggcaaggatattatgaaaaagcatcgccggcaagttttattcagtggaattattacagcagtaggcataagtttgcacaattttccagaaggaatggcagtgttccttggatccatgaagggccttcgtgttggcatcaacttagctttagccattgctctgcacaatataccagagggtgttgctgttgcacttcctgtttattttgcaacacaaagtaaatggcaggcattcaaattagcatcactttctggcttcgctgaacccctgggagttataatcgtagcctatctattccctagcagcttaagtcctgagattctggaaggtttactcggatcagttggtggagttatggcttttctgacccttcatgaaatgctgccattggcttttgattatgccggacagaagcaatctgttaaggctgtctttttggggatggctttcatgtctgcaagcctttattttctaagtatcagcttaccggaggagttaagcttgtaggtggggacaagttattttttcttctctgaatgtcttgaaatccacatgctcaattgtgaagtgtctcctgattctatcatccgtcgcagaaatgttccctcagaaggggtctcatagagtatccaatgacaataatgtacagccatctgttaaggatagcaatcaatgtagagggatgcattccacctatgattgtggtttcccctatagactaatgatgtacaaaaaaaattgaaagaataagagtatgccgcctttaattctttaaccgaccctccttgtatactgtatcatcaaccaagattggacttaaattgcagaatcggttgataatgtgttgggctataagaaacattcacataacataaatacctctggtagtgaaaaggttcctcacgggtcatgatgcgagcaatcttcctttataaacaattgggtactccactaggcacagggagacatcgaattttttacttgtattcttcaggattcagttgcccaatttgtatgggcctatggggtaatcggaccatttgcctgctttgataatcagctttgttctcagttc

SEQ ID NO: 1596 - DNA, 1362 bp, Phaseolus coccineus
ataaatgcggcgtggttcatccatgggtagtggtgagttgagtgagtgggtatgttatcatcatcactgcgttctgtttctggaaattacttcataagaatcgttccttcgttcagttaggtcacacaatcgaagagaaccctaacgccaaattcacctgacattgttgaggcatggattctcaggttgccgtagctcttgctctttcacttgttggtggtgtcagcacttctatcggtgcacttgttgtgattgttaatcaggctcccaatttgaagatgcttgggctactacagggttttgctgctggtttgatgcttagcatatcgttctttgatttggctcacaatgctttgaactcactgggcttcttgaaaggcaacctttggttttttgctggggtaatattctttggtattgtggccagttttatcccagagccaactcttgctcccacttctgatgtgaaaggcaaaaagaaaaagggggatgaaggaggcaaggatactttgaaaaagcatcgccgacaggttttattcagtggaattgttacagccgtaggcataagtttgcacaattttccagaaggaatggcagtgttcctaggatccatgaagggcctccgtgttggcatcaacttagcattagccattgctctgcacaatatcccagagggtgttgctgttgcacttcctgtttattttgcaacacaaagtaaatggcaggcgttcaaattagcaacactttctggcttcgccgaacccctgggagttataattgtagcctatctattccctagcagcttaagtcctgagattctggaaggtttactcggatcagttggtggagttatggcttttttgacccttcatgaaatgttgccattggcttttgattatgcgggacagaagcaatctgttaaggctgtctttttggggatggctttcatgtctgcaagcctatattttctaagtatcagtttacccgaggacttgagcttgtagcaaaattccttcagaagggttccgagagtgcccaaggacaataatgcacagttcatctgtttaggatagcaatcaatcagacatcagtgtagagggatgcagtccacctatgattgtggattctcctatagactaatgtacaaaaatataagaataagagtatccttcaattctttaaccgacccatcttgtatactgtatcatcatcgaactcatcaacgaaggttggactttaaattcacaatttgctgctactgtgttgtgtcaatatatttcgatcgtgtgttgtactactcaatcacagaacataaatatgaatgttgatgagcagtaaataatatcattttggaaccaagca

SEQ ID NO: 1597 - DNA, 1268 bp, Phaseolus coccineus
ggagttgagtgagtgggtatgttatcatcatcactgcgttctgtttctggaaattacttcataagaatcgttccttcgttcagttaggtcacacaatcgaagagaaccttaacgccaaattcacctgacattgttgaggcatggattctcaggttgccgtagctcttgctctttcacttgttggtggtgtcagcacttctatcggtgcacttgttgtgattgttaaccaggctcccaatttgaagatgcttgggctactacagggttttgctgctggtttgatgcttagcatatcgttctttgatttggctcacaatgctttgaactcactgggcttcttgaaaggcaacctttggttttttgctggcgtaatattctttggtattgtggccagttttatcccagagccaactcttgctcccacttctgatgtgaaaggcaaaaagaaaaagggggatgaaggaggcaaggatactttgaaaaagcatcgccgacaggttttattcagtggaattgttacagccgtaggcataagtttgcacaattttccagaaggaatggcagtgttccttggatccatgaagggcctccgtgttggcatcaacttagcattagccattgctctgcacaatatcccagagggtgttgctgttgcacttcctgtttattttgcaacacaaagtaaatggcaggcgttcaaattagcaacactttctggcttcgctgaacccctgggagttataattgtagcctatctattccctagcagcttaagtcctgagattctggaaggtttactcggatcagttggtggagttatggcttttttgacccttcatgaaatgttgccattggcttttgattatgcgggacagaagcaatctgttaaggctgtctttttggggatggctttcatgtctgcaagcctatattttctaagtatcagtttacccgaggacttgagcttgtagcaaaattccttcagaagggttccgagagtgcccaaggacaataatgcacagttcatctgtttaggatagcaatcaatcagacatcagtgtagagggatgcagtccacctatgattgtggattctcctatagactaatgtacaaaaatataagaataagagtatcctgtcaattctttaaccgacccatcttgtatactgtatcatcatcgaactcatcaacgaagattggactttaaattccacaattggctgctactgtgttgtgtcaatatatttcgatcgtgtgttgtactact

SEQ ID NO: 1598 - DNA, 1430 bp, Cicer arietinum
ggtatgtagcaagacactactgttgtaaataaaaaaaaaagaaaatcacaattaagaaattgtgtgtgattttcaattgcgcctgagaactctgacctaacaccgtcgaggccatggattctcaggtgatggtagctcttgctctttcacttgttggtggtctcagcacttccctcggtgcactgtttgtaattatcaatccagctcccaatttgaagatgcttgggctattgcagggttttgctgctggtttgatgctgagcatatcattctttgatctggctcataatgctttgaactcactgggcttcttgaaaggcaacctttggttttttgctggtgttatattctttgctgttatagccaattttatcccggagccaacacttactcccacttcagatgtgaagaatagaaagaaaaaaggggatgaaggaggcaaggatattatgaaaaaacatcgccagcaagttttattcagtggaattattacagctgtaggcataagtttacacaattttccagaaggaatggcagttttccttggatccatgaagggtctccgtgttggcatcaacttagccttggccattgctctgcataatatcccagagggtgttgctgttgcacttcctgtttattttgcgacacaaagtaaatggcaggcattcaaattggcatcactttcaggctttgccgaacccttgggtgttataattgtagcctatctattccctagcagcttaaatcctgagattctagaaggtctacttggatcagtcggtggagttatggcttttctaacccttcatgaaatgctgccattggcttttgattatgctggacagaagcaatcagtcaaggctgtattttttgggatggctttcatgtctgcaagtctgtattttctaagtatcagcttaccagaggagataagcttgtagatgggaacaatctcttttcttttcttaattcacgaactccacagtatcattgtggtgtgtatcttccgattctatcatcagttgcagcaaaatttcttcatatagagtctcacaaactgtccaatgacaataacatacagccatgtaatgaggttagcaatagacatcaatatagagggaaactactccacctatgattgtagtttcccctaagaatgtacaaagaaaattagagaataagattgtgctgtatttaattctttagcagaccaccaatcttgtatcatgtatcatcaaatcaaggtcagactttgaattgcacagttgactgataatgtgttatgtttatttatttctgcctaggggtataagaaacagtcataaacagcataaacatgaaatgtaggtaactgttactggtgaaaaggttcctcttaagtcactgtgccccgagcattctcctttgccattggtactcaattatca

SEQ ID NO: 1599 - DNA, 1431 bp, Trigonella foenum-graecum
gacggagttgggttgagtaggtgttggtatgaaacgcttattcttttcttgttgttgaataacgataacaaattgttctctaatttctaggtcaattctcaaccaaatcaatcaatcaatcgttgaattttgaaggcatcattaatggattctcaagtgatggtagctcttgctctttcacttgttggtggtctcagcacttccattggtgcgcttcttgtaattatcaagccagctcccaatttaaagatgcttgggctattacagggttttgctgctggtttgatgctgagcatatcattctttgatctggctcataatgctataaactcactgggcttcttgaaaggcaacctttggttttttgctggtgttatattctttgctgctgtagtcagttttatcccggagccaacacttactcctactgcagatgtcaagactaaaaagaataaaggggatgaaggaggcaaggatattatgaaaaagcaccgccaacaagttttattcagtggaattattacagctgtaggcataagtttacacaattttccagaaggaatggcagtgttccttggatccatgaagggcctccgtgttggcatcaacttagcactggccattgctctgcataatatcccagagggtgtagctgttgcacttcctgtttattttgcgacacagagtaaatggcaggcattcaaattggcaacactttcaggctttgcagaacccttgggtgttataattgtagcctatctattccctagcagcttaaaccctgagattctggaaggtctacttggatcagttggtggagttatggcttttctgaccctacatgaaatgctgccattggcttttgattatgctggacagaagcaatctgtaaaggctgtattttttggtatggctttcatgtctgcgagcctgtattttctaagtatcagcttaccagaggagataagcttgtagatgggaacaacctcttttcttttcttaatgcacgagctccacagtatcttgtggtgtgtgtcttcagattctatcgccaattgcagaaaaaatccttcagtaggagattcacaaactatcggatgacaataaaacatacatccatctgatgaggatagcagatatatcaatctagagggatacattccacctatgattgtggtttccccaaaaactgtacaaagaaaattagagaatgagtgttgtctttaatttttagccgaccacaatcttgtatcatgaaaccaaaggtcaaactttgaattgcacagttactgatagcatgttacatttatttatttctgcataggggtataataaacaatcataaacatgaaatgccggtaactactactggttaaaaggttcctcttaagtcagtgtgcctcaaggattcttccttcgctactggtattc

SEQ ID NO: 1600 - DNA, 1166 bp, Medicago truncatula
gtggcatggattctcaagttatggtagctcttgctctttctctcgttggtggtctcagcacttccataggcgcgcttcttgtaatcatcaagccagctcccaatttgaagatgcttgggctattacagggttttgctgctggtttgatgctgagcatatcattctttgatctggctcataatgctataaactcactgggcttcttgaaaggcaacctttggttttttgctggtgttatattctttgctgctgtagtcagttttatcccggagccaacgcttactcccactgcagatgtcaagactaaaaagaataaaggggatgaaggaggcaaggatattatgaaaaagcatcgccaacaagttttattcagtggaattattacagctgtaggcataagtttacacaattttccagaaggaatggcagtgtttcttggatccatgaagggtctccgtgttggcatcaacttagcattggccattgctctgcataatatcccagagggtgttgctgttgcacttcctgtttattttgcgacgcaaagtaaatggcaggcatttaaattggcaacactttcaggctttgcagaacccttgggtgttataattgtagcctatctattccctagccgcttaaatcctgagattcttgaaggtctacttggatcagttggtggagttatggcttttctgactcttcatgaaatgctgccgttggcttttgattatgctggacagaagcaatctgtaaaggctgtattttttgggatggctttcatgtctgcgagcctgtattttctaagtatcagcttaccagaggagataagcttgtagacaggagcaacttcttttcatttcttaattcatgagctccatggtatcattgtggtgtgtgtcttcagtttctattgccaattgcatcaaaattccttcagtaggagtctcacacactgtctgatgacaataacgatacaaccatctgatgaggatagcagtagatatatcaatatataggggatacattccacctatgattgtggtttcccctaaaaatgtacaaagaggaaccgaatatgagtgtgctgtcttcaatttttttagcctaccatcaatcttgtatcatgtatcatcaaaccaagatcaaaccttgaattgcacagttaa

SEQ ID NO: 1601 - DNA, 2801 bp, Ricinus communis
ctggcctatgatttgtcgtagtggggcttcctcccagagcttgtcggttctgggctgcattcattaagtccgtaattagttgcttagctctgcaaataaagaataaagggtcacagctttttccttcaataatggcagcattcttgctcttccagatgctccaacataggcaacgagttaataaagaatcagaagattactgacctctatatgaaataatatcctgtcacaaattagagaaagaagttaaacccatgccattgggagaatagcttaaattggaagctaggcaggtagccctagaatgatcacggaaaaacaagagatgctatatggactcctcctccctgatacaaataggacagatgggttaaaaaaccaagctccctgctgaaaagattaactttagtagcaacgaagctgcgaaataatttaagtttaggagagaggttagagtgcgaatcagatctccaaagactagaatccattgtagcagttgaaggagactgggcaggtgatattctgtcattcctatcacacaagaggtcgcataagcttatgggcatcaatattcacgcaggtatttttaccacctgatggtaattggcaacttgtttagtttttattgaaccacgataacttgccacgtcattaactgagccaggtggcaccttgtggtttggtttgttccacgggtgaaagtcgccggcaagtcatggaaattggatttcgggtcaagtaacatggacatggagttgggaatatatttgacccaatagctgaggcgattgaatgagaaagccagttggaattggaacagcttcgtcttcatcttcatcgtctgatgctaccaaaaagtaattatataaaagaacagtagataacaatggaaagttaggtataagatagtagaggaagtaaagtcatcccaaaaacccaaaacccagttttggccaattcatttcttaaacttccctattaaaaccatcatttatttgtttagtgaagcacagccctatatctttcaatttgtaccctttctgacgctattgatatcttgagcttacatatggattctcaagtggtggtagcacttgctctttctcttgttggtggattaagcacttctataggtgcactttttgtaattcttaatcaggctcccaacttaaagatgcttggccttttacagggctttgctgcagggctaatgttgagtatatcattcctagatctggctcataatgctatgaactcaattggcttcttgaaaggaaacctttggttttttggaggtgttctgttctttgctattgttgcaaggtttatcccagagccaacccttatcccgggttcagatgttaaaagtaaaaagaaaaatggggatgaaggaggaaaggacatcatgaaaaagcatcgtcgccaagttatgttcagtgggattgttactgccataggcataagcttgcataattttccagagggaatggcagtgttccttgggtcaattaagggactacgtgttggtcttaatttggctttggccattgccttgcacaacattccagagggggttgctgttgcactgcctgtttattttgcaacagaaagcaagtggcaagcttttaaattagcaactctgtctggtcttgccgaaccacttggtgttgtgcttgtagcatatctattcccaagcagcttaagtcctgaaatcctcgagggcctgctgggatcagttggtggtgtgatggctttcctgaccttgcatgagatgctgccattggcttttgattatgcggggcagaagcaggctgttaaggctgtattccttggcatggcattcatgtccgcaagcctttactttcttgaaatcagcttaccagaggatataagtttgtagccatggatcaaccacaatgttgtacattccaaaaccatagtacttaacaaggggccgctctcgttatacagaagcgaaatcttgtaatttgatctccttcgcaaggtccataaggcaggggtatcctaaagggtaaagtatgattgtatttctttttttctaaatcattgaatgctcaccaatttacttaatttcctgtaagaggaaaatgtaaaggggatagggaggaggtgaagaaaagggggaaaaaaattatattggatctcatcatcttgaatgaactcgattatcatttactttttccgaattgctgatgaatcagtctcgcacttattttctatatttgttcatagattatatttgtgctgcttggaagctacagctgcaaggagcttttccttgttcggaaaagccgtttgtcgggcctaagccaagatgctctatgatcaaacaaatactaatcaatagttcacatattaagcatgtatggctaattttttcataaaagtaaaatggaagaaaaaaaaaaagagaaaagaaatagacaagttatcctggtacgattactgggtggagagttgagttgagactttctttatgtgcaactcgggccattcattcgtcttcacacctatcttggtataactattatttcttggttaccaccaccttatctttctcctgcaatggtgtgcggacaagtgaaaacgttaattgaaaagacatttaaaaaggaaacaaagacaggagaaagatcacagagactactggttggtatttcagacagtaacttttggtatcccactcaagatgcatgacatgcagtgtaataacctttagaatccagtacctgtaactaacatgggtttcgaaattttgttgaaagtgtgtttctgtttct

SEQ ID NO: 1602 - DNA, 1240 bp, Mimulus guttatus
aatcagataatacttcaaaaatgcagcacgaaaaatgctgatgcaatttatggcaaaccccaaatcactacttcttaaaaaacatattcgtttcacattaacagattcttcctttgacaatataaaaatgaatctccattgttgttagtcaatccttcaagttatcagttcatagcaaggggatttcgacaaaattatttccgacttttattcccaggattttgcggaatccaatttgctagggtttttcgttttttgttaatcagatgggtttaatggattctcaggttttagttgcgcttgcactttcactcgtgggcggcttgagcacctctgttggggcactttttgttgtcatgaacaaggctccagacctgaagatgcttgggcttttacagggttttgctgcagggcttatgttgagcatatcgttctttgacttggctcataatgccataaattccatcggcttcttgaaggggaatctctggttctttgcaggcgtaattttctttgcaattattgctaattttattcctgagccaacgcttgcacccgtttccgatgggaagaaagacaagaaaaacggggatgaagggggaaaggatatcatgaaaaagcatcgtcgtcaagtattgttcagtggaatcatcactgctgtaggtataagtttgcacaattttccagagggaatggcagtgttccttggatcgatgaagggtcttcgtgttggtctgaacttggcactagctatcgctttgcataacatccctgagggtgttgctgttgcacttcctgtttattttgccacacaaagcaaatggcaggcattcaagctggccaccctttctggttttgctgagccccttggcgtaattatcgtagcttacctattccccagcagcttaaatcctgaaattctcgaggggcttttaggagcagttggtggagtaatggcttttctaacattgcatgaaatgctacctctggcattcgattatgcgggacaaaagcaagctgtaaaggctgtattcttcggcatggctttcatgtctgccagcttatattttcttgagatcagtttgccagcagaaatcagcttgtaaaaacatttaacatttacacattgcttttctggttggtccctacatttttttactgttaatctgttatcaactatgtatttgtattacaatttcagctgggaaatataaggccaaaaaaagagtaattaaaaagt

SEQ ID NO: 1603 - DNA, 1405 bp, Fagus grandifolia
ccaattgctccaaacgtcagctaagccacgcttcagggatgagatctcaatgcaaagttaggtatagtctatacattatacaaatactgctttaacgtttcttgaaccacattctcaaactatctctttcttccactgtacaacatataaattccctctctcccaaaactttttatatatatagcttctttgcgcggtgcacacttcataaactctctttctcttcacaaaattctgtatctttcggtaaagtcctcgacttttcagctatttttcactgatttggtgttattaaagtttgaatttttgggcacccaatagaaagagaagggaaaagctcaaatgggttctcaggtattggtggcacttgcactctcactgcttggtggactcagtacttctataggtgcactttttgtagttctcaatccggctcccaatttgaagatgcttgggcttttacagggatttgctgcaggtctgatgctgagcatttcattccttgatttggctcacaacgctatcaactctattggcttcttaaaaggcaacctttggttttttgcaggtgtcatattttttgcttttgttgccaattttattccagaaccaacacttgcccctgttccagatgtgaaaaggaaaagaaaaatggagatgaagggggcaaggacattatgaaaaagcatcgccgccaagttttattcagtgggattgttacagcaataggcataagcttgcacaattttcctgaaggaatggcagttttccttgggtcaatgaagggtcttcgtgttggtctcaacttggctttggccattgctctgcacaacattccagagggtgttgctgttgcacttcctgtttattttgcaacagagagtaaatggcaagcattcaaattggctactctttctggtttggctgagccccttggtgttataatcgtagcctatctattcccaagcagcttgagtcctgaaattcttgagggccttctcgcatcagttggtggagtgatggcttttctaaccctgcatgaaatgctaccgctggcgtttgattatgcggggcagaagcaagctgtcaaggctgtgttcattggaatggctttcatgtctgcaagcctatatttcttgaaatcagtttacctgccgacatgagcttgtagtcatggatcagcctgttggtattccagtgttgtacatttctggaccaccttgatgggttttcaaaatgtgcctgctcttgtcaactggcattgaagacctatactaatagtcggcttcatttggtttcagccaaagggtagagaagttaacccatctgtactgataacagttcttatcattaatattacagaaatgtatcactgtttgttttttattaaaaagataataaaaga

SEQ ID NO: 1604 - DNA, 1116 bp, Orobanche aegyptiaca
tctctaatattgacgacagaaaaactcgcttttcatgccttggtttccttattgagtttgattccaagatttttggaacccatttggtgggttttttccggagaagattagatgggtttaatggattctcaggtcttagttgctcttgcactttcacttgtcggtggcttgagtacctcaatcggagcactttttgttgtcattaatccggctccaaatctgaaaatgcttgggcttttacagggttttgctgctgggcttatgttgagcatatctttcttagacttggctcataattccataaattccatcggcttcttaaagggaaatctttggttctttgcaggtgtaattttctttgccattgtcgctaatttcattcctgaaccaaatcttgcacccatttcagatacaaagaaagacaagaagaatggagatgatggtggcaaggatatcatgaaaaaacatcgtcgtcaagtattgtttagtggaatcatcactgctgtaggcataagtttgcacaattttccagagggaatggccgtattccttggatcaataaagggtcttcgtgttggtgtgaacttggcgctagctattgctttgcacaatatccctgagggtgttgctgttgcacttcctgtttacttcgccactcaaagcaaatggcaggcattcaagctggctactctttccggtttagctgaacccctcggtgtaattattgttgcttacttattccctagcagcttaaatcctgagattctagaggggcttctcggatcagttggtggagtaatggcttttctaaccttgcatgaaatgttacctttggcattcgattatgcgggacagaagcaagctgtaaaggctgtgtttgtcggcatggccttcatgtctgccagcctatattttcttgagatcagcttgccagcagacatgagcttgtagtcgatgcagtaatgattatctacacttaatctgtcatttactgttaatctgcacattgtaaactatgtacgtacaatgttctttttatatcatggatcttttacatcatgggtggggaccagatttcagttcacagtatcttaaggaacaggaaaaggactgttc

SEQ ID NO: 1605 - DNA, 2180 bp, Theobroma cacao
aaatgtcagcagataggagtccaatagagtgacacgtgtcaactaaaggcagccattcaaaacagttagtctggggcaaggattaagcaagaggtagatgggccttagaagggccggcagtcacccctacccttttctgagctttgagtcgtaataagggtcggagggaaaggaatccaacaaatcaaaaatgcaatcagctgcataaaacaatgggttgacgttaggtatagactgtagagcaagaaaatggtcgttaatactcaacaccctcatgcccctgcctcaacttgattagcattctatttcttcaacctctctatcaattcatctctttctttttctgcaattattctttctctattgctttatttgcgtgtctgtccttcacaattactcattattattattcttatcttcctaagcatatgtttctgggtagttgctagtcaatttcagtccaaacccaccaaagccttccaagaattatcaatctccactaccaatttcaactcctttttacttcgcttttttttttgggagtgaagcaatagagagaagcaagattttccatggattctcaggtgatggtggcgcttgctctctcacttgttggtggattcagtacttctctaggtgctctttttgttattcttaatcaagctcccaacttaaaaatgcttgggcttttacagggttttgctgcaggtctaatgttgagcatatcattccttgatttggctcataatgctatgaactcgatagggttcttaaaaggcaacttatggttttttgctggtgttatcttctttgctgtggttgccaattttataccagaaccaatactttctcagagttctgaggtgaaaagcaaaaagaaaaacagtgatgaagggggcaaggacatgatgaaaaagcatcgtcgccaggttttatttagtggaattattacagcaataggcataagcttgcataattttccagaggggatggcagttttccttggatccatgaagggccttcgtgttggttttaatttggctttggccattgctttgcataacatcccagagggtgttgctgttgctcttcctgtttattttgctacccaaagcaagtggcaggcattcaaattggcaacgctttctggttttgctgagccacttggtgttgtaattgttgcttatctgttcccaagcaacttaagtcctgaaattcttgagggcttgttaggatcagttggtggggtgatggcgttcctaacattgcatgaaatgctgccattggcatttgattatgcgggccagaagcaagctgtcaaggctgttttcttgggaatggctttcatgtctgcaagcctatactttcttgagctaagcttacctgaggagatgagcttgtagcttctttccctgaaacaatcaacaaagtgttgtaaattccaaaatcatggtgtctgcttttgcatatgatagtgatggctttctctgagtgttagcaaaatgctgagaagacttactttggatcgatcttgagaaaaaggatgaagacgtcagtatgtaatgtacaaaatttcaatttatttctttaacgaaatgaaaattgaaaaggaatagaaggggaaaataaatttatggagcttgtattttaaaactgtgctggctaaaccttgtttattttgtcaacaaacggaaaatcagcaatctggaatcttcttttttatggatcatgcatctccaatacatctagctggtgcatctctgttctttttctggtctatttgtttgttgtcttttcttaggtattagtttgaagttcctgtgccaaaaatattgaagactacatttatcaagctgcctgggatgttaggtatggttctttatgggtgctcaggaagtcaggttgtataattctggtagacttttcgtgcactgatgccaccagaaacatttaaaagactctgggtttacagctcgattaatcacccaaacatttatcattgttccctgggagtcccacctcgaggactggctgacttgccaaattctctaccagcagtgaaagagatgagaaccattcagccaaaattaagatgatggtaattacaaatcctgttgttgataacgagcttgtgcataagccaatttatgtggaaaatgaaatgaagccatcaatttctc

SEQ ID NO: 1606 - DNA, 1316 bp, Vitis vinifera
tttaaaccctaaacctcatctaaatagtatgccttctgcatctccctcaacctgctctcaaaaccctggatttttttcttcaaatttgtgagatttttatcttttcttttcggatttttagaggcggagagcatcaatggattctcaggtcatggttgctcttggtctgtcacttgtgggcggagcgagtacttctataggtgcactttttgtaattcttaatgagactcccaacctgaagatgcttgggcttttacagggatttgctgcaggcctcatgctgagcatatctttcctagatttggctcataatgctttgaactccatcggcttcttaaaaggaaacctttggttctttgcgggtgtcgttttctttgctgttgtggttggttttatcccagagccaacacttgctcccagttcagatgtgaaaaataagaagaaaaatggggttgaagggccacaggacactatgaaaaaacatcggcgccaagttttattcagtggaattatcacagcagtaggcataagcttgcacaattttcccgagggaatggctgtgttccttggatcaatgaagggccttcgggttggactaaacttggcactggccattgctttgcacaacatcccagagggtgttgctgttgcacttcctgtttattttgcaacacagagcaaatggcaggccttcaaactggcaactctttctggctttgctgagcccctgggtgttataattgtagcctatctgttcccaagcagcttgaatccagaaattcttgagggcctgttaggatcagttggtggagtgatggcttttcttaccttgcatgaaatgctgccattggcatttgactatgctgggccgaagcaagctgtcaaggcagtcttctttggaatggctttcatgtctgcaagcctttattttcttgaaatcagcttacccaaagacatgagcttgtagctattggggcaactgccagtgtttcacaatgttgtacattcctggaaccatcataacagggctgctaatggtacttggttgcagcatatttcctgttaaccttcttgcaatctctccccatcatatcccaaaagctgagaagatatggcttccttggatagcagctgtttgttatcacccatggaaaaactatgtacttttatcgcactttcaatggataaaccaaaatatgtttagcttttgcagaaaattgccagcccccatggcctatgtgattattcaggaatcacctttgtctgcacattatgattaaataaataagatgctgtcgttttatttagtctctcca

SEQ ID NO: 1607 - DNA, 1184 bp, Citrullus lanatus
acatttctctgaatttcgaagccctcgagtcttttcgggggttcattgctgtaatcaccgacgcctttgaatccgggatacgactctacaagatctccatggcttctcaggtgttggtagctctggcactttcgcttgtgggtggattcagtacatctcttggtgcacttttagtgattcttagcggggctccaaatttgaagatgctcggccttttacagggctttgctgcaggtttaatgttgagcatttcgttcctggatttagctcataatgctattaactcaattggattcttaaaaggaaatctttggtttttcgcgggtgtaatcttctttgcttttgttgcgcactttataccagaacccacacttggtcctgtttcagataccaaacgtaagaaggacaaggacgaagggggcaaggatattatgaaaaagcatcgtcgtgaggttctgttcagtgggataataacagcaataggaataagcttacataattttccagaagggatggctgtttttcttggatcaattaagggtctacgtgttggtctaaacttagcccttgccattgccttgcacaacataccagagggtgtagctgttgcgcttcctgtttattttgctacacagagcaaatggcaggcattcaagttggctactctctctggctttgctgagcccctcggtgttataatcgtagcctacttatttccaagcagcttgagtcctgagattcttgaaggtctactaggagctgtcggcggagtaatggcgtttctaactctgcatgaaatgctgcctttggcatttgattatgctggacagaagcaagctgtgaaggtagtcttcttaggaatggcttgcatgtcggcaagcctttattttctggaaatcagcttgccggaggatttgagcttgtagttacctgtctcttctgttccttgccatttctgtgttgcaaatttcctggaaaagaagaacattggggaataaaggattaccatttctatgttacctgccatttgcctcaacaagcatacagcccccttccaaatagatgctaattctgtgtaaaatattaaaactcttgacctcatcagaagttgaaaaatgaattaaaaaaattcttttacctgatctcaattctgtgttcattctcgtatctatggtttgtttgga

SEQ ID NO: 1608 - DNA, 1185 bp, Gossypium hirsutum
gttgtctttatttaatcctttttggggttgtcattatcagtccaaaatccaaaaccccaccctgaaattatcaaattcccactcccaatttgcttatagttttctttttcaaagtaaaggaaataaaagagatatagaacaaaaaggaagcaaaagtttccatggattctcaggttttggtggcgcttgctctctctctcgtcggtggattgagtacttctctaggtgctcttttcgtaattcttaatcaagctcccaatttgaaaatgctcgggcttttacagggttttgctgcaggtctaatgttgagcatatcattccttgattttagctcataacgctatgaactcaattgggttcttgaaaggcaacctctggttttttcctggtgttatcttctttgctgtggttgccaattttatacccgagcctaccctatctcacagttctaaggtgaaaggcaaaaagaacaagggtgatgaagggggcaaggatatgatgaaaaagcatcgacgccaggtttttttcagtggaattattacagcaataggcataagcttgcataattttcccgaggggatggcagttttccttggatccatgaagggccttcgtgtcggtcttaatttggctttggccattgctttgcacaacatcccagagggtgttgctgttgcactgcctgtttattttgctacacagagcaagtggcaggcattcaagttggcaactctttctggttttgcagagcctctcggcgttgtaattgttgcttatctgttcccgagcagcttaagtcccgaaattctcgagggcttgttaggatcagttggtggggtgatggccttcctaacattacatgaaatgctgccattggcatttgactatgccgggcagaagcaagctgtcaaggctgtgttcttcgggatggctttcatgtctgcaagcctatactttctcgaactaagcttaccgaaggacatgagcttgtaacctctttccatatgaacaaaaaaatgttgtaaattcctgaaccaagatgttttatttagttgatttctctgataattttagccaaactatgagatatcttaaaagcaaaaaggatgaacaggcccagtttgcaatgtacataatttgtttccttgtaacaacatgagcattgaaaaggggaaaaaaagaggg

SEQ ID NO: 1609 - DNA, 944 bp, Gossypium hirsutum
aaaggaagcaaaagtttccatggattctcaggttttggtggcgcttgctctctctctcgtcggtggattgagtacttctctaggtgctcttttcgtaattcttaatcaagctcccaatttgaaaatgcttgggcttttacagggttttgctgctggtctaatgttgagcatatcattccttgatttagctcataatgctatgaactcaattgggttcttgaaaggcaacctctggttttttctggtgttatcttctttgctgtggttgccaattttatacctgagcctaccctatctcacagttctgaggtgaaaggaaaaaagaacaagggtgatgaagggggcaaggatatgatgaaaaagcatcgacgccaggttttttcagtggaattattacagcaataggcataagcttgcataattttcccgaggggatggcagttttccttggatccatgaagggccttcgtgtcggtcttaatttggctttggccattgctttgcacaacatccccgagggtgttgctgttgcactgcctgtttattttgctacacagagcaagtggcaggcattcaagttggcaactctttctggttttgcggagccgctcggcgttgtaattgttgcttatctgttcccgagcagcttaagtcccgaaattctcgagggcttgttaggatcagttggtggtgtgatggccttcctaacattacatgaaatgctgccattggcatttgactatgccgggcagaagcaagctgtcaaggctgtgttcttcgggatggctttcatgtctgcaagcctatactttctcgaactaagcttacctaaggacatgagcttgtaacctctttccatatgaacaaaaatatgttgtaaattcctgaactaagatgttttatttagttgatttctctgataattttagccaaactatgagata

SEQ ID NO: 1610 - DNA, 1448 bp, Fagopyrum esculentum
gctatgatcagagtagagatgcagcatacgagaatataagcaggagtgagaggtatcccaatccatgggaagaggaagagcatattgaattgttttagtcaagcggtcacccaattcttgatttctttccttactcttgctttatccccaattattcttcggtcattttctgtcataaacccttttctgattccttatctctggctattcaacagtttctacattgcttttagttctataatctatttccactgcctgaaagagggttcgcgggatcgtatttactaactgagtcgattttgtggaacgattttctggtactggaaactgttgcaatggaatctcaggttctcgttgctcttgcgctgtcacttgtcggaggattgagcacatccttaggtgcacttttcgtgatacttaatccaaccccaaacttgaagatgcttgggttattacagggatttgctgcaggtctcatgctcagcatatcattcctagatttggctcataatgctctgaactctatcggcttcttgaagggaaacctttggttctttgcaggagtcattttctttgctgctatttccagtttcatcccagaaccaagccttgctcctggttcggacgtgaaaagtaaaagaagaggaatgtggaagaaaagggcaaggacacaatgaaaaaacatcgccgccaagttatgttcagtggaattgtcactgctataggcatcagcttgcacaattttccagagggtatggcagtttttcttgggtccatgaagggtcttcgagttggtcttaacctggcgctggcaattgctttgcacaacattccagagggtgtagctgttgcacttcctgtctattttgcaacgcagagcaaatggcaagcgttcaagttggcatcactttctggcttcgctgagccccttggtgttattattgtggcctatctgttccctgcaagtctgagccctgagattctagaaggtcttctaggagcagttggaggtgtaatggcttttctgactctgcatgagatgttgccgttggcattcgattacgctggacagaaacaatcggtcaaggccgtgttcttgggaatggccttcatgtctgctagcctatactttctggaaattagcctaccagaggagatgagcttatagtaggtttccagaatttggtgtcatgatgtgtatgaaggagaattgtgatctcatgggttctcatagggtttgaacaaaacagtgtaattcctggttgtagtaaataagacctgtttagggtggtaaatttagtgaatttaacttgtggggagggtaacttggaaagattaaaggcagttgaattactattaatacataatgttcttccccacaccttcttgcattgtttgattacaattaccaaataaagagtacatgctagccaatttccgacttaact

SEQ ID NO: 1611 - DNA, 1309 bp, Gossypium hirsutum
gttgaagcatggaatagactgtagagcaagaaaatgatggcctaaggttttaaaagaaaagaaaaagaacagcatgaaaccatagctcccctatttcttcaacctctctattaattcatctctttctttttcttcaattattccttcctttttgttgtctttatttaatcctttttggggttgtcattatcagtccaaaatccaaagccccaccctgaaattatcaaattcccactcccaatttgcttatagttttttttttaaaggaaataaaagagatatagaaaaaaaaaaaggaagcaaaagtttccatggattctcaggttttggtggcgcttgctctctctctcgtcggtggattgagtacttctctaggtgctctttttgtaattcttaatcaagctcccaatttgaaaatgcttgggcttttacagggttttgctgcaggtctaatgttgagcatttcattccttgatttagctcataacgctatgaactcaattgggttcttgaaaggcaacctctggtttttttctggtgttatcttctttgctgtggttgccaattttatacctgagcctaccctatctcacagttctgaggtgaaaggcaaaaagaacaagggtgatgaagggggcaaggatatgatgaaaaagcatcgacgccaggtttttttcagtggaattattacagcaataggcataagcttgcataattttcctgaggggatggcagttttccttggatccatgaagggccttcgtgtcggtcttaatttggctttggccattgctttgcacaacatccccgagggtgttgctgttgcactgcctgtttattttgctacacagagcaagtggcaggcattcaagttggcaactctttctggttttgcggagccgctcggcgttgtaattgttgcttatctgttcccgagcagcttaagtcccgaaattcttgagggcttgttaggatcagttggtggggtgatggccttcctgacattacatgaaatgctgccattggcatttgactatgccgggcagaagcaagctgtcaaggctgtgttcttcgggatggctttcatgtctgcaagcctatactttctcgaactaagcttaccgaaggacatgagcttgtaacctctttccatatgaacaaaaaaatgttgtaaattcctgaaccaagatgttttattttagttgatttctctgataattttagccaaactatgagatatcttaaaagcaaaaaggatgaacggccccagtttgcaatgtacataacttgtttccttataacaacatga

SEQ ID NO: 1612 - DNA, 1154 bp, Gossypium hirsutum
ggggttgtcattatcagtccaaaatccaaaaccccaccctgaaattatcaaattcccactcccaatttgcttatagttttttttaaaggaaataaaagagatatagaaaaaaaaggaagcaaaagtttccatggattctcaggttttggtggcgcttgctctctctctcgtcggtggattgagtacttctctaggtgctcttttcgtaattcttaatcaagctcccaatttgaaaatgcttgggcttttacagggttttgctgctggtctaatgttgagcatatcattccttgatttagctcataacgctatgaactcaattgggttcttgaaaggcaacctctggtttttttctggtgttatcttctttgctgtggttgccaattttatacctgagcctaccctatctcacagttctgaggtgaaaggaaaaaagaacaagggtgatgaagggggcaaggatatgatgaaaaagcatcgacgccaggtttttttcagtggaattattacagcaataggcataagcttgcataattttcccgaggggatggcagttttccttggatccatgaagggccttcgtgtcggtcttaatttggctttggccattgctttgcacaacatccccgagggtgttgctgttgcactgcctgtttattttgctacacagagcaagtggcaggcattcaagttggcaactctttctggttttgcggagccgctcggcgttgtaattgttgcttatctgttcccgagcagcttaagtcccgaaattctcgagggcttgttaggatcagttggtggtgtgatggccttcctaacattacatgaaatgctgccattggcatttgactatgccgggcagaagcaagctgtcaaggctgtgttcttcgggatggctttcatgtctgcaagcctatactttctcgaactaagcttacctaaggacatgagcttgtaacctctttccatatgaacaaaaatatgttgtaaattcctgaactaagatgttttattttagttgatttctctgataattttagccaaactatgagatatcttaaaagcaaaaaggatgaacggccccagtttgcaatgtacataatttgtttccttataacaacatgaacattgaaaaggggaaaaaaagaggg

SEQ ID NO: 1613 - DNA, 1278 bp, Gossypium hirsutum
acttgcaatattcaattaattagcagaaaaaaaaaagaaacaattggttgaagcatggaatagactgtagagcaagaaaaatgatggtttaaggttttaatagaaaagaaaaaaccagcatgaaaccatagctcccctatttcttcaacctctctattaattcatctctttctttttcttcaattattccttccttttttgttgtctttatttaatcctttttggggttgtcattatcagtccaaaatccaaaaccccaccctgaaattatcaaattcccactcccaatttgcttatagtttttttttaaaggaaataaaagagatatagaaaaaaaaggaagcaaaagtttccatggattctcaggttttggtggcgcttgctctctctctcgtcggtggattgagtacttctctaggtgctcttttcgtaattcttaatcaagctcccaatttgaaaatgctcgggcttttacagggttttgctgcaggtctaatgttgagcatatcattccttgatttagctcataacgctatgaactcaattgggttcttgaaaggcaacctctggtttttttctggtgttatcttctttgctgtggttgccaattttatacccgagcctaccctatctcacagttctaaggtgaaaggcaaaaagaacaagggtgatgaagggggcaaggatatgatgaaaaagcatcgacgccaggtttttttcagtggaattattacagcaataggcataagcttgcataattttcccgaggggatggcagttttccttggatccatgaagggccttcgtgtcggtcttaatttggctttggccattgctttgcacaacatcccagagggtgttgctgttgcactgcctgtttattttgctacacagagcaagtggcaggcattcaagttggcaactctttctggttttgcagagcctctcggcgttgtaattgttgcttatctgttcccgagcagcttaagtcccgaaattctcgagggcttgttaggatcagttggtggggtgatggccttcctaacattacatgaaatgctgccattggcatttgactatgccgggcagaagcaagctgtcaaggctgtgttcttcgggatggctttcatgtctgcaagcctatactttctcgaactaagcttaccgaaggacatgagcttgtaacctctttccatatgaacaaaaaatgttgtaaattcctgaaccaagatgtttatttagttgatttctctgataatttagccaaactatgagata

SEQ ID NO: 1614 - DNA, 868 bp, Manihot esculenta
attttcgcctttttatctcaatggattctcaagttctggtagcacttgctctttctcttgtgggtggattgagcacttctataggtgcattttttgtaattcttaatcaggctcctaatctaaagatgcttgggcttttacagggctttgctgcaggtctaatgttgagcatatcattcctagatctggctcataatgctatgaattcaattggcttcttaaaaggcaacctttggttttttggaggtgttgtattctttgctattgtcgcaaggtttatcccagaaccaacagtaatccctggttcagatagtaaaagcaaaaagacgaatggggatgatggaggaaaggacatcatgaaaaagcatcgtcgccaagttttttttagtggcatcattacagccataggcataagcttgcacaattttccagagggaatggcagtattccttggttcgatgaagggtctacgtgttggtcttaatttggccttggctattgctttacacaacattccagagggtgttgctgttgccctgcccatttattttgcaacacaaagcaagtggcaggcattcaaattggcgacactttctggttttgcagaaccactcggcgttattcttgtagcatatctatttccaagcagcttaagtcctgaaattcttgagggtctgctaggatcagttggtggagtaatggctttcctaaccttgcatgaaatgctgccactggcttttgattatgcggggcagaagcaagctgttaaggctgtgttccttggtatggctttcatgtcagcaagtctatattttctggaaatcagcttacctgaggagatgagtttgtaactatcaactgaaatgct

SEQ ID NO: 1615 - DNA, 1402 bp, Quercus alba
ggggggaccgtttctcaaaccatctctttcttccacagtctaaattccctctctccctcccaaaacttcgtttatataaacctgcactgcacacttactacttcataaactcacaaaattctgtttcttgttgagtaaagctttcgacttttctgcgaattctctctgatttggtgttaaagtttgaatcttttgggcacccaatacagaaagaaaggaaaagctgcaaatgggttctcaggtattggtggctcttgggctctcactaattggtggactgagtacttctataggtgcactctttgtagttctcaatcaggctcccaatttgaagatgcttgggattttacagggatttgcagcaggtctgatgctgagcatttcattcctggatttggctcacaacgctattaactctattggcttcttaaaaggaaacctttggttttttgcaggtgtcttattttttgctattgttgccaattttattccagaaccaacacttgccccggtttcagatagtaaaaagaaaactagagatgaagggggcaaggacattatgaaaaagcatcgccgccaagttttattcagtgggattgttacagctgtaggcataagcttgcacaattttcctgaaggaatggcagtttttcttgggtcaatgaagggtcttcgtgttggtgtcaacttggctttggccattgctctgcacaacattccagagggtgttgctgttgcacttcctgtttattttgcaacacaaagcaaatggcaggcattcaaattggctaccctttctggtttggctgagcctctgggtgttataattgtagcctatttattcccaagcagcttgagtcctgaaattcttgagggcttgctcggagcagttggtggagtgatggcttttctaaccctgcatgaaatgctgccgctggcatttgattatgctggacagaagcaagctgtcaaggctgtgttctttggaatggctttcatgtctgcaagcctatattttcttgaaatcagtttacctgaggagatgagcttgtagtaatggaacagtctgttggtattcctctattgtacatttctggaccgctatgatgggttttcaaattgtgcctgatcttgtcaaccggcattgaagacctatactaatagtcggcttcatttggtctcaggcaaagggcagagaagttataccattatgtactgagcagttcttatcatcaatataacagaaatgtatcactgtttgttttttaattaaaataaataaaataagagaaagggagggaaaaaaatacaagatttcatggaacttgttttctcttgataacttcatgtcatctatctttttgtgcttgtttgagtatatacacttaaagagcaatactag

SEQ ID NO: 1616 - DNA, 1332 bp, Cucumis sativus
gatacaacaagaagaaggtaaccaaaaccaaagcaaaaagtgcccgactttcttggactactttgctaaaccatctctttctttcgccataaagattctctccgaaacccctctaaagtagaagaaaatatttttatatttggttcaatagcagcggcaagtttctcgctgcttgcagaatatagtcagctccttcaacatttgtttctgaatttctaaggtttaaaagccctcgaatcgtttcgggggtttttattgctgtgattacagacgcctttgaatccaggatacaactctactaaacttacatggcttctcaggtgttggtagctttggcactttcgcttgtgggtggattcagtacttctctaggtgcactttttgtggttctcagcggggctccaaatttgaagatgcttggtcttttacagggatttgctgcaggtttaatgttgagcatttcgttcctggatttagctcataatgctattaactcaattggattcttaaaaggaaatctttggttttttgctggtgtaatcttctttgcctttattgctcactttattccagaaccctcacttggtcctgtttcagataccaaacgtaggaaggacaaggacgaaggtggcaaggatattatgaaaaagcatcgtcgtcaggttctgtacagtgggataataacagcaataggaataagcttacataactttccagaagggatggctgtttttcttggatcagttaagggtcttcgtgttggtctgaacttagccctagccattgccttgcacaacataccagagggtgtagctgttgcacttcctgtttattttgctacacagagcaaatggcaggcattcaagttggctacgctctctggctttgctgagccccttggtgttgtaatcgtagcctacttatttccaagcagcttgagtcctgagattcttgaaggtctactaggatctgttggtggagtaatggcgtttctaactctgcatgaaatgctgcctttggcttttgattatgctggacagaagcaagctgtgaaggtagtcttcttaggaatggcttgtatgtcggcaagtctttattttctggaaatcagcttgccggaggatttgagcttatagtgtacctgtctcttctgttccttgccatttctatgctgtaaatttcctgggaaagaagaacatataggggaataaagcattaccatttctatgtcacctgacatttgcctcaacaatctaattctaattctgtgtataatacacattcgaactattgacctcatttaaatgaatcaatggtctcaattattggttc

SEQ ID NO: 1617 - DNA, 1115 bp, Flaveria ramosissima
gaaggcaaccggagacctactgtcagcagtttcgaacattatcaccaccatcaacaactctataaacatcaacaattgtttcaattcaattttcacagctactgattctctaaatcctctgtttctttgaagaatttgatgatggattcggaggttttggttgctctttctctctcgcttgttgggggattaagtacatctttaggggcgctttttgtgattttgactaaagctccaaatttgaagatgcttggacttctgcagggttttgctgcaggacttatgctaagcatatctttctttgatttggcccataacgctataaattccattggttttctgaaaggcaatatttggttctttggaggtgtcattttctttgccatcatcgctaattttattccggaaccatcactagctcctacaatagacactaaaaataaaaagaaacaagtagatgaagggggaaaagatatcatgaaaaaacatcgtcgtcaagttttatttagtggcattataacagcagttggcataagcttacacaattttccagaaggaatggctgttttccttggatcactcaagggtcttcgtgttggccttaacttggctctagccatagccttgcacaatatcccagagggtgttgctgttgcacttccagtttattttgcaacacagagcaaatggcaggcgtttaaattggcgacggtttctggctttgctgagcctttgggtgtcatcattgtagcatatctcttcccaagtagcctagatcctgagattcttgagggcttgctaggatcagtcggtggagttatggcctttttaacactacatgaaatgcttccgttagcatttgattatgctggacagaagcaagctgttaaagccgtcttctttggaatggccttcatgtccgcaagcttgtactttctggagattagcttaccctcggatgtaggcttgtagatgcaaattcctttattcgacgcgtgttaatttaaaccgagatttacttctatttagcatcctaacccttggcaaaattaaagggtaacaagtagagcaaggataaacaaaatgtatatacacatgtgctgctattcttattt

SEQ ID NO: 1618 - DNA, 1319 bp, Fagopyrum esculentum
ggaagagcattattgaattgtttgagtcaaacgtcaccctaattcttgatttctttccttactcttgctttatccccaattattcctccatcatttttctcataaaccctttttctggttccttattcccggctatccaacaacttctacattgcttttagttctataacctattgccattgcctgcaagagggttttcgggatcctatttacaaactgaatcgattttgttgagcgaatttctggtactggaaactgttgcaatggaatctcaggttctggtggctcttgcgctgtcacttgtcggaggattgagcacctctttaggtgcacttttcgtgatacttaatccaaccccaaacttgaagatgcttgggttattacagggatttgctgcaggtctcatgctcagcatatcattcctggatttggctcataatgctctgaactctatcggcttcttgaagggaaacctttggttctttgcaggcgtcattttctttgctgctatttccagtttcatcccagaaccaaaccttactcctggttcggacttgaaagtaaaagaagaggaatgtggaagaaaagggcaaggacacaatggaaaaacatcgccgccaagttatgttcagtggaattgtcactgctataggcatcagcttgcacaattttccagagggtatggcagtttttcttgggtccatgaagggtcttcgagttggtcttaacctggcgctggcaattgctttgcacaacattccagagggtgtagctgttgcacttcctgtctattttgcaacggagagcaaatggcaagcattcaagttggcatcactttctggcttcgctgagccccttggtgttattattgtggcctatcttttccctgccagtctgagtcctgagattctagaaggtcttcttggagcagttggaggcgtaatggcttttctgactctgcatgagatgttgccgttggcattcgattacgctggacagaaacaagcggtcaaggccgtgttcttgggaatggccttcatgtctgctagcctatactttctggaaattagcctaccagaggagatgagcttatagtaggtgtgcagaatttggtctcatgatgtgtatgaaggagaaatgtgatctgatggtttctcatagggtttgaacaaaacaatgtaatttcatggttgtagtaaataagatctgtttagtgaatttaacttgtggggagggtaacttggaaagatcaatacataatgttcttccccatactttctttcattgtttgataacaattaccaaataaagagtacatg

SEQ ID NO: 1619 - DNA, 1444 bp, Lactuca sativa
ttttattaggtacatgacgattgctttggcttatagaattggaataaaagtggtttatggaacaatttggggcaggaggtaaccggagacttgctgtaagcagtttcgcacattgtcatccgaaggcacccaattgcctccaccatctgtaaccctataaacaacattcaagctcatcaatcgtttcatcacaagttttaaactactgattctcccaacttttccatttcctccatttcttcgttcctaattcctgaaataaatcgaggaatggactcgcaggtgttggttgctctttctctctcgatggttggcggattaagtacatctttaggtgcactttttgtgattctagccaaggctccaaacttgaaaatgcttggacttttacagggttttgcagcaggtcttatgctaagtatatctttctttgatttagctcataatgccataaattccattggctttctaaaaggcaatctttggttctttggaggtgtcattttcttcgcgataattgctaattttattccagaaccatcacttgctcccacagcagactccaaaagtaaaaagaaatatggagatgaagggggcaaagatgtcatgaaaaaacatcgtcgacaagttttattcagtggaattattacagcagtaggcataagcttacacaattttccagaaggaatggctgttttccttggatcattaaagggtcttcgtgttggccttaacttagccttagctattgctttacacaatattccagagggtgttgctgttgcacttcctgtttactttgcaacacaaagcaaatggcaggcgtttaaattggcaacggtttctgggcttgctgagcctttgggtgtcattattgtagcatatctcttcccaagtagcctagatcccgagattctcgagggcttgttaggagcagttggtggagttatggcctttttaacgcttcatgaaatgttgccgttagcatttgattatgcgggacaaaaacaagccgttaaggccgttttctttggcatggccttcatgtctgcaagtttgtattttttggagatcagcttaccggcggatgtgggcttgtagatgcgaattcctttgttgggctcaattaaaagagtaacaagtagaacaaagtaaattgagaaacaaaatgtacatacatatgtgctattcttatatgtactttaacattacattgaatttaggcttatttgaatattatgttgttgcattttaaaaaataattgttggattcaagcccatgatttgaagaagtgtaatgatgtgcattgtacaagtcattgatgcatttatgtccacatgtccaatgtggtacaagctttcatagtattgtatagtacaaatttacaatttgcaatgattgcgattttaagggattaatgattatttacttgatcaaaggtga

SEQ ID NO: 1620 - DNA, 1239 bp, Artemisia annua
gatacaaaacgagaataattaaacagagagaaaaaattgggggcaagtaaccataaacctactgtcagcagtttcgcatattatcattaaccgtctttttctttttttataaataaataaaacccctcatttcaaacacactaaaataacaagttttaaaacatacccatcatttcatatatttgaatctgtaaatttgtaagaaagaaataatggattcagaagtattggttgctctttctttatctcttgttggtggattaagtacttctttgggtgcacttctagtgattttgactaaagctccaaacttgaagatgcttggacttttacagggatttgctgcaggccttatgctaagcatatctttctttgatttggctcataacgctataaattccattggatttctcaaaggaaatctttggttctttggaggtgtcattttctttgccatcattgcgaacttcattccagaaccatcccttgctcccacatcagacccgaaaagtaaaaagaaacatggggatgaaggtggcaaagatatcatgaaaaaacatcgtcgtcaagttttatttagtggaattatcacagcagtaggcataagcttacacaattttccggaaggaatggctgttttccttggatcacttaagggtcttcgtgtgggccttaacttggccttagccatcgctttgcacaatatcccagagggtgttgctgttgcacttccagtttattttgcaacacagagcaaatggcaggcgtttaaactcgcaactgtttctggacttgccgagcctttgggtgtcattattgtagcatatctcttcccaagtagcctagatcctgagattctcgagggattgctaggagcagttggcggagttatggcctttctaacactgcatgaaatgctgccattagcgtttgattatgcgggacagaaacatgctgtcaaggccgtcttctttggaatggcctttatgtctgcaagcttgtattttctggaaattagcttaccagcagacatcggcttgtagatgcaacttcctatatttagcaagtgttaatccaaatctcgattagttcttcattcggctcccctgtcaagatatagggtaacaagtagaacaaagtataatgagtgaagatgaacagaatgtttttaagtgtacatcatcatatgctactattcttacatgtacttcacataaaataaaaaatcagggatatttg

SEQ ID NO: 1621 - DNA, 1596 bp, Citrus sinensis
cgttaggtatatcaaaaaaaaacgcaaatgaaatgaagaaagcaaaggaaaatgaaaggaaacgaaatggtgattgatgagtgatgattgatgattgatgagcacagctgataacatctacttagcttagcgcagttgtttttgtcattgcttgcaccccgccattgaacaatctctttcttccactgtacatattccaaatatgctctcaaataacgttttatttagtgttattaattaattaattaattcagtggagtcgacaaaaaaccaaatccaatttgttattttgatttggtcaattattttaaaacccaaaaccctataaatattattcgccaacctcaaatacccactacagtttttgagtttttgaagggaaatataggacagcctagaggaagaaaatggtttctcaggttttggtagctcttgggctttcacttgtgggtggattgagtacttctattggtgcactttttgttgttcttaatgaagctcccaatttgaaggtgcttgggcttttacagggttttgctgcgggtctgatgctgagcatatcgtttctagatttggctcataatgccataaactccattggctttttgaaagggaacctttggtttttttctggtgttatattcttcgcaatcgttgccaattttatccctgaaccatcacttgctcagggttctgatctaacaagtaaaaagaaaaacaaggatgaagggggtaaggacattatgaaaaagcatcgtcgccaagttctttttagtgggattattacagccgtaggcataagcttgcacaattttcctgagggaatggccgtatttcttggatcaatgaagggccttcgtgttggccttaatttggcagttgccattgctttgcacaacatccctgagggtgttgctgttgctcttcctgtttattttgcaacacagagcaagtggcaggcattcaaattggctactctttctggttttgcggagcctcttggagttataattgtggcctacttatttccaagcagtttaagtcctgaaattctcgagggtttgctaggatcagttgggggagtgatggccttcctaactttgcatgaaatgctgccgttggcctttgattatgcgggtcagaagcaagccgtgaaagctgtattcgttgggatggctttcatgtctgcaagcttatattttcttgaaatcagcttgccggcagagatgagcttgtagctgccacatgtcatgacatttgtacattcctgaactgcctcgatggtttctatcataaggttgctgcctgccttactgttctttagccaaaaagccaacctgtggagctgctatgaaaaatagtaattcttatgattcaactcaaaattgtacgctcaaatggaaaatgtatgtgacaagaaaaagaccccaaaggcttgtgtattttttattattgtctttcctccctaagctttttcgatattacgctgatcgatccatttattttcttgccattgaatttactttttatcttttaaaaggttcagccggagatgagagtcctcacccattaaataccaatatttatcctcggtta

SEQ ID NO: 1622 - DNA, 1602 bp, Citrus sinensis
cgttaggtatataaaaaagaaacgcaaatgaaatgaagaaagcaaaggaaaatgaaaggaaacgaaatggtgattgatgagtgatgattgatgattgatgagcacagctgataacatctacttagcttagcgcagttgtttttgtcattgcttgcaccccgccattgaacaatctctttcttccactgtacatattccaaatatgctctcaaataacgttttatttagtgttattaattaattaattaattcagtggagtcgacaaaaaaccaaatccaatttgttattttgatttggtcaattattttaaaacccaaaaccctataaatattattcgccaacctcaaatacccactacagtttttgagtttttgaagggaaatataggacagcctagaggaagaaaatggtttctcaggttttggtagctcttgggctttcacttgtgggtggattgagtacttctattggtgcactttttgttgttcttaatgaagctcccaatttgaaggtgcttgggcttttacagggttttgctgcgggtctgatgctgagcatatcgtttctagatttggctcataatgccataaactccattggctttttgaaagggaacctttggtttttttctggtgttatattcttcgcaatcgttgccaattttatccctgaaccatcacttgctcagggttctgatctaacaagtaaaaagaaaaacaaggatgaagggggtaaggacattatgaaaaagcatcgtcgccaagttctttttagtgggattattacagccgtaggcataagcttgcacaattttcctgagggaatggccgtatttcttggatcaatgaagggccttcgtgttggccttaatttggcagttgccattgctttgcacaacatccctgagggtgttgctgttgctcttcctgtttattttgcaacacagagcaagtggcaggcattcaaattggctactctttctggttttgcggagcctcttggagttataattgtggcctacttatttccaagcagtttaagtcctgaaattctcgagggtttgctaggatcagttgggggagtgatggccttcctaactttgcatgaaatgctgccgttggcctttgattatgcgggtcagaagcaagccgtgaaagctgtattcgttgggatggctttcatgtctgcaagcttatattttcttgaaatcagcttgccggcagagatgagcttgtagctgccacatgtcatgacatttgtacattcctgaactgcctcgatggtttctatcataaggttgctgcctgccttactgttctttagccaaaaagccaacctgtggagctgctatgaaaaatagtaattcttatgattcaactcaaaattgtacgctcaaatggaaaatgtatgtgacaagaaaaagaccccaaaggcttgtgtattttttattattgtctttcctccctaagcttcttcgatattacgctgatcgatccatttattttcttgcctttgattttactttttatctttttaaaggttcagccggagatgagagtcctcacccattaaataccaatatttatcctcggttattactc

SEQ ID NO: 1623 - DNA, 1395 bp, Fragaria vesca
atacaaagttaggtacaagactccatccctaaacaaggaaacttggttgcaccatcttacacttgcttggaacaccctttcaaacatctctttcttctactataaaacaaacccagattccctctcccatttcctctcctccctctatatatacttacctcggagtagtttgccatttttattttctagtctttacccaagtgtttccttagtcacactcttttcaacccccaccaagccctccatggattctcaggtcttggtggctctcgcactctcacttgtgggtggattgagtacttctctgggtgctcttttcgtaattctcaatgaggctcccaatttgaagatgcttgggcttttacagggttttgctgcaggtctgatgctaagcatatcattcctagatttggctcacaatgctataaactcaattggatttttaaaagccaacttatggtttttcggtggtgtcatattctttgccataatcgccaattttatacctgaaccatcacttgctcctagttcagatgtgaaaagtaaaaagaaaggcggggatgaagggggaaaagacactctgaagaagcatcgccgtcaagttttatacagtggtattgttacagcaataggcataagtttgcacaactttcctgaaggaatggcagtgttccttggatcaatgaagggcctccgtgttggtgtcaatttggctttggccattgccttacacaatatcccagagggagttgctgttgcacttcctgtctactttgcaacacagagcaaatggcaggcgttcaaattggcgacactttctggttttgctgagcctttgggtgttataatagtagcctatctattccctagcagcttgaatccagaaattcttgaaggccttctgggagcagttggtggagtgatggctttcctaactctgcatgagatgctgcccttggcatttgattatgcagggcagaagcaagctatcaaggctgtgtttttgggaatggctttcatgtctgcaagcctatacttccttgaaatcagcttacctgcagaaatgagcttgtagctgtattccatttgctattttagggttgtacatttatgtactgccatgcatgatagtcctcaaccggtgcccacttattgtaattggcactgaatagctgtaatacattcgattcggtttcggcctagaggagattacagttgcggaaagatagcagattgatcatatttaagatcctagaaacattgcaatcaaatgtaaagtgattagtgtatgagactcgacttcttcaatcaacttcagtctctttttcgttcttatttgcatttgatttgatggagctgataaaagtcctaaaacagtgtaacaagacttacgac

SEQ ID NO: 1624 - DNA, 1390 bp, Valeriana officinalis
ttcgaaccataatattttatttcatttttcttggtggacgaagcaagagaaatgcctgttcttcaatttccaaataaaaccttccgtccttttatctttattctcattcttagttcttaattccaaaaccctaaaaagcttccttccattgatgggtcacttcatcaaacacattccttttctttcactgcacatattctccactataaatatacaataatcaactcaatctctctctaaaaccccaattttcattagcacaacttatgcatatgttgaactatcacctatatagacactgattttcttgggatttgagtcaaacaccattacagctttcatggactctcaagtcttggtcgctcttgctctctcacttgttggcggcttcagtacttcattaggtgctctttttgtgattctaaatgaaactccaaatatcaaaatgcttggtctcttacagggtttcgctgctgggcttatgttgagcatttcattctttgatttagcacataatgccattaactctattggcttcttgaaaggaaatctttggttctttgcaggtgtaattttctttgcaattattgcaaatttcattccagaacctactttatctccagtttcagacacgaaaaatagaaagagaaaaggtgatcaagggggccaagatacgatgaaaaagcatcgacgacaagttttatatagtggaatcgtcacagcaataggcataagcttgcacaatttcccagaaggaatggcagtgttccttggttcaatcaagggtcttcgtgtcggtcttaacctggccttggctattgctttgcacaacattccagagggtgtagctgttgcacttccggtctactttgctacacagagcaaatggcaggcattcaaattggcaacactatctggtcttgctgagccacttggagtagttatagttgcttatcttttcccaagtagcttaaatcctgaaattctagaggggcttcttggtgcagtgggtggagtgatggcatttttaacattgcatgagatgctaccgttggcttttgattatgccggacagaaacatgctgtgaaggctgtcttcttcggaatggcttttatgtcagcaagcctgtattttctcgagattagcttacctgaggatttgagcttatagctaaaacgccgacaaagaagtattcagctcaatgttgtacatttcagaagtaaaatcatctcaggaaactaacagatttgatatgcattcggcacttagaaagcgagctcgacttctgctagttaaattcacttagaatgcattcactttaagtaaaacacacgttagaaaaaaacctcttttctttcaacaatatttatttgtaataaaaagagaata

SEQ ID NO: 1625 - DNA, 1263 bp, Tropaeolum majus
gaagataatccaagttaggttcgaaaaaaatggagtcgattgaacaaatacactactctataattattccattgtagcaaaacttaagagtagaaactagaaagcaatccaattaaatcatccttttcctcaatcttacatattctttctctacttttggggatttttgaggaattcgtcctaaacctccccagaataattatctctatatagtcgatttcagtccaaaaaactttccctaggttttgtgtttataatctagttttatttagtgtatcgaaggagataaggaggaataagtagtcttcatggattctcaagtggtggtggcgcttgctctttcccttgtgggtggattgagtacttctctaggtgcactatttgtaattcttagtaagacgcccaatatgaagatgcttgggcttttacagggttttgctgcagggctaatgcttagtatatcattccttgacttggctcataacgctatcaactcaattgggttcttgaaaggcaacatttggttttttggaggcgttgtgttctttgctttcattgccaaattcataccagaaccaacacttgttccaggttcagatgtgaaaaggaaaaagaaaaacggggacgaaacaggcaaggatatcatgaaaaagcgtcgccgtcaggttatgtttagtggaatcgttactgccataggcataagcttgcataacttcccggaggggatggcagtattccttggttcaattaaggggcttcgggttggcgttaatttggcactggctattgctttgcacaacattcctgagggtgttgctgttgcacttcctgtttattttgcaacagaaagcaagtggcaggcattcaaattggctacactttctggtttggcagagccgctaggagttattattgtagcctatctattcccaagcagcttaagtccagaaattcttgagggcttgctaggagcagtcggcggagtgatggctttcctgactttgcacgaaatgttaccgttggcattcgattatgctgggcagaagcaagctgtaaaggcggtgttccttggaatggcgttcatgtctgccagcttgtattttctggagatcagcttaccttcagaaatgagcttgtagttgtcgttaacccaatcaaattatgtgtagattccgatgtaataagcagcttgtatggatgctcgcgatatcatcccttcaagcattagctcatttacaaagggatgtgatatgtgaaaaacaa

SEQ ID NO: 1626 - DNA, 1360 bp, Aquilegia formosa
atttgagaaagaaaggttggaaagatgcttgttccatatgctcttcacaccataggcatagagcaaacaatctcattaacaaacaatctcttgctttctcattaaacatacgttttcttctgctgtgttgtgttctcagagacaaattgtcaaacaggttgtgttgtggtttcctgtttccctccccaccattttaaataccaaaaccattccatttcttttctctcatccactatcttctatatacctaactcacacaccatttctcttctcttctcagtgttttcttcgtcactattccaactacatcatcacccatcttgctttcataaaccccccaaccccaaccccaacgtctctctctctctctctctctctctgaaatttgtacaatggattctcaggtgatggtagctcttgctctatcaatggttggtggattaagcacgtcactaggtgcactttttgtgattcttaacgatgctcccaatctgaagatgcttgggcttctacaggggtttgctgcagggcttatgctgagcatttcgtttctagacttggcacataatgctatgaattctattggcttcttaaagggcaacctttggttctttgcaggtgtcatattctttggtattattgccagttttatccctgaacctacactagctccgagtgtagatgttaaaagtaaaaagaaaaaagatgacggtggcaaggaccagttgaaaaagcatcgccgtcaagttctatttagtggaattatcactgctattgggataagcttgcacaattttccagagggaatggcagtgttccttgggtcaatgaagggacttcgggttggtctgaatttggccttggctattgcgttgcacaacattccggagggagttgccgtcgcacttcctgtctactttgccactcagagcaagtggcaggctttcaaactggcaacactctctggatttgccgagccccttggtgtggttattgtagcttacctgttcccaagcagtctaaaccctgagatacttgaaggcttactcgcagcagttggcggagtcatggcttttcttaccttgcacgagatgctgcctttagcgtttgactatgcaggccagaaacaagccgttaaggcggtattccttgggatggctttcatgtctgcgagtttatactttctggagatcagcttaccaaaggacatgagcttgtagtggcagacttcagagcctttgtacattgccaaccattgcaggttttggaccttcccaattgacctcatttacttgtaatgtcaggaatttatgcactcctgaaggcccatgttatatcagcttgccagtcatgtaaatga

SEQ ID NO: 1627 - DNA, 1642 bp, Cannabis sativa
ataacattgtattgatttgatttgatgctaccttacattgtatcccaaaaaagagaaattgaactgaaatttgaaaattaaagccactaaatttcagcaaaatacaattgaaacctaaatcccaaatgcccatttaaatcaaattaaattaaattaaatgtatctactttacaaaataaaaattaaaaattaaaactttaaaaataagagatggcatgggaaatgggttatggcgtagcaggtgacttccatgaaagtttagggataatattatatgagtttcattaaacaaaccctaatgtctattgaagaagaagacgaagaagaaacacaaggaaaggaattggtggagatcagagtaacaccaccactccaaaccatctctttccctttcttcaaccacacaaattctcttcattaaaccttctctctagttttcccttttagccttcatatatattacgtctaacacgttcaataaaaacattccttcttccctaaaaatctgatctttgagtttcttgatagaccacaatggattctcaggtcttggttgctctggccctctcacttgttgggggactcagtacttctataggtgcaattttagtgattctcaatccaactccaaatttgaagatgcttgggcttcttcagggctttgctgcaggtctaatgttgagcatatcattcttggatttagctcacaacgcgataaactcgattggcttcttaaaaggaaacttatggtttttttcgggtgttattttctttgctgtgattgctaattttattccagagccatcacttgctcctgttccaaataagaaagataaaaagaaaaatggggatgaaggtggcaaggatatcatgaaaaagcatcgtcgtcaagtcttatatagtggaattgtcacagcaataggaataagcttgcacaattttccagaaggaatggcagtgttccttggatccatgaagggtcttcgtgtcggtgtcaacttggccctggcgatcgctttgcacaacatccccgagggcgttgcggttgcacttccagtttactttgcaactcaaagcaaatggcaggcattcaaattggcaacactttctggttttgctgaacctttgggtgttataattgtggcctatcttttcccaagcaacttgaatcccgaaattcttgaaggccttcttggagcagttggtggagtgatggcttttctaactctgcatgagatgcttccattggcgtttgaatatgcggggcaaaagcaatctataaaggcggtgttcttgggaatggctttcatgtcagcaagcttatattttcttgaaatcagcttgcctaaggagatgagcttgtagagtaaatggtcaatttgtatcaggattctgcattgaataaacttacaattatagccaactttcttaactgattttattaagatatgattcaacaccaaaatggattttttcttttttttttactttgcactttttatttctaattttctatcttaatcttgtaaataaataaagaatatggaccctgttgtgcatgttttataccttaccaaacaagtttaatactccaactagtaaatattatataagaacaattgtcaaaactatttttatttat

SEQ ID NO: 1628 - DNA, 1602 bp, Citrus clementina
cgttaggtatataaaacagaaacgcaaatcaaatgaagaaagcaaaggaaaatgaaaggaaacgaaatgatgattgatgattgatgattgatgattgatgagcacagctgataacatctacttagcttagcgcagttgtttttgtcattgcttgcacctcgccattgaacaatctctttcttccactgtacatattccaaatatgctctcaaataacgttttatttagtgttattaattaattaattaattcagtggagtcgacaaaaaaccaaatccaatttgttattttgatttggtcaattattttaaaacccaaaaccctataaatattattcgccaacctcaaatacccacttcagtttttgagtttttgaagggacagataggacagcctagaggaagaaaatggattctcaggttttggtagcgctcgggctttcacttgtgggtggattgagtacttctattggtgcactttttgtagttcttaatgaagctcccaatttgaaggtgcttgggcttttacagggttttgctgcaggtctgatgctgagcatatcgtttctagatttggctcataatgccataaactccattggctttttgaaaggaaacctttggtttttttctggtgttatattcttcgcaatcattgccaatttcatccccgaaccatcactagctcagggttctgatctaacaagtaaaaagaaaaacaaggatgaagggggtaaggacatgatgaaaaagcatcgtcgccaagttctttttagtgggattattacagccgtaggcataagcttgcacaattttcctgagggaatggccgtatttcttggatcaatgaagggccttcgtgttggtcttaatttggcagttgccattgctttgcacaacatccctgagggtgttgctgttgctcttcctgtttattttgcaacacagagcaagtggcaggcattcaaattggctactctttctggttttgcggagcctcttggagttataattgtggcctacctatttccaagcagtttaagtcctgaaattctcgagggtttgctaggatcagttggtggagtgatggccttcctaactttgcatgaaatgctgccattggcctttgattatgcgggtcagaagcaagctgtgaaagctgtgttctttgggatggctttcatgtctgcaagcttatattttcttgaaatcagcttgccggcagagatgagcttgtagctgccacatatcatgacatttgtacattcccgaactgcctcaatggcttctatcacaaggttgctgcctgccttactgttctttagccaaaacgccaacctgtggagctgtctatgaaaaatagtaattcttatgattcaactcaaaattgtacgctcaaatggaaaatgtatgggacaagaaaaagaccccaaaggcttgtgtatttttattactgtctttcccccctaagcttctttgatgttacgctgatcgatccatttattttcttgccattgattttactttttatctttttaaaggttcagccggagatgagagtcctcacccattaaataccaatatttatcctcggttattactc

SEQ ID NO: 1629 - DNA, 1180 bp, Flaveria ramosissima
ggcaaccggagacctactgtcagcagtttcgaacattatcaccactatctacaaccctataaacatcaacaatcgtttaatttcaattttcacagctactgattctctacatcctctgtttcttcgaagaatttgatgatgaattcggaggttttggttgctctttctctctcgctggttggtggattaagtacatctttaggggcgctttttgtgattttgactaaagctccaaacttgaagatgcttggacttcttcagggttttgctgcaggccttatgctaagcatatctttctttgatttggcccacaatgctataaattccattggatttttgaaaggcaatatttggttctttggaggtgtcattttctttgccatcatcgctaattttattccggaaccatcaattgctcctacaatagatgctaaaaataaaaagaaacaagtagatgaagggggaaaagatatcatgaaaaaacatcgtcgtcaagttttatttagtggtattataacagcagttggcataagcttacacaatttcccagaaggaatggctgttttccttggatcactcaagggtcttcgtgttggccttaacttggctctagccatagccttgcacaatatcccagagggtgttgcggttgcacttccagtttattttgctacacagagcaaatggcaggcgtttaaattggcgacggtttctggctttgctgagcctttgggtgtcatcattgtagcatatctcttcccaagtagcctagatcctgagattcttgagggcttgctaggatcagtcggtggagttatggcctttttaacattacatgaaatgcttccgttagcatttgattatgctggacagaaacaagctgttaaagccgtcttctttgggatggccttcatgtctgcaagcttatactttctggagattagcttaccctcggacgtaggcttgtagatgcaaattcctttattcgacgcgtgttataatttaaaccgagaattactactgttaagctcccttcgcaagattaaagggtaacaattagagcaaggataaacaatatgtaaatacacatgtgctgctattctaatttgtactttatataaaacttcaggcttatttgaaaatgatgttatgccttttggtattctgctggtcatctatt

SEQ ID NO: 1630 - DNA, 1418 bp, Populus trichocarpa
ggtatcggctgtaaggaaagtcttcttccttgaacttctttctcctctttatattgtttccctctaaacacaatcactccttcagtggagtggtcatatatatatcagctctaatcaattattgggtcgttgtcatatagcgaaaagaagcatcttttttcaatggattctcaagttatggtagctttggctctctctcttgtgggtggattaagcacttctataggtgcactctttgtaattctttttcaggctcccaatttgaagatgcttggactattacagggttttgctgcaggcctgatgctgagcatatcattccttgatcttgctcataatgctatcaactcaattgggttcttaaaaggcaacctctggttttttggaggtgttgtattctttggcatcattgccaattttatcccagagccaacatttgccccaagttcagatgttaaaagtaaaaagaaaaatggcgaccaagggggaaaggacataatgaaaaagcatcgtcgtcaagttttgttcagtggaattatcactgcaataggaataagtttgcataactttccggagggaatggcagtgttccttggatcaattaagggcctccgtgttggtcttaatttggctctggcaattgctttgcacaacattccagagggtgttgctgttgcacttcctatatattttgcaacgcagagcaagtggcaggcattcaaattggcgacagtttctggttttgctgagccacttggtgtggtgcttgtcgcatatctattcccaagcagcttaagtcctgaaattctggagggtttgctcgcatcagttggtggggtgatggctttcctaaccttgcatgaaatgctgccactggcatttgattatgcgggtcagaaacaagctgtcaaggctgtattctttggtatggctttcatgtcggcaagcctatattttcttgaaatcagcctccctgaggagatgagcttgtagctgtggatcagctttaatcaacctacgtaaccatttgtacattcccaaaccagagagatttaggtcgtgctgcatggtgcctgtgtaatgtcacattgaaatccgatgatttgacctcgccagaaggccaaactggcggcacaatccttgagaacatggcggtttccagctttaagcacctcaaaattgtactgatcttcttactttgattagtgtgaaaatctaaaatggcagtaagggttgacaaggggaacaattatggattgcatactcttcgatgaagttcgtttcatttatcatagtgttgccactcaatgagcttccaagtatactgctgcttgcatggaagataaatggtttctgggctagcaagttacaagctgtagttctacaaaatagatgaaaatgagagctttagttattac

SEQ ID NO: 1631 - DNA, 1416 bp, Solanum tuberosum
gcattctttcatctgcccaattcctgaaggctattgagtctttggggctctccaagatttgatatttaggggagctcttctttccttgagcctacattttttattcttgacatcaatctccaacacccatttgcttcaactacagagaaattccccccagattttttctgggtttactcttcttctttttctgtgaatttttgttttcggctaaaggggtttcagagaaaaagggttttctatggattctcaagttcttgttgctcttggtctttcattgttgggtggattgagtacctctctaggtgcactttttgtggttattagccaggctcctaacttgaagatgctaggacttttacaggggtttgctgctggtcttatgcttagcatatcattctttgacttggctcataatgctataaactccattggcttcttaaaaggaaacctctggttttttgcgggtgttatcttctttgctcttgtttcaaatttcatcccggaacctacacttgcacccatttcaagtgccaaaggcaaaaagaaagacggagatgataggggtaaggatattatgaagaagcatcgccgccaagttttatttagtggaatcatcacagcagtaggtataagcttgcacaactttcctgaagggatggctgtgttccttggatcaatgaagggacttcgggttggtctaaacttggctcttgctattgctttacacaacataccagagggtgttgcagttgcacttccagtttattttgcaacacagagcaaatggcaggcattcaaattggcaacactttctggtctcgcagagcccctgggtgtaataattgtggcatatctatttccaagcagcttgaatcctgaaattctggagggcctcctgggagcagtgggaggggtgatggcatttttaaccttacatgagatgcttccattggcattcgactatgccggtcagaagcgagctgtcaaagctgtgttccttggaatggctttcatgtctgcgagcctatatttcctagagcggagcttgccagcagacatgagcttgtagttctcagtcatatggtgtttcactacttgtactgctgaacttcgatggagttttttcgtggtgctaagcttcaaaactacaattcgcattcttacaaaatccatgaggcatggcatttagtttggcaagctgaatgagagtgaaggtataacagtttctgagattgttttatagtaaaataggaaatgcacacagatctaaaatccctcagccagtatctcatatatgaacaagagatacatgggcaaaacattgtgtggattaatttgcgaatggtcatccaactttcaaatcgttgtaacaatgtcacaaaactaacctttgtaatgaaaaaaaataaactc

SEQ ID NO: 1632 - DNA, 1437 bp, Primula obconica
tttacttgtatcgctccaggaaacgatctctttcttcataccatagttattctccctattttggtcagtcttccgaatatttcttagtcatataatacaatcaaatattatgtatctattcttgtagctgggtaacctccctccttaatcctgttgtagagagagaccccatattttaaaatccctataaaatcagtattacaagtagctgagactatacccaccaatttcaatctgtttaatccattttcattcccatctcattatctgtatcagaattcagggtatttgatttgtgggtttatcaatagagaagaaaaatgaattcacaggtgttggtggcacttgctctctcacttgttggtggattaagtacatctctgggtgctctcttcgtgattcttaaccctgctcccaatctgaaggtgctcgggcttttacagggattcgcagcagggcttatgctgagtatatctttctttgatttggctcataatgctatgaatgctattggctttctgaaagggaacctctggttctttgcaggggtcattttctttgctatcatagccaattttatccctgaaccaacactagctcccattgcagatgagaaaaataaaaagaagaaaggagacgatggaaataaggataccatgaaaaagcatcggcgccaagttttattcagtggaatcatcacagcagtaggcataagcttgcataattttccagaaggaatggccgtgtttcttggatctctcaagggtcttcgagtaggtttgaacttggcctttgcgattgctttacacaacattcctgagggcgttgctgttgcacttcctgtttattttgccacacaaagcaaatggcaggcattcaaacttgcaacactttcgggatttgctgaaccgttgggtgtaataattgttgcttatttattcccaagcggcttaagtcctgaaattcttgagggtctgcttggagcagttggtggggtgatggctttcctaactctgcatgaaatgctacccttggcgtttgattatgcgggtcagaagcaagctgtcaaagccgtatttttcggaatggcttttatgtctgccagtctatactttcttgagatcagcttacctgcggatatgactttgtagcaatggttattgagaactcaaaactattggcagtttcttcctgcatttatgtgtttgtgtggttgtgttgctggattggactccatatcttcatcaatcagtggatgcaaaatttatacttctgtgaatataatttacttattttccttttgatgttctttttctatgttttgctttaaataaattcgaaatatatgtgagtagccgaaatgcctcacacactcgcctagtaattatagataattcataattgtttacaatccttattcaaatttagtagtcaacc

SEQ ID NO: 1633 - DNA, 1504 bp, Solanum phureja
aaagcaagaagtttctaatatcttgaatccctttgtttccattgtctctttctttgactctacacattctttcatctgccccattcctgaaggctattgagtctttggggctctccaagatttgatatttaggggagctcttctttccttgagcctacattttttattcttgacatcaatctccaacacccatttgcttcaactacagagaaaatccctccagattttttctgggtttactcttcttctttttctgtgaatttttgtttttggctaaaggggtttcagagcaaagggttttctatggattctcaagttcttgttgctcttggtctttcattgttgggtggattgagtacctctctaggtgcactttttgtggttattagccaggctcctaacttgaagatgctaggacttttacaggggtttgctgctggtcttatgcttagcatatcattctttgacttggctcataatgctataaactccattggcttcttaaaaggaaacctctggttttttgcaggtgttatcttctttgctcttgtttcaaatttcatcccggaacctacacttgcacccatttcaagtgccaaaggcaaaaagaaagacggagatgataggggtaaggatattatgaagaagcatcgccgccaagttttatttagtggaatcatcacagcagtaggtataagcttgcacaactttcctgaagggatggctgtgttccttggatcaatgaagggacttcgggttggtctaaacttggctcttgctattgctttacacaacataccagagggtgttgcagttgcacttccagtttattttgcaacacagagcaaatggcaggcattcaaattggcaacactttctggtctcgcagagcccctgggtgtaattattgtggcatatctatttccaagcagcttgaatcctgaaattctggagggcctcctgggagcagtgggaggggtgatggcatttttaaccttacatgagatgcttccattggcattcgactatgccggtcagaagcgagctgtcaaagctgtattccttggaatggctttcatgtctgcgagcctatatttcctagagcggagcttgccagcggacatgagcttgtagttctcagtcatatggtgtttcactacttgtactgctgaacttcgatggagttttttcgtggtgctaagcttcaaaactaaaattcgcattcttacaaaatccatgaggcatggcatttggtttggcaagctgaatgagagtgaaggtataacagtttctgagattgttttatagtaaaataggaaatgcacagagactcagccagtatctcatatatgaacaagagatacatgggcaaaacattgtgtggattaatttacgaatggtcatccaactttcaattcgttgtaacaatgtcacaaaactaacctttgtaatgaaataaataaactcaaaaagtattaactgaatgctggaaaacgtaaattca

SEQ ID NO: 1634 - DNA, 1276 bp, Tragopogon dubius
gggggggggcagaaggttaccgggagaccttcagtagcagtttcgcacattgtcatccgaagaaatccaattgtctctaccatctgtaaccctataaacaacattcaagctcactaatcgtttcattacaagttttttagcctactgattcctccaacttttccatttcctctgtgttttcgtccctaattcttgaagaaattgagggatggactccgaggtgttagttgctctctccctttcgctagtcggtggattaagtacctcgttaggtgcactttttgtgattctgactaaagctccaaacttgaaaatgcttggacttttacagggttttgctgcaggtcttatgctaagcatatctttctttgatttagcccataacgcgataaactcaattggatttctaaaaggcaatctttggttttttggaggtgtcattttcttcgccattatcgctaatttcattccagaaccatcacttgctcctgcagtagacaccaaaaacaaaaagaaacatggggatgatggtgggaaagatgttatgaaaaaacatcgtcgccaagttttatttagtggaattattacagctgtaggcataagcttacacaattttccagaaggaatggctgttttcctcggatcactcaagggtcttcgagttggtcttaacttagccttagctattgctttgcacaatatcccagagggtgttgctgttgcacttccagtttattttgcaacacaaagcaaatggcaggcgtttaaactggcaacggtttctggtcttgctgagcctttgggtgtcattattgttgcatatcttttcccgagtagcctagaccctgagattcttgagggcttgctaggagcagttggtggagttatggccttcctaacacttcacgaaatgttgccattagcatttgattatgcgggccaaaaacaagctgttaaagctgtcttcttaggaatggccttcatgtcagcaagcttgtattttctggagatcagcttaccgaaggatatgggcttgtagatataaattcctcattgctcaattaaaaacccgatttgttcttcgttaagggtaacaagtagagggagagtaaatgagaaacaaaatgtacatacacatatgctattcttatttgtactttaacatcgaatttcaagcttatttgaaaattgtgttggctttgcacaaattgttgttggattttggcacatgatttagtgaattgctatatgatatcatggcacaagtaacattata

SEQ ID NO: 1635 - DNA, 1110 bp, Cirsium arvense
agaaggtaaccggaagacctactgtcagcaatttcgcacattctcatcgaattatctccaatctctgcaacctctatcttaataaaccccccattcaacctcactaatcgtttcataacaactttctttctatttactttgtttttatttggaagaaattgaaggatgaactcggaggtgttggttgctctttctctctccatggttggtggattaagtacatctttaggtgcgctttttgttgttatgagtaaagctccaaacttgaagatgcttggacttttacagggttttgccgcaggacttatgctaagcatatctttctttgatttggcccataacgctataaattccattggctttctaaaaggcaatctttggttctttggaggtgtcattttctttgccatcattgctaatttcattcccgaaccatcacttggtcctacatcagacacgaaaaataaaaagaaacatggggatgaggggggcaaagatgtcatgaaaaagcatcgtcgtcaagttttatttagtggaattatcacagcagtaggcataagtttacacaattttccagaaggaatggctgttttccttggatcactcaagggtcttcgtgttggccttaacttggccttagccattgctttgcacaatatcccagagggtgttgctgttgcacttcctgtttattttgcaacacagagcaaatggcaggcatttaaactggcaacggtttctgggcttgctgagcccttgggtgtcatcattgtagcatatctcttcccaagtagcttagatccagagattcttgagggcttgctaggagcagtgggtggagttatggcgtttctaactcttcatgaaatgctgccattagcattcgattatgctggacagaaacaagctgtcaaggctgtcttctttggaatggccttcatgtctgcaagcttgtattttctggagatcagcttaccgaaggatatggggttgtagatgcatattctttctatatttggcaagtgttataaccgcgattcctttgggtccattggaaagaaggataaagaaggccagggtaacaagtagagaaaagtaaaggaacaagat

SEQ ID NO: 1636 - DNA, 1045 bp, Helianthus annuus
cgtttgcctttgtgcataaaactggaataaatagtagttggggcacaaggcaaccggagacctactgtcagcagtttcgcacattatcatcttcctcatcttcctcatcttcatcatcctatattaataacaacctcattcaacatcgtttcatttcaattctcatacacatacatacctactgttgttcttttttcgacgaatttgaggatggattcggaggttttggttgctctttctctctcacttgttggtggattaagtacttctttaggggcgctttttgtaatattaactaaagctccaaacttgaagatgctcggacttttacagggttttgccgcaggccttatgctaagcatatcattcttcgacttagcccataacgcgataaattccatcggctttttgaaaggcaatatttggttctttggaggcgtcattttctttgccattgttgctaattttattcccgaaccgtcgcttgctcctactatagaagcgaaaaataagaagaaacaagtggatgacgggggaaaagatgtcatgaaaaaacatcgtcgccaagttttatttagtggcattataaccgcagttggcataagcttacacaattttcctgaaggaatggctgttttccttggatcactcaagggtcttcgtgtcggccttaacttggctttagccatagcgttgcacaatatcccagagggtgttgctgttgcacttccggtttattttgcaactcagagcaaatggcaggcgtttaaattggcaacggtttctggccttgctgagcctttgggtgtcataatcgtagcatatctcttcccgagtagtctagatcccgagattctcgagggcttgctaggatcagttggtggagttatggcctttttaacgctacatgaaatgctgccattagcatttgattacgctgggcagaaacaagctgttaaagccgtcttcttcggaatggccttcatgtctgcaagcttgtattttctggagatcagcttaccgtcggatgtaggcttgtagatgc

SEQ ID NO: 1637 - DNA, 1615 bp, Eucalyptus grandis
gctgcccgtattctctctcttctgtgcctttcgtgagctccattgcaagagctcgcttcagtccaacccctctctctctctctctcttcctttcgccgcacacattctctccctctcgagcacggcgtgaacccttctccgttcccaacctcttctataaccccaactccacaaccccaccaaggaaagaccgtcgcttgccttccgcatcgagttcgaaatcgccctccccggcgcctccggttgatcttggtgggtcgacattgagctcgagctcgagctcgaactcgaactcgaactcgggtcggtctccgttttcccaatcgttccgagcagcggcttcatggattctcaggtgttggtggctctcgggctctcgctcgtgggcgggctgagcacttccgtaggggcactatttgttattctcaaccaggctccaaatttgaagatgcttggtcttttacagggttttgctgcaggcctcatgctgagtatatcattcctagatttggcacacaatgctatcaactcaattggctttctgaaagggaacctttggttttttgcaggtgtcatcttttttgctattgtggtcaaatttatcccagaaccaccgattgcccccagttctgaatcgaaaaaaaagaagcatactggggatgaagggggaaaggatatgataaagaagcaacggcgccaggttctgtttagtgggatcgttacagcagtagggattagcttgcataattttccagagggaatggctgtcttccttggatccatgaagggccttcgagttgggcttaacttggcagtggccattgctttgcataacataccagagggtgttgctgttgcgttgcccgtatattttgccacacaaagcaaatggaaggcattcaaaattgcatccctctctggttttgctgaacctcttggtgtaattattgtagcctatctatttccaagcaacttgagtccagaaatccttgagggcttgctgggcgcagttggtggagtgatggcttttctgaccttgcacgaaatgctgccacttgcatttgattatgccggacagaagcaggctgtaaaagctgtgtttttggggatggctttcatgtcagctagcttatactttctggaaatcagcttgccaaaggagatgagcttgtagaggaccctaatcaaacactcggatgttcctgttaagtatcagtttgacatcatagggccatgtataacaatacctgctgcggcttagcgatggagatccacccgacaactagtagccaagaactttttagtttctctattgtcatgtgacttgtgccgaaagccgaaactatacacttggctctataaacttctctgtacaaggaggaaatggggtgggtggtgttggagggtgagatgagcttaaccatcatacattcatcttctttggaggacttctctcttttcccttcactttgaataccaagctgatcctccccacaggagcaatatctcattttactgctttcccattttttttggaactgcatcatctcttttgcctgcaggcaggttgagttgtttcggggattgcctcgcggcacattaaagctaattcgta

SEQ ID NO: 1638 - DNA, 1182 bp, Euphorbia peplus
taggtataatccagaggaagacgaagacgaaaactcatttttcttttcctgattatcgtgctactatctaggtcagaccaggtctgtcttatttattcattactttgacttccctatcaaaccatccctttcttagtttattcaaccacttctactatgctctgctcaattcttccttccttgttgtatttagtgaacctataaccccaattcaatcaatctcttcttaatttcaccttaaaaaatccactcattttgtctaattgagggagaaattaagttaagcaagagttaatggattctcaactgttggtagctcttgctctctctctcgtgggaggtctcagcacttctataggtgcacttattgtaattattaatcaggctcccaacttgaagatgcttgggcttttacagggttttgctgcaggcttaatgttgagcatatcattcctagatctggctcacaatgctattaattcaattggcttcttaaaaggcaacctatggttttttggaggtgttgtattctttgctattatagcaaagtttatcccagaaccaacagttgttcctggttcagatgttaaaaacaaaaagaagggggacggaggaaaggacatcatgaaaaagcatcgccgccaagttttctttagtgggattattacagctattggcataagcttgcacaattttccagagggcatggcagtgttccttggctcaatgaagggcctgcgtgttggtgttaatttggccttggccattgctttgcacaacattccggagggtgttgctgtggcgctgcctgtttattttgcaacagaaagcaagtggcaggctttcaaattggccacactttctggttttgccgaaccccttggtgtcgtgattgtagcatttctattcccaagcagtttgaatcctgaaatcctcgagggcttgctagcagcagttggcggagtaatggcttttctcactttacatgaaatgttgccgttggcttttgattatgctgggcagaagcaagctgttaaggctgtcttccttgggatggccttcatgtctgcaagcttatatttccttgaaatcagcttaccgaaggacatgagtttgtagccattggatcaaccacaatgttgtactgtactctgatttaacatggtctcaacctttgatgat

SEQ ID NO: 1639 - DNA, 1491 bp, Solanum lycopersicum
aaagcaagaagtttctaatatcttgaatcccttcttttacattgtctctttctttgactctacacattctttcatctgccccattcctgaaggctattgagtatttgggctctccaaaatttgctatttaggggaactcttagcctacatcttatattcttggtatcaatctccaacacccatttgcttcaaataaagaataacagagaagaaaccccagattttttctgggttgactcttcttctttttctgtgaatttttgtttttggctaaaggggtttcagagcaaagagtttgctatggattctcaagttcttgttgctcttggtctttcattgttgggtggattgagtacctctctaggtgcactttttgtggttattagccagactcctaacttgaagatgctaggacttttacaggggtttgctgccggtcttatgcttagcatatcattctttgacttggctcataatgctataaactccattggcttcttaaaaggaaacctctggttttttgcaggtgttatcttctttgctcttgtttcaaatttcatcccggaacctacacttgcacccatttcaagtgccaaaggcaaaaagaaagacggagatgataggggtaaggatattatgaagaagcatcgccgccaagttttatttagtggaatcatcacagctgtaggtataagcttgcacaactttcctgaagggatggctgtgtttcttggatcaatgaagggacttcgggttggtctgaacttggctcttgctattgccttacacaatataccagagggtgttgcagttgcacttccagtttattttgcaacacagagcaaatggcaggcattcaaattggcaacactttctggtctcgcagagcctctgggtgtaattattgtggcatatctatttccaagcagcttgaatcctgaaattctggaaggcctcctgggagcagtgggaggggtgatggcatttttaaccttacatgagatgcttccattggcattcgactatgccggtcagaagcgagctgtcaaagctgtgttctttggaatggctttcatgtctgcgagcctatatttcctagaacggagcttgccagcggacatgagcttgtagttcttagtcatatggtgtttcactacttgtactgctctgaacttcgatggagttttttcgtggtgctaagcttcgaaactacaattcacattcttacaaaatccatgaggcatgacatttggtttggcaagctgaatgagagtgaaggtataacagtttctgagattgttttatagtaaaataggaaatgcacagagatctcaaatccctcagccagtatctcatatatgaacaagagatacatgggcaaaacattgtgtggattaatttacaaatggttatccaactttcaattcgttgtaactatgtcacagaactaacctttttaatgcaaataataaactcgaaaactatttactg

SEQ ID NO: 1640 - DNA, 1055 bp, Helianthus annuus
atgacgtttgcctttgtgcataaaattggaataaatagtagttggggcacaaggcaaccggagacctactgtcagcagtttcgcacattatcatcatcttcatcttcatcttcatcacccctatattaataacaacctcattcaacatcgtttcatttcaattctcatacacatacatacctactgttgttcttttttcgacgaatttgaggatggattcggaggttttggttgctctttctctctcacttgttggtggattaagtacttctttaggggcgctttttgtaatattaactaaagctccaaacttgaagatgctcggacttttacagggttttgccgcaggccttatgctaagcatatcattcttcgacttagcccataacgcgataaattccatcggctttttgaaaggcaatatttggttctttggaggtgtcattttctttgccattgttgctaattttattcccgaaccgtcgcttgctcctactatagaagcgaaaaataagaagaaacaagtggatgacgggggaaaagatgtcatgaaaaaacatcgtcgtcaagttttatttagtggcattataaccgcagttggcataagcttacacaattttcctgaaggaatggctgttttccttggatcactcaagggtcttcgtgtcggccttaacttggctttagccatagcgttgcacaatatcccagagggtgttgctgttgcacttccggtttatttcgcaactcagagcaaatggcaggcgtttaaattggcaacggtttctggccttgctgagcctttgggtgtcataatcgtagcatatctcttcccgagtagtctagatcccgagattctcgagggcttgctaggatcagttggtggagttatggcctttttaacgctacatgaaatgctgccattagcatttgattacgctggacagacacgagctgttaaagccgtcttcttcgggatggccttcatgtctgcaagcttgtattttctggagatcagcttaccttcggatgtaggcttgtagatgcgaattcgt

SEQ ID NO: 1641 - DNA, 827 bp, Malus domestica
ctcctccatggtttctcaggttttggtggctctcgcgctgtcactcgtgggtggactcagtacttcattcggtgcacttttagtaattgtcaatgagactccgaatttgaagatgcttgggcttttacagggttttgctgcaggtctgatgctaagcatatcattcctagatttggctcacaatgctatcaactcaattggttttttaaaaggcaatctatggttttttggaggtgtcatattctttgctttcattgccaattttattccagaaccaactcttgctcctatttcaaagaaagatgaagggggcaaggacactttgaaaaagcagcgccgacaagttttattcagtgggatagtaacagcaataggcataagtttacacaaccttccagaaggaatggccgtgtttcttggatcaatgaagggccttcgtgttggtgtgaacttggccttggccattgccttacacaacatcccagagggtgttgctgttgcgcttcctgtttattttgcaacacagagcaaatggcaggcattcaagttggcaacgctttccggtttagctgagcctttgggtgtcgtaattgtagcctatctattcccaagcagcttgagtcctgaaattcttgaaggcctgctcggatcagttggtggagtgatggcttttctaactctccatgagatgctgcccttggcgtttgattatgcggggcaaaagcaagccatcaaggccgtgtttttgggaatggccttcatgtctgcaagcctttactttcttgaaatcagcctaccacaggacatgagcttgtagctgtaatcta

SEQ ID NO: 1642 - DNA, 1215 bp, Centaurea maculosa
  misc_feature (1047)..(1047): n is a, c, g, or t
ggggggcagaagagactactgtcagcagtttcgcacattttcatcatccaatttctgcaacctcttcttcttccttctataaacccccaaattcaacctcattactaatctcatttatctccatcttttctgtttctactttggaagaaaattgagagatggattcggaggttttggttgctctttctctctccatggttggtggattaagtacatctttaggtgcactttttgttgtactgagtaaagctccaaacttgaagatgcttggacttctgcagggttttgctgcaggtcttatgctaagcatatctttctttgatttggcccataacgctataaattccattggctttctaaaaggcaatctttggttctttggaggtgtcattttctttgccatcattgctaatttcattccagaaccatcgcttggtccaacggcagacacgaaaaataaaaagaaacatggggatgaggggggcaaagatgtcatgaaaaagcatcgtcgtcaagttttgtttagtggaattattacagcagtaggcataagcttacacaatttcccagaaggaatggctgtttttcttggatcactcaagggtcttcgtgttggccttaacttggccttagccatcgctttgcacaatatcccagagggtgttgctgttgcacttcccgtttattttgcaacacagagcaaatggcaggcgtttaaactggcaacggtttctggccttgctgagcccttgggagtcattatcgtagcatatctcttcccaaagagcctagatccagagattcttgagggcttgctaggagcagtgggtggagttatggcgtttctaactcttcacgaaatgctgccgttagcatttgattacgctggacagaaacaagcagtcaaggccgtcttctttggaatggccttcatgtccgcaagcttgtattttctggagctcagtttaccgaaggacatggggttgtagatgctagtttcttcgatatttggaagtgttgttatgacagacgatttgttcgactccnatggcaggatggtaacaagtagagaaagttaaaaaggaagatgtacatatacatgataagctgctatattcttatttgtagtttacaaggcttatttgaaaattatgttgggtttaattactttacacaattatggttgttggattctgatatatgattcattctact

SEQ ID NO: 1643 - DNA, 1064 bp, Cirsium arvense
aattcaacctcattactattcattttcatcacaactttttctcatttctctccatctttactttggaagaaaattcagagatggattcagaggttttggttgctctttctctctccatggttggtggattaagtacatctttaggggcactttttgttgtactgagtaaagctccaaacttgaagatgcttggacttctgcagggttttgctgcaggtcttatgctaagcatatctttctttgatttggcccataacgctataaattccattggctttctaaaaggcaatctttggttctttggaggtgtcattttctttgccatcattgctaatttcattccagaaccatcgcttggtccaacggcagacacgaaaaataaaaagaaacatggggatgaggggggcaaagatgtcatgaaaaagcatcgtcgtcaagttttgtttagtggaattattacagcagtaggcataagcttacacaatttcccagaaggaatggctgtttttcttggatcactcaagggtcttcgtgtgggccttaacttggccttagccatagctctgcacaatatcccagagggtgttgctgttgcacttcccgtttattttgcaacacagagcaaatggcaggcgtttaaactggcaacggtttctggccttgctgagcccttgggtgttattatcgtagcatatctcttcccaaagagcctagatccagagattcttgagggcttgctaggagcagtgggtggagttatggcgtttctaactcttcacgaaatgctgccgttagcatttgattatgctggacagaaacaagcagtcaaggccgtcttctttggaatggccttcatgtccgcaagcttgtattttctggagctcagtttaccgaaggacatggggttgtagatgctagtttcttcgatatttggaaagtgttgttacgacgacgatttgttcgactccaatggcaggatggtaacaagtagagaaagttaaaaggaagatgtacatatacatgataagctgctatattcttatttgtagtttacaaggcttatt

SEQ ID NO: 1644 - DNA, 1307 bp, Prunus persica
actatacaaaattgaaaattccctctctctccctctctgtatatatatttggctttgagttccccgatagcttaaaccatttcagcttcactgtttcattttactctctagctactcagtcatattccgtcacacttttttcaacggttcagccccacggattttggagctttttggtctttgaaaaaatccctccatggattcacaggtcttgatggctctggctctctcacttgtgggtggactgagtacttcaatcggtgcactttttgtagttctcaatgaggctcccaatttgaagatacttgggcttttacagggttttgctgcaggtttgatgctaagcatatcattcctagatttggctcacaatgctataaattctattggctttttaaaaggcaacctatggttttttggcggtgtcatattctttggtatcattgccaattttattccagaaccaacacttgctcctagttcagataaaagtggggatgaagggggcaaggacactttgaagaagcatcgccgccaagttctatacagtgggataattacagcaataggcataagtttacacaactttccagaaggaatggccgtgttccttggatcaatgaagggccttcgtgttggtgtcaacttggccttggccattgccttacacaacattccagagggcgtcgctgttgcacttcctgtttacttcgcaacacagagcaaatggcaggcattcaaattggcaacactttctggttttgctgagcctttgggtgtcataattgtagcctatctatttccaagcagcttgagtcctgatattcttgaaggcttgctgggagcagttggtggagtaatggcttttctaaccctgcatgagatgcttcccttggcgtttgattatgcggggcagaagcaagctgtcaaggccgtatttttgggaatggccttcatgtctgcaagcctctactttctcgaaatcagcctacctcaggagatgagcttgtagctgtgttccatcattccatggatcttaccccacagtaatttacattgttgtacaagtctactgactttagaccgccttcaatagatcatttcgtttctgcctgaagacctgtagtgattttaatcggcctttaatagctcatctggtttcggcgcaaaggagaaagtaataccccaaggatggtagttcatactcgatataaaagagatgtacttattttttccttttaataaatatgtaaaatgaatagtgtacggaacttgatttctttactgaacactctttcattttcctg

SEQ ID NO: 1645 - DNA, 1129 bp, Silene vulgaris
tattgtgtgatggattctcaggtgttggttgctcttgggctgtctcttgttggtggattgagcacttctttaggtgcacttcttgtggtactcagtaatgctccaaacttgaagatgcttgggctgttacagggctttgctgctggtctaatgcttagcatatcattctttgatttggctcacaatgccataaattcaataggctttttgaaaggcaatatctggtttttctcaggagtcatattctttgcattcattgcaaacttcatcccagagccaacacttgctcctactccagatgttaaaagcaagaagacaaacggacatgccaagggaaaggataccatgaaaaaacatcgccgccaggttatgtacagcggaatcattacagccataggaataagcttacacaactttccagaaggcatggctgtttttcttggatccataaagggccttcgagtgggactcaatttggctttggctattgctttgcacaacattccagagggtgttgcagttgcccttccagtatacttcgcaacacagagcaagtggcaagcatttaagctggcatcactctccggtttggctgagcccctaggggtgataattgtagcataccttttcccgagcagtctaaatcctgagattttggagggtcttcttggagcagttggtggagttatggcatttcttaccttgcatgagatgttgccgttggcatttgattatgctggtcagaaacaagctgtcaaggccgtattcttgggcatggcctttatgtccgcaagcttgtattttctggaaatcagcctaccggcagatatgagtttatagacgacccggtgatatatgataacaatctggacgagctaccggagacaaacacccttccaacctgacacttggcaacgacttccccctttatcgacacagtaatatagctggtagccttctacttacccgatgcactggagttcatatcaaagtacatttaaaactcttcttttttaatgtgaattactactccgtagtaggttattgtagccactgcacactattgaaaagcttaataaaattgtaaagcttttaatttcagcagtgaatctgatgtttaaagttcagg

SEQ ID NO: 1646 - DNA, 1237 bp, Ambrosia trifida
gtacgcggggggggtagtaaaattggaataacagtagttgtgacacaaggcaaccggattacctactgtcagcagtttcgtcacaatattattattatcatcatcatcatcattacaaaccctattaaaacctcattcaattcaacaccctttcatatacacactgtttctctattatatccaatctttattcatagaaattaaagatgaactcagaggtgttggttgtctctttccctctcattggttggtggcttaagcacatctttaggggcgctttttgtaatcttgactaaagctccaaacttgaagatgcttggacttttacagggttttgcggctggccttatgctaagcatatctttctttgacttggcccataacgctataaattccatcggctttctgaaaggcaatatttggttctttggaggtgtcgttttctttgccattgttgcgaactttattcctgaaccatcgcttgctcctacaatagaagcgaaaaataagaagaaacaagtggatgaagggggaaaagatatcatgaaaaaacatcgtcgtcaagttttatttagtggcattataacagcagttggcataagcttacacaactttccagaaggaatggctgttttcctcggatcactcaagggtcttcgtgttggccttaacttggctttagccatagcgttgcacaatatccctgagggtgttgcagttgcacttccggtgtattttgcaactcagagcaaatggcaggcgtttaaattggcaacggtttctggccttgctgagcctttgggtgtcattattgtagcatatctcttcccaagtagcctagatcctgaaattcttgagggcttgctgggagcagtcggtggagttatggcctttctaacactacatgaaatgctgccgttagcatttgattatgctggacagaaacaagctgttaaagccgtcttctttggaatggccttcatgtctgcaagcttgtattttctggagattagcttaccgtcggatgtaggcttgtagatgcgatcatgggaattcctttattcgacaagtgttcacttaaaaccgagatttacttttattcagctcccttggaaagattaaagggtaacaagtagagcaaggataaacaaaatgtacatacactgatacacatattctgctattcttatttgtacttcacatataatttcaggcttatttgaaaattatgttatgc

SEQ ID NO: 1647 - DNA, 1446 bp, Aristolochia fimbriata
gggggggatggtcagacgcttgattgttcccctgcgacacacaatcctttgcgtcgcattcacttcgggcgaatcagcagtcagtctctgctcgcttaattattctgcactacttctaacgcaatcgcttgccttctctcgactctccactctcgactcgcgctgttccttcgttcgaccctttccctccaaataaataaccgaagaacggtcggctgccctgcctcctccccggctgcttttcttttcccttcgtttcacaagtccccctgccttctttctgtattcattctgactttccgagttcaattacctgcaccgtgcttgtccactgtttcaatcttcgagtatctaagcattcatcgagtttgattactcgacgccaactctcatggattctcaactcatggttgctctcctgctctcccttgtcggtggcttgagcacgtcgataggtgcattctttgttatcataaatcctgctcccaatctgaagatgttggggcttttacagggctttgctgcagggctcatgcttagcatttcctttttcgatttggcacataatgctttgaatgctattgggttcttgaagggcaacctttggttctttgctggtgttatcgtctttgctcttattgcacattttatacctgaacctacacttgctccaagcaataaggctgtaaaaaagaagcagaaaaatgatgatggtactgggaaggatctgatgaaaaagcaccgtcggcaagttttatttagtggaattatcactgcaattggtataagtttgcacaattttccggaggggatggcagtgttccttggttccatcaaggggctgagggtaggtcttaacctggcttttgctattgccctacataacattccagagggtgttgctgtagcacttcctgtctattttgcaacagagagcaaatggcaggcatttaaactggccactctttctggtttcgctgagcccctaggtgtaattattgtagcttacctgtttccgagcagcctaagcactcagatacttgagggtttgcttgcctcagttggaggagtaatggcttttctcactttgcatgagatgcttcctcttgcatttgattatgcagggcaaaaacaagcggtgaaggctgtattcctaggcatggctttcatgtctgcgagtctttactttttggagattagcttgcccgaggagatgagcttgtagcttttggaatttctataatgcattccgcaggctctcaaagacccacctcagacgaaaagcaaaaactgcagatatttactgtggcaactcccaagaaactgaccgtgtaacatttgaaaaaggaagcctgttgcttctttattcataatatgtataatctcagtttcagttccttctgtagtagttccgacatccacatccattcaaaggaaaagctaatt

SEQ ID NO: 1648 - DNA, 1671 bp, Elaeis guineensis
aaaccgacgctcatttcttgccttcatccaatccttgtctcgctctcttcctctccggtttataatcgaacgtctgcttcgaggtctagggtttcttcgccgaaggggacaggtctcgatggatccccaggtcctcgtcgcccttgccctctccctcgtgggcggattgagcacttcaataggtgcactttttgtgattctaaatcatgctcccaatcttaagatgcttggacttttacagggttttgctgctggtcttatgctgagcatatcttttttagacttggcacataatgctctgaactctattggcttcttaaaaggcaacctttggttctttgcaggagttctattctttgctttcgttgtcagttttatccctgaaccaacagttgttgccagaacagatgaaaacaacagacagaaagatgacgatggatctggtaaagaccttatgagaaaacatcgtcgccaagtcttatttagtgggataatcactgcaattggcattagtttgcacaattttcctgaaggaatggcagtctttcttgggtcaataaagggtctgcgagttggccttaacctagctctggctattgctctacataatattccagagggtgttgctgtagctcttcctatctattttgctactgaaagcaaatggcaagcattcaaactagcaacactttctggttttgccgagccgctaggtgtgattattgtagcttacctctttcccagcagtttagatcctgagatacttgaaggcttacttggagcagttggtggagttatggcttttctgacattgcatgaaatgttacctctagcatttgactatgcgggtcagaaacaagcggtcaaagctgtcttccttggcatggctttcatgtctgcaagcttatatttcttagagatcagcttgccaaaggagatgagcttgtagctctggatggttcatgacttccaatcataatcaaacatgtcatgcaaattccaaaatccagacaggtccttcctatgttgctgccacatttaatatcatgtaccactgtcttttttatcacaaaatgtggttgccatcagtaaaatgagaagtccacctcttcttcagaaggaaaatttgtacattgtacactgattctattgtcatacttattcgcaaaacatggtccacattttcttacttttgctggcctacatctgatgaattgccatggtaaaagaagcagccagtctcaagttgaactgtgtaggaggctgctgatttacccagacgcatcagaacggatgaagagttgtgtcaagttctaaagccattgagttctctaatagactcatcagtcaaaaacagatcatgaaagagcacatcatctgttgagagagagattttaaaacttttcattcttcgtctctccatgcaccgtgacattctgtacatttgttcacaaaacgttggctcgtttgatgtcaaggcaacctgtccttggggttgtggctcttgtatattgcacctgtgcttgatgcattctaaatgttggttgtcaataataaaaatcacgtataattgtttgataaatgtatgtttagctgattgtatgataatcatctaaactttcactgggtgaagctttctgatgtcttggaaagagattgcaaataggtaat

SEQ ID NO: 1649 - DNA, 1088 bp, Ambrosia trifida
aacaccctttctatatatacactgtttctctattatatccaatctttattctaacgaattaaagatgaactcagaggtgttggttgtctctttccctcctcattggttggttggcttaagcacatctttaggggtcgctttttgtaatcttgactaaagctccaaacttgaagatgcttggacttttacagggtttcgctgcaggccttatgctaagcatatcttctttgacttggcccataacgctataaattccatcggctttctgaaaggcaatatttggttctttggaggtgtcatttctttgccatcgttgcgaactttattcctgaaccatcgcttgctcctacaatagaagcgaaaaataagaagaaacaagtggatgaagggggaaaagatatcatgaaaaaacatcgtcgccaagttttatttagtggcattataacagcagttggcataagcttacacaactttccagaaggaatggctgttttcctcggatcactcaagggtcttcgtgttggccttaacttggctttagccatagcattgcacaatatcccagagggcgttgcggttgcacttccagtatattttgcaactcagagcaaatggcaggcgtttaaattggcaacggtttctggccttgctgagcctttgggtgtcattattgtagcatatctcttcccaagtagcctagatcctgagattcttgagggcttgctgggatcagtcggtggagttatggcctttttaacactacatgaaatgctgccattagcatttgattatgctggacagaaacaagctgttaaagccgtctctttggaatggccttcatgtctgcaagcttgtattttcttggagattagcttgccgtcggatgtaggcttgtagatgtgatcatgcgtattcctttattcgataagtgttgacttaaaaccgagatttacttttattcagctcccttggaaagattaaagggtaacaagtagagcaaggataaacaaaatgtacatacacatattctgctattcttatttgtacttcacatataatttcaggcttatttgaaaattatgttatgc

SEQ ID NO: 1650 - DNA, 1060 bp, Flaveria ramosissima
agctactgattctctatatcctctgtttcttcgaagaatttgatgatggattcggaggtcttggttgctctttctctctcgcttgttgggggattaagtacatctttaggggcgctttttgtgattttgacaaaagctccaaacttgaagatgcttggacttctgcagggttttgctgcaggacttatgctaagcatatctttctttgatttggcccataacgctataaattccattggttttctgaaaggcaatatttggttctttggaggcgtcattttctttgccatcatcgcaattttattccggaaccatcacagctcctacaatagacactaaaataaaagaaacaagtagatgaagggggaaagatatcatgaaaaaacatcgtcgcaagttttatttagtggcattataacagcagttggcataagcttacacaattttccagaaggaatggctgtttccttggatcactcaagggtcttcgtgttggccttaacttggctctagccatagccttgcacaatatcccagagggtgttgctgttgcacttccagtttattttgcaacgcagagcaaatggcaggcgtttaaattggcgacggtttctggctttgctgagcctttgggtgtcatcattgtagcatatctcttcccaagtagcctagatcctgagattcttgagggcttgctaggatcagttggtggagttatggcctttttaacactacacgaaatgctgccgttagcatttgattatgctggacagaaacaagctgttaaagccgtcttctttggaatggccttcatgtctgcaagcttgtactttctggagattagcttaccctcggacgtcggcttgtagatgctaattcccttgttcaaaggcgtgttaatttaaaccgagaattactactatttagctcccttggcaagattaaagggtaacaagtagagcaaggataaacaaaatgtacatacacatgtgctgtattcttatttgtactttttataaaacttcaggctcatttgaaattgatgttatgccttttggat

SEQ ID NO: 1651 - DNA, 1182 bp, Papaver somniferum
agagagcagagctacacttgtttctcttctcgtcctcatccttcaattcggcagatccactgggtcggagtttgtagattgttggaaaaatggatcaacaggtgttgattgctcttgctctttctatgcttggtggattgagtacttcgttaggtgcgcttgttgtgatccttaatgatgcccccaatttgaagatgcttgggcttttacaggggtttgccgcgggtcttatgctgagtatttcgtttcttgatttggcgcataatgcgataaattcgattggtttcttgaaaggaaatgtttggtttttcggtggtgttattttctttgcgattgtgtctagttttattccggaacctactcttgctccggctgtggattcaaaaagcaaaaagaagggtggtgatgcagggggtaaagatacgttgaaaaagcatcgccgacaagttctgttcagtgggattattactgcgattggtattagcttgcataatttccctgaaggaatggcggtcttccttggatcaatgaagggacttcgagttggtatcaacttggcttttgctattgctttgcataacattcctgagggtgttgctgttgcacttcctgtctattttgcaacacagagcaaatggcaagcattcaagctggcaactctttctggtcttgccgagccccttggtgtgattattgtagcttatctatttccaagcagtctaaaccctgaaattctcgagggattgctaggaggagttggtggagttatggcttttctgacgttacatgaaatgctccccttggcgtttgattatgcaggtccaaagcaagctgtcaaggctgtatttttgggaatggcttttatgtctgcaagcctgtatttccttgagatcagcttgcccaaggatataagcttgtaaagatgcacagactcttcgttgactgattagcactcaactgactagagttaattatgagccatattcatgtatatctcattctgcgtactgctgttaatccgaattgatgttataaattttaaggctataataggcttgtaaatttgactgcagttctctttatattgcttcagtaatttccattcatcctgtaaatttgttacaacttttaagctctgaaatttggattttgcactttggcaagatttgctaaaaaaaaaaa

SEQ ID NO: 1652 - DNA, 1325 bp, Amborella trichopoda
acgctttctcagtgctctctggtactaacatttgcatcaccttctctttctattaaagcttttcgagggttttccatttcctctggttctaggggtttggagggtttctgcttgtgtgttttggggttctcttagcgttccgaggagccatggatccccaggtgatggttgctcttgctctatcgcttgttggtggattgagcacttctattggtgcattttttgttattctgaatcctgctcccaacttgaagatgctggggcttctgcaaggatttgctgctggccttatgctgagcatttcattcttagacttggcacataatgccatgaattctattggcttcttaaaaggaaacctttggttctatgcaggtgtaatcttgtttggactggttgccaacttcataccagaaccaacactggtgcccaaaaaagatgccgctaaacctgatgatggagcaggtaaagacatgatgaagaagcatcgccgccaggttttatatagtggaatcgtcacagccattggcataagcttgcacaattttcccgagggaatggctgtctttcttggatcaatcaagggacttcgggttgggcttaatttggcgttggctattgctttgcataatattccagagggtgttgctgtggctcttcctgtctattttgcaacagaaagcaaatggcaggcttttaaattggcaacactttctggtttcgccgaacctctgggggtgattcttgtggcttacctattcccaagcaaattatcccctgaaatcctggaaggcctacttggatcagttggaggagtgatggcttttcttacactacatgaaatgctgcctcttgcattcgactatgctggccaaaagcaagccgtcaaggccgtcttcttaggcatggctgcaatgtctgcaagtctttatttcttggagatcagcttgcccaaggagatgagcttgtagctgttgacctttgcgtagccatgtaactgtaattgatcatttcaattctctgacctcatttatgtacagctacatttgatgccaataaaacgtctctgggtagatatatcttatttttgttggctcaatttgaggttctatagatggcattctgcaaatccaaaccctaacatagaagcaaaaattgacctgctgttcgcctaggttgccaccctgacttgcctacggagcagagtgcccactgaggtctaggcaggccttcttaggcgtttgaggcaggtgcctagggtttaggcctaggcacccgcctagtttgccccttgccatagggcataaaatatctcgagtaaggag

SEQ ID NO: 1653 - DNA, 1214 bp, Populus trichocarpa
gtaaggaaaccgtacttccttgaacatttcatgttcctttctctcaaaccatccctttctttctcctctttatattcttttcctctaagcacaatcattccttcagtggagtggttatataaactagctctaaacagtacttgggtcattgtcatatacagaaaagaagcatttctttcaatggattctcaggtcatggtagctttggctctgtctcttgtgggtggattaagcacttctataggtgcactcttcgtaattctttgtcagactcccaatttgaagatgcttgggttattacagggttttgctgcaggcctgatgctgtgcatatcattccttgatcttgctcataatgctatcaattcaattggattcttaaaaggcaacctctggttttttggaggtgttgtattctttggtatcatcgccaattttatcccagagccaacacttacctcaagcttagatgttaaaagtaaaaagaaaaatggtgaccaagggggaaaggagattttgaaaaagcagcgtcgccaagttttgttcagtggcattatcactgcaataggaataagcttgcataacttcccagagggaatggcagtgttccttggatcaatgaagggcctccgtgttggtattaatttggctgtggcaattgctttgcacaacattccagagggtgttgctgttgcacttcctatttattttgcaacacagagcaagtggcaggcattcaaattagctacactttgtggtttggctgagccacttggtgtggtgcttgttgcttatctattcccaagcagcttgagtcctgaaattcttgagggtttgctgggatcagttggtggagtgatggctttcctcaccttgcatgaaatgctgccactggcatttgattatgctggtcagaaacaagctgttaaggccgtattctttggtatggctttcatgtctgcaagcctgtattttcttgaaatcagcctacctgatgagatgagcttgtagctatggatcagccaaatcaacctacataacaatttgtacattcccaaactagagcactaggccatcttgcatggtgcccgcttaatctcgccttgacatcctataattcgacctcatcagcaggtcaaacaggcagcattatacttacaggagattacagcagtttccatccttaatcaataactcaaaattgtactaacctt

SEQ ID NO: 1654 - DNA, 1494 bp, Oryza sativa
gcatgtgattagcaaaagacgccgtactctctctctcatcaaactgctgacgtacgcacgccgtgagacgccgccgcagcaaaagcttcccttcccccatctccctctcctctcctctcctccccgcctccccccgcctcgataccctgcaagccctagctctctctcgccgccaatggagtcgcaggtgctggtggcgctcgccctctcgctcgtcggcggcctcagcacgtccatcggtgcgctgtttgtgattttgaatccgacgcctaatcttaagatgcttgggcttctacagggttttgccgctggacttatgttgagcatttcctttctagatttggcacacaatgcattgaattctattggtttcttgaagggcaacctttggttttttgctggagttcttttctttggtttggttgtcaagtttattccagagccaactgttgtgccaacagctgatgcaggcaagaagcagactgacgatgatggttcgggtaaagatatgatgaaaaaacatcgtcggcaagtattattcagtgggatcattactgctgttggaatcagcttgcataactttccggaggggatggcagtatttttgggatccatgaagggccttcgtgtgggactgaacttggctattgctattgctttacacaatataccagagggggttgctgtagctctaccactctattttgctaccaacagcaaatggcaagcatttaaagttgcaaccctctctggtttcgctgagccactaggagtgatcattgttgcttacttgtttccgagcagcttaaatcctgaagttcttgaaggcctacttggttcagttggtggggttatggccttcctcactttgcatgaaatgttacctctagcatttgactatgctggtcaaaaacaggctgtcaaagcagtctttgttggcatggccttcatgtctgcaagcttgtatttcttggagatcagcctgccaaaggaagtgagcttgtagcacatgactatccatacaagcttgtcacactatcctctgaactgaagcggagaacttaggagagatgttaactttctgagcactgccaggcagggatgtggggatatatggttcgccatttatcaaacggaaacaaggatttgtgacttagattcgcgcgttggccatgtgtatgctatcacagctggtcattgtatttgaccattttacagtgaagatgaacagtctgggatgggtggcaaaacaccacccagaatcagaatgtaacctccgcttgttggggaggaataggacacaacttgaactagcagactgatcagatcagtcctttaacttgaccagtgtacattggttgaaggcactgtgagaaaaataaaaataaaaatgcttcgttttcactgtcaagaactgtctttggtttgaacctttggccagacatgagtgaattatatagttccagaaaccttgatggtaatatatcataatcc

SEQ ID NO: 1655 - DNA, 1343 bp, Oryza sativa
cgccgcagcaaaagcttcccttcccccatctccctctcctctcctctcctccccgcctccccccgcctcgataccctgcaagccctagctctctctcgccgccaatggagtcgcaggtgctggtggcgctcgccctctcgctcgtcggcggcctcagcacgtccatcggtgcgctgtttgtgattttgaatccgacgcctaatcttaagatgcttgggcttctacagggttttgccgctggacttatgttgagcatttcctttctagatttggcacacaatgcattgaattctattggtttcttgaagggcaacctttggttttttgctggagttcttttctttggtttggttgtcaagtttattccagagccaactgttgtgccaacagctgatgcaggcaagaagcagactgacgatgatggttcgggtaaagatatgatgaaaaaacatcgtcggcaagtattattcagtgggatcattactgctgttggaatcagcttgcataactttccggaggggatggcagtatttttgggatccatgaagggccttcgtgtgggactgaacttggctattgctattgctttacacaatataccagagggggttgctgtagctctaccactctattttgctaccaacagcaaatggcaagcatttaaagttgcaaccctctctggtttcgctgagccactaggagtgatcattgttgcttacttgtttccgagcagcttaaatcctgaagttcttgaaggcctacttggttcagttggtggggttatggccttcctcactttgcatgaaatgttacctctagcatttgactatgctggtcaaaaacaggctgtcaaagcagtctttgttggcatggccttcatgtctgcaagcttgtatttcttggagatcagcctgccaaaggaagtgagcttgtagcacatgactatccatacaagcttgtcacactatcctctgaactgaagcggagaacttaggagagatgttaactttctgagcactgccaggcagggatgtggggatatatggttcgccatttatcaaacggaaacaaggatttgtgacttagattcgcgcgttggccatgtgtatgctatcacagctggtcattgtatttgaccattttacagtgaagatgaacagtctgggatgggtggcaaaacaccacccagaatcagaatgtaacctccgcttgttggggaggaataggacacaacttgaactagcagactgatcagatcagtcctttaacttgaccagtgtacattggttgaaggcactgtgagaaaaataaaaataaaaatgcttcgttttcactgtcaagaa

SEQ ID NO: 1656 - DNA, 1222 bp, Eutrema parvulum
aggttaggtagaaaacgagaaagcacgcaaggatcaggctcaatatgctcacttaggctaagaatttgaaagggaaaaccatggattagggttttgcgtctcatcaattaactctcaaaactatctctttcttcgggtttagatattctccttgtcaccgtctttatatacacacatacatttttcgtcttctccatttctgaagccgactttggaatttacttgggaaaaaactttggttcgtcttctccatttgtgtttactactgaggagcgataataaggtcttttctgttcgaatccggccgataaatcgatggattcccagatgctcgtggcgcttggactatcccttgtgggtggattaagtacttctttaggtgcgcttttcgtagttctcagtgacactcccaatatgaagatgcttggactgctacagggttttgcggcaggtctgatgttgagcatatcgttcctggatttggctcataatgcaataaactctattgggttcttaaaaggcaatctctggtttttcggtggtgtgatattctttgcatgtattgccaaattcataccggaaccaacacttggtccttctactgacgtgaaaagaaggaagaaaaatggagacgagggtggtaaggacatggtgaagaagcatcgccggcaagtcttatatagtggaattgttacagctattggaataagcttgcacaattttccagaagggatggccgtatttctcggatcaattaagggcatgcgagttggtgttaatctggctttggcaatcgccttacacaacattcccgagggtgttgcggttgcacttcctatttattttgcaacagagagcaaatggcaggcattcaaattggcaacactctctggtttagctgagcctctaggtgtaattatcgtcgcttatctattcccgagcagcttgagtccagaaatccttgaaggcttgttgggagcagttggtggaatcatggctttcctaacgttgcacgaaatgcttcctttggcatttgattatgctggacagaaacaagctgtgaaggctgtgtttgtcggtatggcatgtatgtctgcaagtctttactttctggagataagtttgcctgagacaatgagcttgtaagttgaattatgtccatgtgtgcaataatttgcctcctcaaacagataaatcagtctctgtaaagacagtgaaatat

SEQ ID NO: 1657 - DNA, 1410 bp, Allium cepa
aaccccaaagaaaatctcgcttcatttttactctttcaatccaaagaggggtttaattgagtattctcaatcaaaccttatcaatggactctcaagttcttgtagctctcgctctctctttagttggtggattaagcacttcaatcggtgcacttattgtagttttgaatcccgcacccaatcttaagatgcttggtcttttacagggttttgccgctggcttaatgcttagcatatcatttttggatttggctcacaatgcgttaaactctattggtttcctgaagggaaatatctggttttatgcaggagtaatctgctttggtattatcgttaaatttattcctgagccaacgcctgttccagatacagatgtagataagagaaagaataaagatgatgagtcaggtaaagatctaatgaaaaaacatcgccgacaagttttatatagcggaattatcactgcagttggcataagcttgcacaactttccagaaggaatggcagtttttcttggttcgataaagggacttcgtgttggaattaatctagctctggctattgcactacataacataccagagggagttgctgtagcccttcctgtgtactttgccactcaaagcaatggaaggcgttcaaacttgctaccctatctggttttgcggaaccattaggtgtcatcattgtagcatatctttttccaagcaatctagatcctgaaattcttgaaggtttacttggagcagttggtggagttatggcttttcttactttgcatgaaatgctacctctggcattcgattatgctggccaaaaacaagcagtcaaagcagtttttcttggaatggctttcatgtctgcaagcttgtactttctagaaatcagcttaccagcagagatgagcttgtaatacgaggttctatcaattgttatatcagcaatacatgatgcatacatccagatactaggcgaaattctgtagttccagggaagatgttgtaatttgtaccgatttttaaatataatatattgggtttatttttccagtaaagtttgccaatctataaaatttcctttgcctaccatgcttcaattttataccttctcagctttatatatcatgcacatgagtgagcagatatctcttttgagcgaagaccgatggttcttggtaattttgtgttaaatattcatttatttctatttgtctacgaatatacatcttatatattatctttaatggaagcatttcgagcttttatcatcattgtgcagcctagcacaacctggtaggtgtgctttacaatgaaatatgcaaggtatgaattttgcgattttttccagagtggtttgtttgatttttatggagtcctatacgaaaaaataggttttccacaatacccttac

SEQ ID NO: 1658 - DNA, 873 bp, Mimulus guttatus
atgggttttacggactccccggttttggttgctcttgctctttcacttcttggtggtgtcagcacctccattggtgcccttttcgttgtcatgaacgagactccaaatttaaagatgcttgggcttctacagggttttgccgcaggtcttatgctgagcatatccttctttgatttggctcataatgccattaactccatcggcttcttaaaggggaacctttggttttttgcaggcgtacttttctttgcaattatcgcctattttatcccggaaccgactatagctccaattaatgatagcaaaaagaaaaccggggatgatggaggaaaggatatgatgaaaaagcaccgaaaacaagtattgtatagcggaatcatcacagccatcggcataagcttgcacaattttcccgagggaatggctgtgttccttggatcaatgaagggtctgcgagttggtctgaacctggcactggctattgcactacacaacgtacctgagggggttgctgttgcacttcctgtttattttgccacacaaagcaaatggcaagcattcaagttggctaccctttctggtctggccgagcccctcggtgtaattatcgtggcttacctatttcccagcagtgtaagccctgaaatcctagaaggccttctaggagcagttggaggtgtgatggcttttctaacgttgcatgaaatgctgccgctggcattcgattacgcgggacaaaaacaagccgtgaaagctgtattcttcggcatggctttcatgtctgctagcttgtactttcttgagatcagcttaccagcagatttgagtttgtagccaccacaatatatacatagattctggaggctgcagcca

SEQ ID NO: 1659 - DNA, 1468 bp, Beta vulgaris
ctctatttgattcctcctaaaaatttgcctttttgtaaacctatgattcactattattcagttacttttatgtgtttttcaccctttataacattttcctctcttatacagggtttttggggttttaacgttcatccctctttccaaaattcagacccacttcttaatttcctcttaaatcaatctaatttttaagggtaactgaaattaattgtgcaaactaaaaattagtttctgggtaatctgcaaaattgggtttttattgttgaaacaaaacttgttgttgttgttgttgctgttgctttagctatggattctcaagtgttggttgctctagcgctctcacttgttggtgggttgagcacatctttaggtgcactttttgtggtccttagtgatgcgccaaacttgaagatgctcgggcttttacagggcttcgctgcgggtcttatgcttagcatatcatttctagatctggctcacaatgccataaatgctattggcttcttgaaaggaaacatatggttctttgcaggtgttatcttctttgcacttatttccaacttcattccagaaccaacgctcgctcctagtccaaatgttaaaagcaaaaagcggactaatggagaaaataagcaaaaggacctaatgaagaagcatcggcgccaagttttgtacagtggcataataacagccgtaggtataagcttacacaattttccagagggaatggcagtttttcttggatcgataaagggccttcgggtgggacttaatctggctttggctattgctttgcacaacattcctgagggtgttgctgttgctcttccagtttactttgctacacaaagcaagtggcaagcatttaagatagcatcgctctctggtcttgcagagcccttgggtgttattattgtagcttatctgttcccaagcagtttaaatcctgagattcttgagggccttctaggagcagttggtggagtgatggctttcctaaccttacatgagatgttgcctttggcgtttgattatgctggtcagaaacaagctgtcaaggctgttttcctcggcatggcctttatgtcagcaagcctgtattttttggaaatcagcttgccagcagagatgagtttatagctgaagcattcacttgggtagatgagaacatagcaacagttgtacattgctctgcacagtttctctcgctctatgtctctctcatcagtcgaggaccaccgtcatcttcaaacttccgtcttcaccacccgttacattacatgaagtgaagtctgcaaccttcggaatccatggaagtgtatctaatcaaacttaaattagaagaaaaagaagggaatgtgaataattgttgttaggttgtaaccattgaacattattggaaaaccttattatcctcttgaaagttgatatctggtgtttgtggttgatttttgatgtgtcatgc

SEQ ID NO: 1660 - DNA, 1150 bp, Papaver somniferum
cttcttctcgtcctcctcctccaattcggcagatccactgggtcggagtttgtagattgttgaaaaaaaatggatcaacaggtgttgattgctcttgctctgtccatgcttggaggattgagtacttccttaggtgcgcttgttgtgattcttaatgatgctcccaatttgaagatgcttgggcttttacaagggtttgctgctggtcttatgctgagtatttcgtttcttgatttggcgcataatgcgataaattcgatcggtttcttgaaagggaatgttggtttttcggaggtgttatcttctttgcgattgtttctagttttattcctgaacctactcttgctccggctgtggatggtaagagcaaaaagaagagtggtgatgcagggggtaaagatatgttgaacaaacatcgccgacaagttctgttcagtgggattattactgcgattggtataagcttgcataatttccctgaaggaatggcggtcttccttggatcaatgaagggacttcgagttggtattaacttggctttcgctattgctttgcataacattcctgagggtgttgctgttgcactccctgtctattttgcaacacagagcaaatggcaagcattcaagctggcaacgctttctggtcttgccgagccccttggtgtgataattgtggcttatctattcccaagcagtctaaaccctgaaattctcgagggattgctaggaggagttggaggagtgatggcttttctgacactacatgaaatgcttcccttagcgttcggttatgcaggtccaaagcaagctgtcaaggctgtgtttctgggaatggcttttatgtctgcaagcctttatttccttgagatcagcttgcccaaggatataagcttgtaaagatgcacagaatcttcgttgactgattagcactcaactgactaaagttaattatgagccatacacatgtatatctcattctgcgtactgctgttatctgaattgatattataaaattttaaggctataataggcttgtaaattcggctgcagttctctttagattgcttcagtatttccgttcatcctgtaaatttgttaaaactacttttaagctctgaaatttggattttgcactttcgcatgattta

SEQ ID NO: 1661 - DNA, 932 bp, Cirsium arvense
ttttggttgctctttctctctccatggttggtggattaagtacatctttaggtgcactttttgttgtactgagtaaagctccaaacttgaagatgcttggacttctgcagggttttgctgcaggtcttatgctaagcatatctttctttgatttggcccataacgctataaattccattggctttctaaaaggcaatctttggttctttggaggtgtcattttctttgccatcattgctaatttcattccagaaccatcgcttggtccaacggcagacacgaaaaataaaaagaaacatggggatgaggggggcaaagatgtcatgaaaaagcatcgtcgtcaagttttgtttagtggaattattacagcagtaggcataagcttacacaatttcccagaaggaatggctgtttttcttggatcactcaagggtcttcgtgttggccttaacttggccttagccatcgctttgcacaatatcccagagggtgttgctgttgcacttcctgtttattttgcaacacagagcaaatggcaggcgtttaaactggcaacggtttctggccttgctgagcccttgggtgttattatcgtagcatatctcttcccaaagagcctagatccggagattcttgagggcttgctaggagcagtgggtggagttatggcgtttctaactcttcacgaaatgctgccgttagcatttgattatgctggacagaaacaagcagtcaaggccgtcttctttggaatggccttcatgtccgcaagcttgttattttctggagctcagtttaccgaaggacatggggttgtagatgctagtttcttcgatatttggaaagtgttgttatgacgacgatttgttcgactacaatggcaggatggtaacaagtagagaaagttaaaaaagaaaaaagtaccgactgcg

SEQ ID NO: 1662 - DNA, 1177 bp, Tripterygium wilfordii
acatgctcagccaagtccatgtatttataccttatggagcgccgatagagagattcctgtatatggtgctttggccgttgcgagagtcaattacagtccaattcaaaaccaatcctgcgaatctgcacggctttggttatagaaaatagaggattccatggcttcgccggtgatgctggctcttgctctctcgcttgtgggcggagttagtacttctataggtgcacttttggttgtggctaacccgactcccaatctaaagatgcttggtcttttacagggttttgctgcaggtctaatgctgagcatatcattcctggatttagctcataacgctatcaactcaatcggcttcttaaaaggaaacctttggttttttgctggcgttgtattctttgctctcattgcctatttcattccagaaccaatggtttctcagggttgggatctgaaaagtaagaaagacaaggatgatggagacaaggatgttatgaaaaagcatcgtcgccaagttttattcagtggaattattacggcagtaggcataagtttgcacaattttccagagggaatggcagtgttccttggatcaatgaagggcttgcgtgtgggcgttaatttggcaatagccattgctttgcacaatgtcccagagggtgttgctgtagcactgccagtctattttgcaacacaaagcaagtggcaagcattcaaattggcaacgctctctggttttgcagagcctctgggtgttatagttgttgcctatatttttccgagcagcttaagtcctgaaattctagaggggttgctaggatcagttggtggagtgatggctttcctaacattgcatgaaatgctgccattggcgtttgattatgcggggccgaagcaagctgtcaaggccgtgttccttggaatggctttcatgtccgctagtctttatttccttgaaatcagcttgcccgaggacatgagcttgtgatcatggatcagccatttggtataccataatgttgtacatttctacaccactgtaatgggctctaacatggtgcctgcttttgttacatggcactgaaaacctgtacaataattcacacaccatctagtgaaccttcaactgacatttgcctcagaagcaaataggtttcattcatgttttgaagcctagcag

SEQ ID NO: 1663 - DNA, 1196 bp, Phaseolus coccineus
atcttccttattattatggtcatggattctcaagtgctgctgggtgttgcactctcatctgtgggtggtttcagcacttccatcggtgcccttttcgtaatccttagtaaagctccaagtttgaaggtgcttggactgttacagggttttgctgctggtttgatgctgagtatatcattctttgatctcactcataatgccttgaactcacttggcttccttaagggcaacctttggttctttgctggtgtcatattctttgctgttgttgccaaattcataccagagccaacacctgttcctcccatttcaaatgagaagagtaggaagaaagttgggaatgaaggaaacaaagacattatgaaaaggcgtcgccgtcaagttttactcagtggtgttatcacagccataggtataagtctgcataattttccagaaggaatggcagtgtaccttggatccatgaagggagttcgtgttggtcttaaccttgccctggccattgcactgcacaacatcccagagggtgttgctgttgcacttcctgtctattttgcgacagaaagtaaatgggaggcattcaaattggcatcactttccggctttgctgagcccctgggtgttataattgtagcctgtttattccctaccagtctaaatcctgagattcttgaaggtatccttggatcagttggtggagttatggcgtttctaacccttcacgaaatgctaccactggcttttgagtatgcaggacaaaaacaatctgttaaggccgttttttgtgggatggctttcatgtctgcaagcttgtattttctacgtaggagcttaccagaggacatgtagctgggaacagtctctttcttttctgaatgagatgcatttcaaagtaccattatgcactgtcttcttgctgctgtcatctgcaagatgtcttcagaggtgaaactcgaaaatttccaataacattaatgtacagcaggaagatagcagttgaacatgaagcagataagatccattcatctgcaatcatggttcccctgtatacataagtacaaacaaaagcaacttgcaattaatgttcttctgttatcttaaatttcatgatttgtgttctttatttactactagttcttggacttgtacaacacaccacgcaatttcgttggaaaaaaagtcactttgcatcctct

SEQ ID NO: 1664 - DNA, 1099 bp, Papaver somniferum
tgagagagagcagagctacacttgtttctcttctcgtcctcatccttcaattcggcagatccactgggtcggagtttgtagattgttggaaaaatggatcaacaggtgttgattgctcttgctctgtctatgcttggtggattgagtacttcgttaggtgcgcttgttgtgattctcaatgatgctcccaatttgaagatgcttgggcttttacaagggtttgctgcgggtcttatgctgagtatttcgtttcttgatttggcgcataatgcgataaattcgattggtttcttgaaaggaaatgtttggtttttcggtggtgttattttctttgcgattgtttctagttttattccggaacctactcttgctccggctgtagattctaaaagcaaaaagagggtggtgatgcaggggggtaaagacatgttgaaaaagcatcgccgacaagttctgttcagtgggattattactgcgattggtataagcttgcataatttccccgaaggaatggcggtcttccttggatcaatgaagggacttcgagttggtattaacttggcttttgctattgctttgcataacattcctgagggcgttgctgttgcacttcccgtctattttgcaacacagagcaaatggcaagcattcaagctggcaacactttctggtcttgcggagcctcttggtgtgattatcgtagcttatctgttcccaagcagtctaaaccctgaaattctcgagggattgctaggaggagttggtggagtgatggcttttctgacgttacacgaaatgctccccttggcgttcgattatgcaggaccaaagcaagctgtcaaggctgtatttctgggaatggctttcatgtctgcaagcctgtatttccttgagatcagcttgcccaaggatataagcttgtaaagatgcacagaatcttcgttgactgattagcactcaactgactaaagttagttatgagccatacccatgtatatctcattctgcttactgctgttatctgagttgatatcataaaatttaaggctataaatggcttgtaaattcgactgcagttctctttatattgcttcagtat

SEQ ID NO: 1665 - DNA, 1036 bp, Glycine max
cgtcatggattcgcaggtgttgcttggtgttgcactttcatccgtgggtggtttcagcacttccatcggtgcacttttcgtaatccttagtaaagctccaagtttgaaggtgcttggactgttacagggttttgctgctggtttgatgctgagtatatcattctttgatctgactcataatgccttgaactcacttggcttcctgagaggcaacctttggttttttgctggtgtcatattctttgctgttgttgccaaatttataccagaaccaacagttgctcctccaacttcagatgaaaagaaagttgggaaacaaggaaacaaagacatcatgaaaaggcgtcgccgtcaagttttaatcagtggagttgttacagccataggtataagtttgcataattttccagaaggaatggcagtgtaccttggatccatgaagggcattcgtgttggtcttaaccttgccctggccattgctctgcacaatatcccagagggcgttgctgttgcccttcctgtctattttgcgacacagagcaaatgggaggcattcaaattggcatcactttctggctttgctgagccactgggcgttgtaattgtagcctgtttattccctactagcctaaatcctgagattcttgaaggtatccttggatcagttggtggagttatggcttttctaacccttcatgagatgctgccacttgcttttgagtatgcgggacaaaaacaatctgttaaggccgtcttttgtggaatggctttcatgtctgcaagcttgtattttctacgtatcagcttaccagaggacatgtagatgggaactatctcttgcgtttctgaatgagatgcgtaaaacatgaaacttgcaaatttgcaattacattaatgtacaatagtcaatagaggataacagtaaaacatgaaggttggattcatttcacctgtgtaactagggtttccccctgtataagtatgtacaaacaaaaggaacttacagttaaatgttgttatgttatctataaatttc

SEQ ID NO: 1666 - DNA, 1106 bp, Cucurbita pepo
tcgctcattctaccagtcactcgcctctctcactcgtccgcctaataccctttcgacattcgtcctgttcttagctttctttcgccattttctttcaatttggaagcgataaagaccctccaatcttttcggggggtttcttgctgttcttatcgacgcctttgaattgggcgtacgacccaagaaggcatcgatggcttctcaggtgttggtagctcttgcactttcgcttgttggtggattcagtacttctctaggtgcacttttggtgattcttagcggtgccccaaatctgaagatgctcggtctcttacagggctttgctgctggtttaatgctgagcatttcgttcctggatttagctcataatgctattaattcattgggttcttgaaggaatctttggtttttgcaggtgtgatctcgtttgcttttgttactcattttgtcccagaacccacacttgctcctggttcagatatcaaaagaaacaaggacgaggatgatgggggaaaggatgttatgaaaaagcatcgtcgtcaggttctattcagtggcataataacagcaataggcataagcttacataactttccagaaggaatggctgttttcttggatcgattaagggtcttcgtgttggtctgaacttagccttagccattgccttgcacaatataccagagggtgtagctgttgcgcttcctgtttattttgctacacagagcaaatggcaggcattcaagttggctactctctctggctttgctgagccccttggtgttataattgtagcctacttgtttccaagcagcttgagtcctgaaattcttgaaggtctactaggatctgttggtggagtaatggcgttcctaactctgcatgaaatgttacctttggcatttgattatgctggaccgaagcaagccgtgaaggtcgtcttcttaggaatggcctgtatgtccgcaagcctttatttctggaatgagcctgccgaaggatttgagcttatagtatagcttgtgttccctgtcatttcattgttgtaaatgacaaatataaactctttagctcatcagaaagtgaaaaatgaatatgcgtgttga

SEQ ID NO: 1667 - DNA, 1190 bp, Brassica juncea
agaatctgcgcagagataagctatggattagggtttccatcgattaacccccaattcaaatctcttccttggtcttcagagattctcctccttctccgtctttatatacacacacattcctcgtctttgtgtgtggttgttatcttatcttctgagtagctgcgacaagaaggtctttttccttttcgattccgtgcagataaaatcgatggattcccagatgctcgtggcgcttggtctatcccttgtgggtggattaagtacttctttaggtgcacttttcgtagttcttagtgagactcccaatatgaagatgcttggacttctacagggttttgcggctggtctgatgttgagcatatccttccttgatttggctcataatgctataaactctattggcttcttgaaaggaaatctctggtttttcggtggtgtgatattctttgcgtgtattgccaaattcataccggaaccaacccttggtccttctactgacgtgaaaagaagaaagaaaaatggagacgagggaggtaaggacatggcaaagaagcatcgacggcaagtgttatatagtggaattgttacagctattggaataagcttgcacaattttccagaggggatggccgtatttctcggatcaattaagggcatgcgagttggtgttaatctggctttggcaatcgctctacataacattcccgagggtgttgcagttgcacttcctatatactttgcaacagagagcaaatggcaggcattcaaattggcaacactctctggtttagctgagcctctaggtgtaatcatcgtggcttatctattcccgagcagcttgagtcctgaaatccttgaaggcttgttgggagcagttggtggaatcatggctttcctaactttgcacgaaatgcttcctttggcatttgattatgctggacagaagcaagctgtaaaggctgtgtttgtcggtatggcttgtatgtctgcaagtctttactttctggagctgagtttacctgagtcaatgggttagtcagtttagttatgtcattgtcatgtgtgcaataattgcctcctcaaagacagaacaagtctgtggagtatagtctctttgtatctgtgaaatcaataggatctgtaacaattgagtattcatttttaattcaaagtaataatctcttttaaca

SEQ ID NO: 1668 - DNA, 1223 bp, Brassica juncea
gcaggcattatatgctctctcactcactcagactaagaatctgcaggacaaaagctatggattagggtttccatcgattaacccccaattcaaatctcttccttggtcttcagagattctcctccttctccgtctttatatacacacacattcctcgtctttgtgtgtggttgttatcttatcttctgagtagctgcgacaagaaggtctttttccttttcgattccgtgcagataaaatcgatggattcccagatgctcgtggcgcttggtctatcccttgtgggtggattaagtacttctttaggtgcacttttcgtagttcttagtgagactcccaatatgaagatgcttggacttctacagggttttgcggctggtctgatgttgagcatatccttccttgatttggctcataatgctataaactctattggcttcttgaaaggaaatctctggtttttcggtggtgtgatattctttgcgtgtattgccaaattcataccggaaccaacacttggtccttctactgacgtgaaaagaagaaagaaaaatggagacgagggaggtaaggacatggcgaagaagcatcgccggcaagtgttatatagtggaattgttacagctattggaataagcttgcacaattttccagaaggtatggccgtatttctcggatcaattaagggcatgcgagttggtgttaatctggctttggcaatcgctctacataacattcccgagggtgttgcagttgcacttcctatatattttgcaacagagagcaaatggcaggcattcaaattggcaacactctctggtttagctgagcctctaggtgtaattatcgtggcttatctattcccgagcagcttgagtcctgaaatccttgaaggcttgttgggagcagttggtggaatcatggcattcctaactttgcacgaaatgcttcctttggcatttgattatgctggacagaaacaagctgtaaaagctgtgtttgtcggtatggcttgtatgtctgcaagtctttactttctggagctgagtttacctgagtcaatgggttagtcagtttagttatgtcattgtcatgtgtgcaataattgcctcctcaaagacagaaacaagtctgtggagtatagtctctttgtatctgtgaaatcaataggatctgtaacaattgagtattcatttttaattcaaagtaataatctcttttaa

SEQ ID NO: 1669 - DNA, 1336 bp, Brassica napus
gagaagcacgcaggcatattatgctctcactcacttaggctaagaatctgcgcagagataagctatggattagggtttccatcgattaacccccaaatacaatctcttccttgggattcagagattctcatcgtctccatctttatatacacacatacacattcgtccgtctttgcgtgtttttgttatcttctgagtagctgcgacaacaagaaggtctttccttttcgattcccttcagattaaatcgatggattcgcagatgctcgtggcgcttggactgtcccttgtgggtggattaagtacttctttaggtgcgcttttcgtagttctcagtgagactcccaatatgaagatgcttggacttctgcagggttttgcggcaggtctgatgttgagcatatcgttcctggatttggctcataatgctataaactctattggcttcttgaaaggcaatctctggtttttcggtggtgtgatattctttgcgtgtattgccaaattcataccggaaccaacacttggtccttctactgacgtgaaaagaagaaagaagaatggagacgagggaggtaaggacatggcaaagaagcatcgacggcaagtgttatatagtggaattgttacagctattggaataagcttgcacaattttccagaggggatggccgtatttctcggatcaattaagggcatgcgagttggtgttaatctggctttggcaatcgctttacacaacattcctgagggtgtggcggttgcacttcctatatactttgcaacagagagcaaatggcaggcattcaaattggcaacactctctggtttagctgagcctctaggtgtaattatcgtggcttatctgttcccgagcagcttgagtcctgaaatccttgaaggcttgttgggagcagttggtggaatcatggctttcctaactttgcacgaaatgcttcctttggcatttgattatgctggacagaagcaagctgttaaggctgtgtttgtcggtatggcttgtatgtctgcaagtctttactttctggagctgagtttacctgagtcaatgggttagtcagtttagttatgtcatgtgtgcaataattgcctcctcaaagacagaaacaagtctgtggagtatagtctctttgtatctgtgaaatcaataggatcagtaacaattgagtattcatttttaattcaaagtaataatctcttttaacatcttatttaacagtaatctttgccaatctctcgcaaaatgtcactgtaaatccatgtgatcatctatggacaaagatgcttttgcaaaaataaaaggtgtatttatagc

SEQ ID NO: 1670 - DNA, 1286 bp, Brassica napus
ggaggaggaaaggttaggtagaaaacgagaagcacgcaggcataatatgctctcactcacttaggctaagaatctgcgcagagataagctatggattagggtttccatcgattaaccaatctcttccttgggcttcagagattctcctcctctccctctttatatacacacacatacacattcttcgtctttgtgtgtttgaaatcatctgagtaactgcgacaacaagaaggtctttctttttcgattcccttcagattaaatcgatggattcgcagatgctcgtggcgcttggactgtcccttgtgggtggattaagtacttctttaggtgcgcttttcgtagttcttagtgagactcccaatatgaagatgcttggacttctgcaaggttttgcggcaggtctgatgttgagcatatccttcctggatttggctcataatgctataaactctattggcttcttgaaaggcaatctctggtttttcggtggtgtgatattctttgcgtgtattgccaaattcataccggaaccaacacttggtccttctactgacgtgaaaagaagaaagaaaaatggagacgagggaggtaaggacatggcgaagaagcatcgccggcaagtcttatatagtggaattgttacagctattggaataagcttgcacaattttccagaggggatggccgtatttctcggatcaattaagggcatgcgagttggtgttaatctggctttggcaatcgctttacacaacattcctgagggtgtggcggttgcacttcctatatactttgcaacagagagcaaatggcaggcattcaaattggcaacactctctggtttagctgagcctctaggtgtaattatcgtggcttatctattcccgagcagcttgagtcctgaaatccttgaaggcttgttgggagcagttggtggaatcatggctttcctaactttgcacgaaatgcttcctttggcatttgattatgctggacagaagcaagctgtaaaggctgtgtttgtcggtatggcttgtatgtctgccagtctttactttctggagctgagtttacctgagtcaatgggttagtcagtttagttgtcatgtgcaataattgcctcctcaaagacagaaacaagtctgtggagtatagtctctttgtatctgtgaaatcaataggatctgtaacaattgagtattcatttttaattcaaagtaataatctcttttaacatcttatttaacagtaatctttgccaatctctcgcaaaatgtcactgt

SEQ ID NO: 1671 - DNA, 1140 bp, Brassica napus
gcacgcaggcataatatgctctcactcacttaggctaagaatctgcgcagagataagctatggattagggtttccatcgattaaccaatctcttccttgggcttcagagattctcctcctctccctctttatatacacattcttcgtctttgtgtgtttgttatcatctgagtaactgcgacaagaaggtctttccgtttcgattccgttcagattaaatcgatggattcgcagatgctcgtggcgcttggactgtcccttgtgggtggattaagtacttctttaggtgcgcttttcgtagttcttagtgagactcccaatatgaagatgcttggacttctgcagggttttgcggcaggtctgatgttgagcatatcgttcctggatttggctcataatgctataaactctattggcttcttgaaaggcaatctctggtttttcggtggtgtgatattctttgcgtgtattgccaaattcataccggaaccaacacttggtccttctactgacgtgaaaagaagaaagaaaaatggagacgagggaggtaaggacatggcgaagaagcatcgccggcaagtcttatatagtggaattgttacagctattggaataagcttacacaattttccagaagggatggccgtatttctcggatcaattaagggcatgcgagttggtgttaatctggctttggcaatcgctttacataacattccggagggtgttgcggttgcacttcctatatattttgcaacagagagcaaatggcaggcattcaaattggcaacactctctggtttagctgagcctctaggtgtaattatcgtggcttatctgttcccgagcagcttgagtcctgaaatccttgaaggcttgttgggagcagttggtggaatcatggctttcctaactttgcacgaaatgcttcctttggcatttgattatgctggacagaagcaagctgttaaggctgtgtttgtcggtatggcttgtatgtctgcaagtctttactttctggagctgagtttacctgagtcaatgggttagtcagtttagttatgtcatgtgtgcaataattgcctccttaaagacagaaacaagtctgtggagtatagtctctttgtatctgtgaaatca

SEQ ID NO: 1672 - DNA, 1330 bp, Phalaenopsis aphrodite
ctcgagaaaaaaatcattactgtaacaaaatgttagaatccgtagggtcaccagtccagatgttctgcagatgctctcttttctgaaactgggtgacgacattgctagcctctctctttcccttgtattcttaggctctaatccgaaacacgaactccctctccgaaaaccttaggtctctgatggattctcagatcctggtggccctgtccctttcactcgtgggtggcctcagtacatcggcaggtgcactactagtgattctaaaccctgctccaaaccttaagatgcttgggcttttgcagggttttgctgctggtcttatgttgagcatatcattctttgatttggcacataatgctctaaactcaataggctttttgagggcaaatctttggttctttgcaggagttgtgttttttgcctctattgtctctttcatcccagaaccaacaattactatagaagcaaataatatacagaaggatgatgatggatcaggcaaagatttgatgaagaaacatcgacggaacgtactatttagcggaattataactgcagtgggaatcagcttgcataattttcctgagggaatggcagttttcctgggatcgataaagggacttcgtgttggccttaatttagctttggctattgctttgcacaatattcctgagggcgttgcagttgcccttcctgtgtattttgccactcaaagcaaatggaaggcatttaaattggcatctctttctggccttgcggaacctctgggtgtgattattgtagcctacctcttccctagtagtctagatcctgatattcttgaaggtctacttggatcagttggaggagtgatggctttcctcactctgcacgaaatgttacctctagctttcgactatgctggtcagaaaaaggctgttaaagctgtctttgttggcatggcgttcatgtctgcaagcttgtactttcttgagatcagtttaccgaaggagctgagcttgtagtcttggagatcgactggaactgattttgttctgtaatatataattcatagttttacaggttaattctatctttacacgtagcatcctcttgaatagaaatttctttatatattgcttgttctgtcatttatgcataaaacctgttttttccaacgtgcagctaaacattacttatgacagagccgttctttttttcaatttcctcaaaatgcttcagatatttcgttgtatttactggctactggaaaattttcacttttcattggaagaaaaacatcaattaccaattttttccttgaacttaggacaacctggtttgattt

SEQ ID NO: 1673 - DNA, 1259 bp, Brassica rapa
gaggcaaaggagaaagaagatgaggagaggaaaggttaggtagaaaacgagaagcacgcaggcataatatgctctcactcacttaggctaagaatctgcgcagagataagctatggattagggtttccatcgattaaccaatctcttccttgggcttcagagattctcatcgtctccctctttatatacacacacatacacattcttcgtctttgtgtgtttgttatcttctgagtaactgcgacaacaagaaggtctttccgtttcgattccgttcagattaaatcgatggattcgcagatgctcgtggcgcttggactgtcccttgtgggtggattaagtacttctttaggtgcgcttttcgtagttcttagtgagactcccaatatgaagatgcttggacttctgcagggttttgcggcaggtctgatgttgagcatatccttcctggatttggctcataatgctataaactctattggcttcttgaaaggcaatctctggtttttcggtggtgtgatattctttgcgtgtattgccaaattcataccggaaccaacacttggtccttctactgacgttaaaagaagaaagaagaatggagacgagggaggtaaggacatggcaaagaagcatcgacggcaagtgttatatagtggaattgttacagctattggaataagcttgcacaattttccagaggggatggccgtatttctcggatcaattaagggcatgcgagttggtgttaatctggctttggcaatcgctttacacaacattcctgagggtgtggcggttgcacttcctatatactttgcaacagagagcaaatggcaggcattcaaattggcaacactctctggtttagctgagcctctaggtgtaattatcgtggcttatctattcccgagcagcttgagtcctgaatccttgaaggcttgttgggagcagttggtggaatcatggcattcctaactttgcacgaaatgcttcctttggcatttgattatgctggacagaagcaagctgtaaaggctgtgtttgtcggtatggcttgtatgtctgcaagtctttactttctggagctgagtttacctgagtcaatgggttggtcagtttagttatgtcatgtgtgcaataattgcctcctcaaagacaaaacaagtctgtggagtatagtctctttgtatctgtgaaatcaataggatctgtaacaattgagtattcatttttaattcaaagtaataatctctttt

SEQ ID NO: 1674 - DNA, 1388 bp, Raphanus sativus
gggagataaatcggggccaacataaaccaggggaacaggcaaaggagaaagaagatgaagaggaaaggttaggtagaaaacgcgaagcacgcaagggggggtctgacataataataatatgctctcactcacttaggctaagaatctatccatctgcctacggattagggtttccatcgatttcaatctcttccttgggcttcagagattctcatcgtctccgtctttatatataacacacaatacacattcttcgtctttgtgtttgtttcttatcttgtgaggagctgcgataagaaggtctttcccgttcagataaaaatcgatggattcgcagatgctcgtggcgcttggtctatcccttgtgggtggattaagtacttctttaggtgcgcttttcgtagttcttagcgagactcccaatatgaagatgcttggacttcttcagggttttgcggcaggtctcatgttgagcatatccttccttgatttggctcataatgctatcaactctattggcttcttaaaaggcaatctctggtttttcggtggtgtgatattctttgcgtgtattgccaaattcatacccgaaccaacacttgctccttctactgatgtgaaaagaagaaagaaaaatggagacgagggaggtaaggatatggcgaagaagcatcgccgccaagtcttatacagtggaattgttacagctattggaataagcttgcacaattttccagaagggatggctgtatttctcggatcaattaagggcatgcgagttggtgttaatctggctttggcaatcgctttacataacattcccgagggtgttgcggttgcacttcctatatattttgcaacagagagcaaatggcaggcattcaaattggcaacactctctggattagctgagcctctaggtgttattatcgtggcttatctattcccgagcagcttgagtccagaaatccttgaaggattgttgggagcagttggtggaatcatggcattcctaactttgcacgaaatgctccctttggcatttgattatgctggacagaaacaagctgtaaaagctgtgtttgtcggcatggcttgtatgtctgcaagtctttactttctggagctgagtttgcctgactcaatgacctaagtttaagtaatgtcatgtgtgcaataattcctcctgaaagacatgaatcagtctctggagtatagtctctttgtatctgtgaaatcaataggatctgtaaacaattgagtattcgtttttaattcaaaggaataatctctttttaacatcttatttaagaataatctttaccaacctctggcaaaatgttactgtaaatccgtgtgatcatctgtgggcaaaagatgtttttgca

SEQ ID NO: 1675 - DNA, 1407 bp, Brassica rapa
aaccaggggggacaggcaaacgagaaagaagatgaggaggaaaggttaggtagaaaacgagaagcacgcaggcataatatgctctcactcacttaggctaagaatctgcgcagagataagctatggattagggtttccatcgattaaccaatctcttccttgggcttcagagattctcatcgtctccctctttatatacacacacatacacattcttcgtctttgtgtgtttgttatcttctgagtaactgcgacaacaagaaggtctttccgtttcgattccgttcagattaaatcgatggattcgcagatgctcgtggcgcttggactgtcccttgtgggtggattaagtacttctttaggtgcgcttttcgtagttcttagtgagactcccaatatgaagatgcttggacttctgcagggttttgcggcaggtctgatgttgagcatatccttcctggatttggctcataatgctataaactctattggcttcttgaaaggcaatctctggtttttcggtggtgtgatattctttgcgtgtattgccaaattcataccggaaccaacacttggtccttctactgacgttaaaagaagaaagaagaatggagacgagggaggtaaggacatggcaaagaagcatcgacggcaagtgttatatagtggaattgttacagctattggaataagcttgcacaattttccagaggggatggccgtatttctcggatcaattaagggcatgcgagttggtgttaatctggctttggcaatcgctttacacaacattcctgagggtgtggcggttgcacttcctatatactttgcaacagagagcaaatggcaggcattcaaattggcaacactctctggtttagctgagcctctaggtgtaattatcgtggcttatctattcccgagcagcttgagtcctgaaatccttgaaggcttgttgggagcagttggtggaatcatggcattcctaactttgcacgaaatgcttcctttggcatttgattatgctggacagaagcaagctgtaaaggctgtgtttgtcggtatggcttgtatgtctgcaagtctttactttctggagctgagtttacctgagtcaatgggttggtcagtttagttatgtcatgtgtgcaataattgcctcctcaaagacaaaacaagtctgtggagtatagtctctttgtatctgtgaaatcaataggatctgtaacaattgagtattcatttttaattcaaagtaataatctcttttaacatcttatttaacagtaatctttgccaatctctcgcaaaatgtcactgtaaatccatgtgatcatctatggacaaagatgcttttgcaaaaataaaaggtgtatttatagctctagtttatttttaccactattt

SEQ ID NO: 1676 - DNA, 1459 bp, Gossypium raimondii
ctcgtttttggaacaggtgctcttttcgtaattcttaatcaagctcccaatttgaaaatgcttgggcttttacagggttttgctgcaggtctaatgttgagcatatcattccttgatttagctcataacgctatgaactcaattgggttcttgaaaggcaacctctggtttttttctggtgttatcttctttgctgtggttgccaattttatacctgagcctaccctatctcacagttctgaggtgaaaggcaaaaagaacaagggtgatgaagggggcaaggatatgatgaaaaagcatcgacgccaggtttttttcagtggaattattacagcaataggcataagcttgcataattttcccgaggggatggcagttttccttggatccatgaagggccttcgtgtcggtcttaatttggctttggccattgctttgcacaacatccccgagggtgttgctgttgcactgcctgtttattttgctacacagagcaagtggcaggcattcaagttggcaactctttctggttttgcggagccgctcggcgttgtaattgttgcttatctgttcccgagcagcttaagtcccgaaattctcgagggcttgttaggatcagttggtggggtgatggccttcctaacattacatgaaatgctgccattggcatttgactatgccgggcagaagcaagctgtcaaggctgtgttcttcgggatggctttcatgtctgcaagcctatactttctcgaactaagcttaccgaaggacatgagcttgtaacctctttccatatgaacaaaaaaatgttgtaaattcctgaaccaagatgttttattttagttgatttctctgataattttagccaaactatgagatatcttaaaagcaaaaaggatgaacggccccagtttgcaatgtacataacttgtttccttgtaacaacatgaacattgaaaaggggaaaaaaagagggggtttcaaataaatttatggataatttccttacaaacctcatttttatttctttaacaaagtgcaaattcagaatattgaatctttcatctctaattggcacattttttagattagtatagttatgcaaggttaaaatatgctataagtccttgcactcttagtaaattaagaatttagtccttatgcttttattttcaagaatttaaatttcaaaattttagctcagttgttaacactattaattgtatttgttaaattggttggtgtaatattttttaaataaagaaggtacccatttagtaacaatataattaaaaacgtttcaattaacctgaatttaacaaaaataatttttataagattaacaatttaacttaaattttaaaatctaaaaatgccaattcaaattttaaaaggttcaagttaatgctcaaatgtagattgtattttatctaagtcattcgattttaagtattgagct

SEQ ID NO: 1677 - DNA, 1308 bp, Eutrema halophilum
ggaaggttaggtagaaaacgagaagcacgcaaggtcaggcataatatgctcacttaggctaagaatttgaagagaaaaactatcgattagggttttgagctttccactttccatcgattaatccccaaaactatctcttccttccggtttagatattctcttcgtctccgtctttatatactaaatcttcgccttctccatttctgaagtcgacttaggaatttacttggaatcaccaggaaaaaaattggttgtgtgtttgtttttgttgaggagcgataaggtctttcctgttcaaattcctgtcagataaaatggtggattcccagatgctcgtggcgcttggactatccctcgtgggcggattatctacttctctaggtgcacttttcgtagttcttagtgacactcccaatatgaagatgcttggacttctgcagggttttgcggcaggtctgatgttgagcatatccttcctggatttggcgcataatgcaataaactctattgggttcttaaaaggaaatctctggttttttggtggtgtgatattctttgcgtgtattgccaaattcatacccgaaccaacaattggtccttctactgacgtgaaaagaagaaagaaaaatggagacgagggaggtaaggacatggtgaagaagcatcgccggcaagtcttatatagtggaattattacagctattggcataagcttgcataattttccagaagggatggccgtatttctcggatcaattaagggcatgcgagttggtgttaatttggctttggcaatagctttacacaacatccccgagggtgttgcggttgcacttcctatttattttgcaacagagagcaaatggcaggcattcaaattggcaacgctctctggtttagcagagcctctaggtgtagttatcgtggcctatctattcccaagcagcttaagtccagaaatccttgaaggcttgttgggagcagttggtggaatcatggctttcctaacgttgcacgaaatgcttcctttagcatttgattatgctggacagaaacaagctgtgaaggctgtgtttgttggcatggcatgtatgtctgcaagtctttactttctggagttgagtttgcctgagacaatgagcttgtaaggtcgataatgtcatgtgcaataattgcctcctcaaagacagaaatcattctctggagtatagtctctttgtaaagacagtaaaacctgtaaacaaatgagtattctttttataaattcaaaggaataatctgttttcaacatccatttgtgtaacagta

SEQ ID NO: 1678 - DNA, 1263 bp, Amorphophallus konjac
gtcttcgcacccattgacctctctccagggaagtctcaccccgctcgtcgccatggattctcaggtcctcgtcgccctcgccctctccctcgtcggcggcttgagcacctccatcggtgcacttattgtgattataaatcaagccccaaatcttaagttgcttgggctgttacagggttttgctgctggtctaatgctgagcatatccttcttagacttggtgcataatgctatgaactctattggcttcttaaaaggcaacctttggttctttgctggagtccttttatttgcactcattgtgaattttattccagaaccaacacttcttccaagcaatactgtaaatacaaaacagagagatgaagatggatcaggtaaggacctgatgaaaaacatcgccgccaagttctctttagtggaattattacagcaatagggataagtttacacaattttcccgagggaatggctgtatttcttggatcaatgaaggggatacgagttggcgttaatttggctttggcaattgctctgcataacattcctgagggtgttgctgtagcacttcctatttattttgcaactcaaagcaaatggcaggctttcaaagtggcgactttttctggttttgctgaacctttgggcgtggttattgtggcttacctgtttcccagcagcttaagtcctgaaattcttgaaggcttacttggatctgttggtggagttatggctttcctcaccttgcatgaaatgctacctttagcatttgattatgctgggcaaaaacaagctgtcaaagctgtcttcttgggaatggcttttatggcagccagcttatacttcttacagatcagcttgcccgatgagatcagcttgtagctgcggaactggtttatggataattctttatctgtaaactcttgtccagcagccacaagttcttgtcgtattccctagtgcaacgtgatcacctccaagtgcctgccttgctgccatcatggtgtacgtgattgcgctttcatcggcaattggaaaatgcagaatgcatctcatgtccaagaaacaaaattatgcgtgtcaaaagttttttttcttattttcaacttcagatgatgtctggtactgacgctcatatatatcctgatagaccgcccccccccccactccttaccatggtctgaactgtaaggctgcagaggggtatggtgttacaagaacatttcgtgttgtacacaaattctgaagtagatatggtatttc

SEQ ID NO: 1679 - DNA, 1320 bp, Lippia dulcis
ccaaagcatcgcgctttgattgaccctttaaaacaatcaatccatttctttacctcaacgtattcctcgccatttacttcttcactcaaaattgctagatcggtatctcacttgccttccgtaatgctttaacttcgcagttcatgactgaggattaaaccccaatcaagggatttctttctcccttccatttccccccttttttcaatacataaattcgggtttgctgtagtcttaagcaatcttgtgtaccccttactccttgctgttctgtttcaaggataaggagaggaggagaaagggttcaggaatttgtgtttgaggagtatgggtttaatggattcacaggttttggttgcgcttgcactttcccttcttggtggtttgagtacctctattggagcactttttgttgtccttagtgagactccaaatctaaagacacttgggcttttacaaggttttgctgctgggctgatgttgagcatatctttcttagacttggctcataatgccattaattccattggcttcttaaagggaaatctctggttctttgcaggtgtaattttctttgcggtgatcgctaatttcatccctgaaccaaagcttgcacctgttccgcatctggagaaaaataagaaaaatggggatgaacggaacaaagatatcatgaagaagcatcgtcgtcaagtcttgtttagcggaatcatcactgccgtaggtataagtttgcacaattttcccgagggaatggcagtgttccttggatcaatgaagggtcttcgtgttggtctgaacttggcactagctatttccctgcacaatattcctgagggtgttgctgttgcacttcctatttattttgccacaaagagcaaatggcaggcattcaagctggctactctttctggttttgctgaacctcttggtgtaattgttgtagcttatctatttcccagcagtctgaatcctgaaattctgagggccttcttgcatcagtcggtggagtgatggcttttctaaccttgcatgaaatgttgcctttggcaattgagtacagtggacaaaaacgagctgtaaaggctgtttttgttgggatggctttcatgtctgcaagcctatattttcttgagatgagcttgccatcagaagtgagcttgtagtcatcgctttcatgggtttttgttccctgaaattgcagtcacagaatctgtaactttcatttatgggaacattattgatttatgtttgtaacaggaaagcgcttacacgtacagatacacgactcttatgtatggatgttagtattaagtacta

SEQ ID NO: 1680 - DNA, 1101 bp, Cicer arietinum
gtcgttttcaaaattgatttccttgcattccaattctgagcattatcgtcctcatggattctcaattcttgctgggtatcgccctctcatccattggtggattcagcacttcaattggtgcactttttgtaataatgagtcaagctccaagtttgaagatgcttggactattacagggttttgctgctggtttgatgctgagcatatcattctttgatcttgctcataatgctttgaactcacttggcttcctcagaggcaacctttggttttttctggtgtcgtattctttgctgttgttgctcactttataccagaaccaacagttcctcctccagataagaagagtaaaaaggttggaaatgaagaaaacaagaacatgatgaaaaaacgtcgccgtcaggttttattcagtggaattattacagcaataggtataagcttacataattttccagaaggaatggcagtgtaccttggatccatgaagggtcttcgtgttggtcttaaccttgcattggcaattgcactgcacaatatccctgagggtgttgctgttgcatttcctgttattttgccacagagagtaaatggcagggcattcaaattggcatcactttctggccttgctgagcccttgggtgttattattgtagcatgtctattccctaccagcctaaatcctgagattcttgagggtctgcttgcatcagttggtggagttatggcttttttgacccttcatgaaatgcttccattggcttttgagtatgcgggacataagcaatctgttaaggctgtcttctgtgggatggctttcatgtctgcaagcctgtattttctacgtatcagcttaccagaggacagtggcttatagctgggaactacatatattttcagaatgaaactcacaaacttgcaatgacaatattgtgcaacacaatcaatagggggattaggggatatcataggaaatgtaggatatgtttcagctatagtttcatctccatataatgcccggttatctttataattcataatttgtataaatttgtttatttataacatggagaataaaaacaattataaacagcataaata

SEQ ID NO: 1681 - DNA, 1112 bp, Ambrosia trifida
ttaaaacctcattcaattcaacaccctttcatatacacactgtttctctattatatccaatcttattcatagaaattaaagatgaactcagaggtgttggttgctctttccctctcattggttggtggcttaagcacatctttaggggcgctttttgtaatcttgactaaagctccaaacttgaagatgcttgggacttttacagggtttcgctgcaggccttatgctaagcatatcttctttgacttggcccataacgctataaattccatcggctttctgaaaggcaatatttggttctttggaggtgtcgttttctttgccattgttgcgaactttattcctgaaccatcgcttgctcctacaatagaagcgaaaaataagaagaaacaagtggatgaagggggaaaagatatcatgaagaaacatcgtcgtcaagttttatttagtggcattataacagcagttggcataagcttacacaactttccagaaggaatggctgtcttcctcggatcactcaagggtcttcgtgttggccttaacttggctttagccatagcgttgcacaatatcccagagggtgttgctgttgcacttccagtatattttgcaactcagagcaaatggcaggcgtttaaattggcgacggtttctggccttgctgagcctttgggtgtcattattgtagcatatctcttcccaagtagcctagatcctgagattcttgagggcttgctgggatcagttggtggagttatggcttttctaacactacatgaaatgctgccattagcatttgattatgctggacagaaacaagctgttaaagccgtcttctttggaatggccttcatgtctgcaagcttgtattttctggagattagcttaccgtcggatgtaggcttgtagatgcgatcatgggaattcctttattcgacaagtgttcacttaaaaccgagatttacttttattcagctctcttggaaagattaaagggtaacaagtagagcaaggataaacaaaatgtacatacactgatacacatattctgctattcttatttgtacttcacatataatttcaggcttatttgaaaattatgttatgct

SEQ ID NO: 1682 - DNA, 1172 bp, Arabidopsis lyrata
tagtaggtagaagaaaacgagaggcaagggtcaggcataatatgctctctcactaggctaagaatttgaagccatggattagggtttttcagtttctttctttcatcgattaaccgtgtttagagattctcttcgtctccgcctatatatcatttctcaaatttcgtttgtgattttatcaagcctagcttcaattcctgttaatcgatggattctcagatgctcgtggcgcttggactatcccttgttgggggattaagtacttctttaggtgcgcttttcgtagttcttagtgagactcccaatatgaagatgcttggtcttctacagggttttgcggcaggtctgatgttgagcatatcgttcctggatttggctcataatgctattaactctattgggttcttaaaagccaatctctggtttttcggtggtgtgatattctttgcgtgtattgccaaattcatacccgaaccaacagttggtccttctactgacgtgaaaagaagaaagaaaaatggagacgagggaggtaaagacatgatgaaaaagcatcgcaagcaagtcttatatagtggacttattacagctataggcataagcttgcacaattttccagaagggatggctgtatttctcggatcaattaagggcatgcgagttggtgttaatctggctttggccatcgctttacacaacattcctgagggtgttgcagttgcacttcctatttattttgcaacagaaagcaaatggcaggcatttaagttggcaacactctctggtttagctgagcctctaggtgtaattatcgtggcctatcttttcccaagaagcttaagtccagaaatccttgaaggtttgttgggagcagtgggtggaatcatggctttcctaacgttgcacgaaatgcttcctttggcatttgattatgcgggacagaaacaagctgtgaaggctgtgttttttggcatggcatgtatgtctgcgagtctttactttctggagctgagtttacctgatacaatgagcttgtaaggttagtgatgtcatgtgcaataattgcctccccaaagagataaaacagtctctggagtgaagtagtctctttgtatctgtaaagactgaaatctgtaaacaatgactaattcatttttaattcaaatgaataa

SEQ ID NO: 1683 - DNA, 1173 bp, Triphysaria pusilla
atcttgcaaacatttccttcttcttattccatttctcggataaggagaggaaaaaagacgggctctacatttcgataccaaattgggcgggttttttgtatagaaagattggatgggtttaatggattctcaggttttagttgctcttgcactttcacttgtcggcggcttgagtacctccattggggcacttttggtcgtcattaatccgactccgaatctgaagaagcttgggcttttacagggttttgctgctgggcttatgttgagcatatctttctttgacttggctcataattccataaattctatcggcttcttaaagggaaacctctggttctttgcaggtgtaattttctttgggattatcgcaaattttattccggaaccaactcttgcacccgtttcaaataagggaaacaagaaacacggggacgaaggtggcaaggatatcatgaaaaaacatcgccgtcaagtcttgtttagtgggatcatcactgctgtaggcataagtttgcacaattttcctgagggaatggctgtattcctcggatcaatcaagggtctccgtgttggtgtgaacttggcactagctattgcgttgcataacatacctgagggtgttgctgttgcgtttcctgtttattttgccacacaaagcaaatggcaggccttcaagctggctaccctttccggtttggccgagcccctcggtgtaattattgtagcttacttattccccagcagcttaaatcctgaaattctagaggggctacttggttcagttggtggagtaatggctttcttaaccttgcatgaaatgttacctctggcatttgattatgcggggcagaagcaagctgtgaaggctgtgtttgttggaatgctttcatgtctgccagcttatattttcttgagatcagcttgccagcagatatgagcttgtagtcatcgatgccgctattcatcaatgcctaacaactttatggatattctaaattggcccctcctaatcagtctttctacgcttaacgtcacttttacatattacaaactgtatttgcattaaacttttcatatcatgaatggaatgaaatttcagctcacatagtgtaaagaaacgagaaaaaagagagacatttaatgcttcttgtacgaaaaaaaaaaaaaaaa

SEQ ID NO: 1684 - DNA, 893 bp, Brassica juncea
gcttggtctatcccttgtgggtggattaagtacttctttaggtgcacttttcgtagttcttagtgagactcccaatatgaagatgcttggacttctacagggttttgcggcaggtctgatgttgagcatatccttcctggatttggctcataatgctataaactctattggcttcttgaaaggaaatctctggtttttcggtggtgtgatattctttgcgtgtattgccaaattcataccggaaccaacacttgctccttctactgatgtgaaaagaagaaagaaaaatggagacgagggaggtaaggacatggcaaagaagcatcgacggcaagtgttatatagtggaattgttacagctattggaataagcttgcacaattttccagaaggtatggccgtatttctcggatcaattaagggcatgcgagttggtgttaatctggctttggcaatcgctctacataacattcccgagggtgttgcagttgcacttcctatatattttgcaacagagagcaaatggcaggcattcaaattggcgacactctctggtttagctgagcctctaggtgtaatcatcgtggcttatctattcccgagcagcttgagtcctgaaatccttgaaggcttgttgggagcagttggtggaatcatggcattcctaactttgcacgaaatgcttcctttggcatttgattatgctggacagaaacaagctgtaaaagctgtgtttgtcggtatggcttgcatgtctgcaagtctttactttctggagctgagtttgcctgattcaatgagctagtaagtatagttatgtcatgtgtgctaataattgcctcctcgaagacataaaccagtctctggagtatagtctctttgtatctgtgaaa

SEQ ID NO: 1685 - DNA, 1113 bp, Medicago truncatula
tccaagcatagttccataatcaaattcatttcgatttttcccttgcattctcatcctcatggattctcaattcttgctgggtatcgccctttcatccattggtggtttaagcacttcaattggtgcactttttgtaattatgagtcaagctccaagtttgaagatgcttggactattacagggttttgctgctggtttaatgctgagcatatcattttttgatcttgctcataatgccataaacacactaggcttcctcagaggcaacctttggtttttttctggtgtcatattctttgcaattgttgccaactttataccagaaccaacagcacctcctcctgataagaagagcaaacaggttggtagggaagaaaacaagaacacgatgaaaaaacgtcgccgtcaggttttattcagtggaattattacagccataggtataagtttacataattttccagaaggaatggcagtgtatcttggatccatgaagggtcttcgtgttggtcttaaccttgcattggcaattgctctgcacaatatccctgagggtgttgctgtagcacttcctgtttattttgctacagagagtaaatggcaagcattcaaattggcatctctttctggcttggctgagcccctaggggttattattgtagcctgtctattccctaccagtctaaatcctgagattcttgagggtttgttggcatcagttggtggtgttatggcttttttgacccttcatgaaatgctgccattggcttttgagtatgctggagagaaaaaatctgttaaggctgtcttctgtgggatggctttcatgtctgcaagcctgtattttctacgtctaagcttgccagaggacactggcttatagtttggtgtgcaacctgtagaggaaattcagaatatatatcttttctgaatgaaagtattccatatacttcaatcacagcctgtcttctgcagcaagatgccttcagaatgagactggaaaacttgcaatgataatattgtgcaactatcagtagaggatattgcataggaatgtaggatatgtttcacctatggccccatttcataaaatgtacaaggaataggaaaaaa

SEQ ID NO: 1686 - DNA, 1137 bp, Arabidopsis thaliana
atgtcaagaatcctaatggacttgaatgtacgaatggaaagtttaaatcctttttcatatattcagatggtgcaccgggttaaaccgacccgagaaaaattcgggtcaacacaaaccaggggacagagacacgagaaagaagaagatagtagattaatcaatggattctcagatgctcgtggcgcttggactatcccttgttgggggattaagtacctctttaggtgcgctttttgtagttcttagtgagactcccaatatgaagatgcttggacttctacagggttttgcttcaggtctgatgttgagcatatcgttcttggatttggctcataatgctataaactctattgggttctttaaagccaacctctggtttttcggtggtgtgatattctttgcgtgtattaccaaattcatacccgaaccaacacttggtccttctactgacggcaaaagaagaaagaaaaatggagacgagggaggtaaagacatgatgaagaagcatcgcaagcaagtcttatatagtggacttataacagctataggcataagcttgcacaattttccagaagggatggctgtatttctcggatcaataaagggcatgcgagttggtgttaatctggctttggccatcgctttacacaacattcccgagggtgttgcagttgcacttcctatttattttgcaacagagagcaaatggcaggcatttaagttggcaacactctctggtttagctgagcctctaggtgtaattatcgtggcctatctattcccgagaagcttaagtccagaaatccttgaaggtttgttgggagcagttggtggaatcatggctttcctaacattgcacgaaatgcttcctttggcatttgattatgcgggacagaaacaagctgtgaaagctgtgttttttggcatggcatgtatgtctgcgagtctttactttctggagctgagtttgcctgagacaatgagcttgtaagtttaatgatgtcatgtgcaataattgcctcccccaaagagataaatcagtctctggagtgaagtagtctctttgtatctgtaaagactgaaatctgtaaacaatctgactattcattttaattcaaaaggaataatctctttagt

SEQ ID NO: 1687 - DNA, 1081 bp, Lotus japonicus
tctattgttaatgtgaaacaggtgcactttttgtgattgttaatccagctcccaatttgaagatgcttggtctattacagggttttgctgctggtttgatgctgagcatatcgttcttcgatctcgctcacaatgctttaaactcactgggcttcttgaagggaaacctttggttttttgctggtgtactattctttggtgttattgccagtttcatcccagagccatcacttgctcccacttcgaatacgaaaagtagaaagaaaaatggggatgaagaaagcaaggatggtatgaaaaagcatcggaggcaagttttattcagtggaattgttacagctgtaggtataagtttacacaattttccagaaggaatggcagtattccttgggtccatgaagggcctccgcgttggcctcaacctagcattggccatagctctgcacaatatccctgagggtgttgctgttgcacttcctgtttattttgcgacagaaagtaaatggcaggcattcaaattggcatcactttctggctttgccgaacctctgggtgtcataattgtagcttatctattcccgagcagcttaaatcctgagattctggaaggtttacttggatcagttgggggagttatggcttttctcactcttcatgaaatgctgcccttggctttcgattacgcgggacaaaagcaatctgttaaggctgtctttcttgggatggctttcatgtccgcaagcctgtattttctaagtatctgcttgccagaggatctaagcttgtagatgggattaacctcttcttttctgaatgtcatgaattccacagtatcactgtggtgtggtgtggtgtgtcttctgatggtataaccagttagttgcagtggaattccttcagaaggagcctttcaaacagatcaatgataataatgtacagccatcagacatcaatatagaggaatacattgcacctatgattagggttttccctattgacgaatgtacacaacaatttagagagaataagagtatgctgattcttaattcgaccactggccttgtattatatcatctcagag

SEQ ID NO: 1688 - DNA, 998 bp, Podocarpus macrophillus
atcttctgttcgaaactgagaactcaaattttcctgaatttctcattcttgaagctgtgacatacgatttggatacattggtacagcacttactggataaaattatgttgtgtttgagaatggataattcgcaagtgatagtagctctgatgctttcgctagttggaggagcaagcacatcgctaggcgctgttttggtggtggtgaatcctactccaaacctcaaagtgctgggacttcttcaaggatttgcatcaggacttatgctaagcatctcttttatggacttggcacataacgctattaactcaattggtttcttgaaagcaaatctgtggttttttggaggggttatactatttgcaatgattgtcaattttatcccagaaccaaatctggttccctctcaaagtcagaaaggaaaaagagaaaagaatcatgatgatggagggaaggatctgatgaagaaacataggaagcaagtttttttcagcggcataataactgcaattggtatcagtctacataactttccagagggaatggccgttttccttggatcaatcaagggtctccgtatcggtttgaacttggcactggctattgccttgcataatattccagagggagtggcagtagcattacctgtctactttgctacacagagcaagtggcaggcgtttaaattagcttctttgtctggcttggcagagcccttgggagtcatcattgtagcttatctatttccgagcaacttgtctccagaaatattggaaggtctacttggatctgttggagggtaatggctttctcacgctgcatgaaatgttaccattagcatttgactatgcaggtcagaaacaagctgtgaaagctgttttcataggcatggctgtaatgtccaccagtctatacttcttggaggtgagcttacccagtagctgtctctataaagtttatgtcttggctgaacttcattgattatcttttcgtcctta

SEQ ID NO: 1689 - DNA, 826 bp, Cajanus cajan
tcttcttccttattgccatatggattcccaggtcttgctaggtgttgcactttcatccattggtggtttcagcacttccatcggtgcactttttgtaatcatgagtcaagctccaagtttgaaggttcttgggctgttacagggttttgctgctggtttgatgctgagcatatcattctttgatctcgcacataatgccttgaacacacttggcttcctcagaggcaacctttggttttttgctggtgtcatattttttgctgttgttgccaaattcataccagaaccaacagttactcctcccacttcagatgacaagattacaaagaaagttgggaaagaaggaaagaaagacattatgaaaaagcgtcgccgtcaagttttactcagtggagttattacagccataggtataagcttgcataattttccagaaggaatggcagtgtaccttggatccatgaagggcattcgtgttggtcttaaccttgccctagctattgctctgcacaatatcccagagggtgttgctgttgcgcttcctgtctattttgcgacacagagtaaatgggaggcattcaaattggcatcactttctggctttgctgagcccctgggtgttataattgtagcctgtttattccctaccagcctaaatcctgagattcttgaaggtatccttggatcagttggaggagtgatggcttttctaacccttcatgaaatgttgccattggcttttgagtatgctggacaaaaacaatctgttaaggccgtcttttgtgggatggctttcatgtctgcaaggtaatcaaatattaaaatc

SEQ ID NO: 1690 - DNA, 885 bp, Taraxacum officinale
gcggggatcacaactttcttaactactgattctcccaactcgtctatttccgccattacttcgtccttaattcctgaaaactttgagggatggattcggaggtgttggttgctctttctctctcgctggtcggtggattaagtacatctttaggtgcactttttgtgattctaaccaaggctccaaacttgaaaatgcttggacttttacagggttttgctgcaggtcttatgttaagcatatctttctttgatttagcccataacgccataaattccattgggtttctaaaaggcaatctttggttctttggaggtgtcattttcttcgcgataatcgctaactttattccagaaccatcacttgctcccacagcagacgttaaaaataaaaagagaaatgaggatgaaggtggcaaagatgtaatgaaaaaacaccgccgccaagttttatttagtggaattattacagcagtaggcataagtttacacaattttccagaaggaatggctgttttccttggatcactaaagggtcttcgtgttggccttaacttagccttagccattgctttacacaatatcccagagggtgttgctgttgcacttcctgtttattttgcaacacaaagcaaatggcaggcgtttaaattggcaacggtttctgggcttgctgagcctttgggtgtcattattgtagcatatctcttcccaagtagcctagatcccgagattcttgagggcttgctaggagcagtcggtggagttatggcgtttttaactcttcacgaaatgttgccattagcatttgattatgcgggacaaaaacaagctgttaaagccgttttctttggatggccttcatgtctgcaagtttgtattttct

SEQ ID NO: 1691 - DNA, 1648 bp, Picea glauca
ctttaggcctgttttgatctagtttccaaggttgttggaagctttgaccagttgtgaaaactgatccacgttctatttttggattctttaagtacagtatcgaagcattttaggcatccatgtggtcatttagagtagcgaatctgaaaacctcgagtgatttgttcaagtcgagttacttgttcagggttcacaactcacatcccgtgtgaagggactctcaggcaggagggacatggattctcaagtcatggttgcccttatgctctctttggtaggaggagcaagcacatcacttggtgctctttttgtggttatcaaccctgctcctaagttgaaagtccttggacttcttcagggttttgcagcaggtcttatgctcagcatctctttcctagatttggcccataatgctatcaactcgattggcttcttaaaagcaaatctgtggttctttggaggtgttgtagtatttgctttcatcgtcaattttattccagagccaactctggttccctctcaaaatcaggcagatacaagtgaaaagtatgatggagggaaggatctaatgaaaaagcatcggaggcaagtgtttttcagtggcatcataacggcaattggtatcagtctacataattttccagaaggaatggctgtttttctgggatcaatcaagggactccgtgttggtttgaacttagcactggccattgccttgcataatattccagagggaatagccgtagcattgcctgtctactttgctactgaaagcaagtggcaggcttttaaattagcttctttgtctggtcttgcagaacccttgggggttgttcttgtagcttatctatttccaagcagcttatccccagaaattttggaaggtctactcgggtctgttggaggcgtgatggctttcctcacccttcatgaaatgttaccactagcatttgattatgcagggcagaagcaagccatcaaagctgttttcataggcatggctgtaatgtccaccagtttatatttcttggagatcagcttacccaaggagatgagtttataatgttttacatcatacttggttctctcaatttctattttatgctcatcttggataccatagctattctgtcaatgacaaggagcaaatcctgctacagaaaggctaccatactgcaattccaattctacttctcaaggagaatctcattgcgactctgttcctgttcttttatacaatgcaaataaagaacaactgcttttgagatggcccagaaattcagttctccactgagaaatgcaatgactgaccaaacagaaaaatatgattacgactgtgtatgctatatcttttacacaaaagggtcgaggtagagaaacattgaggagtcaaattctagtcgttactttcatgtgccataatctgcattgtagattgacttggctgataaaaatattgcaagactttttgcttgctttgtccagtttacaatattgaactataatcatttgattatttattaaatgccagattttcgtcatgttctaactcaagaaacgtgataaggcttactttatttcattgaagaagaaaggagcaaatctattaagattttttcatagtgaataatgatagacattttgatcc

SEQ ID NO: 1692 - DNA, 1352 bp, Picea glauca
  misc_feature (14)..(14): n is a, c, g, or t
ttcacaactcacancccgtgtgaagggactctcaggcaggagggacatggattctcaagtcatggttgcccttatgctctctttggtaggaggagcaagcacatcacttggtgctctttttgtggttatcaaccctgctcctaagttgaaagtccttggacttcttcagggttttgcagcaggtcttatgctcagcatctctttcctagatttggcccataatgctatcaactcgattggcttcttaaaagcaaatctgtggttctttggaggtgttgtagtatttgctttcatcgtcaattttattccagagccaactctggttccctctcaaaatcaggcagatacaagtgaaaagtatgatggagggaaggatctaatgaaaaagcatcggaggcaagtgtttttcagtggcatcataacggcaattggtatcagtctacataattttccagaaggaatggctgtttttctgggatcaatcaagggactccgtgttggtttgaacttagcactggccattgccttgcataatattccagagggaatagccgtagcattgcctgtctactttgctactgaaagcaagtggcaggcttttaaattagcttctttgtctggtcttgcagaacccttgggggttgttcttgtagcttatctatttccaagcagcttatccccagaaattttggaaggtctactcgggtctgttggaggcgtgatggctttcctcacccttcatgaaatgttaccactagcatttgattatgcagggcagaagcaagccatcaaagctgttttcataggcatggctgtaatgtccaccagtttatatttcttggagatcagcttacccaaggagatgagtttataatgttttacatcatacttggttctctcaatttctattttatgctcatcttggataccatagctattctgtcaatggcaaggagcaaatcctgctacagaaaggctaccatactgcgattccaattctacttctcaaggagaatctcattgccactctgttcctgttcttttatacaatgcaaataaagaacaactgcttttgagatggcccagaaattcagttctccactgagaaatgcaatgactgaccaaacagaaaaatatgattacgactgtgtatgctatatcttttacacaaaagggtcgaggtagagaaacattgaggagtcaaattctagtcgttacttttatgtgccataatctgcattgtagattgacttggctgataaaaatattgcaagactttttgcttgctttgtccagtttacaatattgaactataatcatttgattatttattaaatgccagattttcgaca

SEQ ID NO: 1693 - DNA, 1345 bp, Brachypodium distachyon
gaaaagaagagaaggaaagtcaagccaagacaaatccgccttgttttgatttgtttcaaccgctcctcgtgataactccccccattcctcttcccctcccggctcccacctcgctccccaaaccctagcgggagcactgagccgcggcggaatggagtcgcacgtgtgggtggcgctcgccctctccttcgtcggcggcctgagcacctcccttggcgcgctgcttgtgatcttgaatcctactcctgaccttaagaggctcgggctcctccagggttttgctgccggacttatgttgagcatttcgtttctagacttggcacacaatgcactcaattctattggcttcttgaaggccaacctttggttttttgcaggagttcttttctttggtttcattgtcaagtttattccagagccaacctttgtgccaacagacgatgtgattaggaaaaagactgacgatgatggctcgggtaaagatatgatgaaaaagcatcgtcggcaagtcttgttcagtggtatcatcactgctgttggaattagcttgcacaattttcctgagggaatagctgtatttcttggatccgtgaagggtcttcgcgtgggaattaacttggctattgctattgctttacacaacatacccgagggtgttgctgtagccctgccactctattttgctacaaaaagcaaatggcaagcatttaagtatgcaacactctctggttttgctgagccactaggagtggtttttgtagctgtcttttttccgagcaacttaaaccctgaaattcttgaaggcctacttgcatcagttggtggtgttatggctttcctcactttgcatgaattgttaccgctagcatttgactatgctggtcagaagcaagctgtcaaagcagtctttgttggcatggccatcatgtctgcaagcttgtatttcctggagatcagcctgccagaggagatcggcttgtagcatatgactacaccactgtaaccataccagtttttcacagtatctctgaagagcgagagctttgccgtagatgttccttaatcatggggacggagcactcgtcgttcagaaacaagaattatggctagattgttgcactggccatgcgtatgcaattacttctggtcatggcgtctgaccattttacaatgtatacaaacgacagtactgccacccatttggggtggcgtgagaaaagaacagaatcaaaatgcgtccaccagataattagttgtcaggtaacagggtgcagattcaccgtctgccactaattgacggtgtggttaaaaacatcaatgtttgcccattcggcttctcatttcc

SEQ ID NO: 1694 - DNA, 1411 bp, Brachypodium distachyon
gctcctcgtgataactccccccattcctcttcccctcccggctcccacctcgctccccaaaccctagcgggagcactgagccgcggcggaatggagtcgcacgtgtgggtggcgctcgccctctccttcgtcggcggcctgagcacctcccttggcgcgctgcttgtgatcttgaatcctactcctgaccttaagaggctcgggctcctccagggttttgctgccggacttatgttgagcatttcgtttctagacttggcacacaatgcactcaattctattggcttcttgaaggccaacctttggttttttgcaggagttcttttctttggtttcattgtcaagtttattccagagccaacctttgtgccaacagacgatgtgattaggaaaaagactgacgatgatggctcgggtaaagatatgatgaaaaagcatcgtcggcaagtcttgttcagtggtatcatcactgctgttggaattagcttgcacaattttcctgagggaatagctgtatttcttggatccgtgaagggtcttcgcgtgggaattaacttggctattgctattgctttacacaacatacccgagggtgttgctgtagccctgccactctattttgctacaaaaagcaaatggcaagcatttaagtatgcaacactctctggttttgctgagccactaggagtggtttttgtagctgtcttttttccgagcaacttaaaccctgaaattcttgaaggcctacttgcatcagttggtggtgttatggctttcctcactttgcatgaattgttaccgctagcatttgactatgctggtcagaagcaagctgtcaaagcagtctttgttggcatggccatcatgtctgcaagcttgtatttcctggagatcagcctgccagaggagatcggcttgtagcatatgactacaccactgtaaccataccagtttttcacagtatctctgaagagcgagagctttgccgtagatgttccttaatcatggggacggagcactcgtcgttcagaaacaagaattatggctagattgttgcactggccatgcgtatgcaattacttctggtcatggcgtctgaccattttacaatgtatacaaacgacagtactgccacccatttggggtggcgtgagaaaagaacagaatcaaaatgcgtccaccagataattagttgtcaggtaacagggtgcagattcaccgtctgccactaattgacggtgtggttaaaaacatcaatgtttgcccattcggcttctcatttcctgacgagccttctcttgcctagtttttcttttggcgggaaatttttgcatttgccatggatggggcactaccgcactagcctgttgggacttcaaggaggctgctgttagaaataccacttgaaaag

SEQ ID NO: 1695 - DNA, 1247 bp, Arachis hypogaea
ttacagggttttgcagctggtttgatgcttagtatttccttctttgaccttgctcataatgctctcaactcacttggcttcctcaaagggaatctctggttttttgctggcgtagtattctttggtgttgttgccaattttatccctgagccgacacttgctcccacttccagtgacaagagtagaaagaaaaatggggatggaggaggcaaagatatcatgaaaaagcatcgccgccaagttttattcagtggaattattaccgcagtaggtataagtttgcacaattttccagagggaatggcagtgttccttggttcaattaagggccttcgtgttggcctcaacttggcattggccattgctctgcacaatatcccagagggtgttgctgttgcacttcctgtttattttgctacagaaagtaaatggcaggcattcaaattggcatcactttctggatttgctgaacccttgggtgttattattgtagcctatctattccctagcagcttagatcctgagattttggagggtttgcttggatcagttggtggagttatggcctttctgacccttcatgaaatgctgccattggctttcgattatgcgggacagaagcaatctgttaaagctgtcttctttgggatggcttttatgtctgcaagcctatattttctaagtatcagcttgccagaggacatgagcttgtagctgtgaaggaacaatcttagattctttttctgaatgtgatgaatcgatttcaaagtattaatgtggtgtggcgtcttgctgattctgtcaccagtggcatggcagcaatattccttcaccgctgagtatctcagtgacaataatgcacaaccatcaaccatacctaacctatgactataggtttccagtgtagaacgaatgtacagagaaaaaaatatatatataaagaataagaatattctgtctttattctttaaccgaattcctgtgctactgtctcgtcaattaaaagtctgcagacgttaaattgcacaatttgctgattatgtatcatgtttggttatttgtggcattggggtgtcacaaacatcatataccatttccaaaactatgttgcatatcaaaatactaagtggtacctatgcttaacatcttatgggcctattttgttactatcatatggaacttgatgaaatagtaactatgatgaatctttcaatgtgccaatgtgcattggaaagattatagtaaac

SEQ ID NO: 1696 - DNA, 1530 bp, Secale cereale
aaggtgcagtgagcctcatgattcatgccgcacagaccagtagtggcacggttttcgctatttgggacgtggccttgacaagaagaagttcgtgattagcagttccgcgtttcctccctctcacccatcccatccctgatgatccctgcactccactagtcgtatctcctccctctcctctccccgcgcacccgctcctcggccggcggcccctcaaaccctaggtgcgagcgcggcggagatggagcagcacgtgctggtggcgctcgccctctccttcgtcggcggcctcagcacctccctcggtgcgctgctcgtgatcgtcaacccatcccctgaccttaagaggctcggcctcctccagggttttgctgctggacttatgttgagcatctcgtttctagacttggcacacaacgcactcaactccattggcttcttgaaggccaacctttggttttttgcgggagttcttttctttggttttgttgtcaagtttattccagagccaacctttgtgccaacagctgatgcaagcaagaaaaagactgatgatgatggctcgggcaaagatatgatgaaaaaacatcgccggcaagtcttattcagtggcatcattactgctgttggaattagcttgcacaattttcctgagggaatggcggtatttcttggatccgtgaagggtcttcgcgtgggagttaacttggctattgctattgctttacataacatacccgagggggttgctgtagctctgccactctattttgctaccaaaagcaaatggcaagcatttaaatatgcaacactctctggtttggctgagccactaggagtattttttgtagctgtcttgtttccgagcaacttaaatcctgaaattcttgaaggcctacttgcatcagtcggtggtgttatggctttcctcactttgcatgagttgttacctctagcatttgactatgctggtcagaagcaagctgtcaaagcagtctttgttggcatggccgtcatgtctgcgagcttgtatttcctggagatcagcctaccgaaggagatcagcttgtaacatttgactgcacccctgcaactataccggctgttcatagtgtcctctgaagcccgacaactttgccatacatcaaccgtttcttgcgctttgcaaggcaaggggagtggggggtggaaggttcgtcgttcagaaacaagaattatggccatactctttcattggccatgtgtagctacataattactcctggtcatcgtgtctgaccgtttactaggaaaaaacagcagtggggcgacccatatgtggtggctggacatccctcattttgtttgtttcagaaaaccatatgggttgacgggtatctgaatacaaccgccaggtttgttgtccagtaacgggatgcaactagaactgatttgcgtgttttcgccagttgccactgatttgacacttgttaaaaacctgcccacaatcatggctgcaggctgcggtggtcctgttccaagtatatacat

SEQ ID NO: 1697 - DNA, 1482 bp, Hordeum vulgare
ggtgattagcagttccctttttcctccctccgtcctgatgattcctccactccgctagccgtatctcgctccgccctcctcacccactcccctttctccgcgctcccgctcctcggcgggccctcctcaaaccctaggcgcgagctgccgcggcggagatggagcagcacgtgctggtggcgctcgccctctccttcgtcggcggcctcagcacctctctcggtgcgctgctggtgatcgtgaacccttcccctgacctcaagaggctcggcctcctccagggttttgctgctggacttatgttgagcatctcgtttctagacctggcacacaacgcactcaattccattggcttcttgaaggccaacctctggttttttgcgggagttcttttctttggtttcgttgtcaagttcattccagagccaacctttgtgccaacaactgatgcgagcaagaaaaagactgatgatgatggggcaggtaaagatatgatgaaaaaacatcgccggcaagtcttattcagtggcatcattactgccgttggaattagcttgcacaatttccctgagggaatggcggtatttcttggatccgtgaagggtcttcgagtcggagttaacttggccattgctattgctttacataacatacccgagggggttgctgtagctctgccactctattttgctaccaaaagcaaatggcaagcatttaaatatgcaacactctctggtttggctgagccactaggagtattttttgtagctgtcttgtttccgagcaacttaaatcctgaaattcttgaaggcctacttgcatcagttggtggtgttatggctttcctcactttgcatgaattgttacctctagcatttgactatgctggtcagaagcaagctgtgaaagcagtctttgttggcatggccgtcatgtctgcgagcttgtatttcctggagatcagcctgcccaaagagatcagtttgtaacacatgaccgcaccaccgcaactataccagctgttcatagtgtcctctgaagcctgagagcttcgccatatatcaaacgtttcttgcgctttgccgctttgcaaagcaaggggcgtggggtttggaaggttcgtcgctcagaagcaaggattatggccagacagttgcactggccatgtgtagcatacactattactcctggtcattgtatctgaccgttatttactaggaaaaaacagcagtgtcacgacccatatgcggtggctggacacccctcaatttgtttgtttcagaaaaccatatgggttgacgggtatctgaatacaaccaccgggtttgttgtccagtaacaggatgcaactagaactgatttgtgtagtttttgccgatttgacactagttaaaaacctgcctggtggtcttgttcctggattctgttccaagtttatacatcttcagtttcttttctcttgccaaaaaaaaaaaaaaatac

SEQ ID NO: 1698 - DNA, 1357 bp, Triticum aestivum
ccacgcgtccgcctattcctcccatccccatcctccctgatgatccccccgctccactagtcgtatctccctctcctcgcctccgctctcctcccctctctccggtcctcggccggcggcccctcaaaccctagccccgagcgcgagcgcggcggagatggagcagcacgtgctggtggcgctcgccctctccttcgtcggcggcctcagcacctccctcggtgcgctgcttgtgatcgtcaacccttcccctgacctcaagaggctcggcctcctccagggttttgctgctggacttatgttgagcatctcgtttctagacttggcacacaacgcactcaactccattggcttcttgaaggccaatctatggttttttgcaggagttcttttctttgggttcgttgtcaagtttattccagagccaacctttgtgccaacaactgatgcaagcaagaaaaagactgatgatgacgggtcgggcaaagatatgatgaaaaaacatcgccggcaagtcttattcagtggcatcattactgctgttggaattagcttgcacaattttcctgagggaatggcagtatttcttggatccgtgaagggtcttcgcgtgggagttaacttggctatcgctattgctttacataacatacccgagggggttgctgtagctctgccactctattttgctaccaaaagcaaatggcaagcatttaaatatgcaacactctctggtttggctgagccactaggagtattttttgtagctgtcttgtttccgagcaacttaaatcctgaaattcttgaaggcctacttgcatcagttggtggtgttatggctttcctcactttgcatgagttgttacctctagcatttgactatgctggccagaagcaagctgtcaaagcagtctttgttggcatggccgtcatgtctgcgagcttgtatttcctggagatcagcctaccgaaggagatcagcttgtaacatatgactgcaccactgcaactataccagctgttcatagtgtcttctgaagcccgagaactttgccacacatcaacctttctttgcgctctgaaggcaaggaccaagaaacacgatgggattgcgttggccatgtgtagcatacactattactcctggtcattgtgtctgaccgttgtttactaggaaatacagcagtgtggcgacccatatgcggtggctggacatccctcattttgttgtttaagagaaccatatggggtgaaagatacaaccgttgggtttgttgtccagtaagaggatgcaactagaactgatttgtggcattttcgccggccgatttgacacttgttaaatacctgctcacaa

SEQ ID NO: 1699 - DNA, 1415 bp, Glycine max
aacggtccacattccacgcctctcagatctcgcaatcaaacactttaaactccctccttcctcactacacgccgtttctcttttattgccgttttttttatgtcgtcatgttctgagtttcgtgttgtcctgttttgtgttgttgtgttgtgttcagttctttccttcgttacatgcaaaaacgactatgaagacgccaaaacgccaatcgtcgccggcaaacgctgctcgaccagtggagtctgattccggcgagatcgtcacgaggttcaagaacggtggccggagaaggatcaaaatcaagcgaatgaagtacacttgccagacgaagatccgcgtcaggaatgacgccggcgctggcggcgtgtctcaaccgccggcggtggattctgaaggagagaagagagagattgacgagcacgtggagatatcgctgtcgctggcttcctcgtcgtcggaagaggaagagcgattgtcgtcgaagcaaagcgacggcgttttgtcgtacggttcggcgtcggtgatagggagcaggacggagatggaggacgcggtgagctcggagatagggtttgcagcgaagtgcgacttctttgcggtgtacgacggccacggcggagctcaggtggcggaggcgtgcaaggagaggctgcaccggctggtggcggaggaagtggtggggagtagtgagagtcacgtggaatgggactggcggggagtgatggaagggtgttttcggaaaatggacagcgaggtcgccggtaacgcggccgtcaggatggtgggttccacagcggttgtcgccgtcgtggcggtggaggaggttatcgttgctaattgcggtgattctagggccgtgttgggaagaggaggtgaggccgtggacttgtctagtgatcataagccccacaggcccgatgagttgatgagaatcgaagaggctggtggaagggtcattaactggaatggccagcgcgtgcttggtgttcttgccacttcacgatccataggagatcagtaccttagaccttatgtaatatcaaaaccagaagtgacagtgacccagcgaagcagcaaggatgaatttctcatactagcaagtgatggattgtgggatgtgatgtcaagtgaagttgcgtgccaagttgtaaggaaatgcttccaggggcagattaggagagtgtgcgatggagttgggaatcatcaaaaccgtgctaccgaggctgcagacctcttggctgagatagcattggcaaagggaagtagagataacaccagtgtcattgtagttgagctaagaggaacagtaacaactgattgaggcctcgtttctgtcaaaacatgtatttttatttttattttcttctctaattcttgccttgctgctttggactaatatacactcaggttgtgcc

SEQ ID NO: 1700 - DNA, 1726 bp, Cajanus cajan
ctccctttcaaatccacggtccacataccacgcctctcagatctcgcaatcaaacactttaaattccatccttcctcgctacacgccgtttctctttattgccgtttattttttatttctttttttcttattcagtttcgtgtttagttctgttgtgctgtgttgtgttcagttcgttgcatgcaaaaacgacgatgaagacgccaaaacgccactcgccgccgcccaacgcggtccgacgagtggaacccgattccgtcgagattatcgcggggttcaagaattctcgtcggagaaggctaaaaatccggcgaatgaagtacacttgtcagacaaagatccgcgtcgggaaagacgccgacggcgttcctccgatggcggcggaggactcggagggagagaggagagagattcacgagcatgttgagatatcgctgtcgctggcgtcgtcgtcatcggaggaggaggagcggtcgtcgtcgaagcaaaaggacggcgctctgtcgcacgggtcggtgtcgttgatagggagcaggaaggagatggaggacgcggtgagcgtggagatagggtttgtggcgaaggagagagggaagtgcgacttcttcgcggtgtacgacggccacggcggagctcaggtggcggaggcgtgccgggagcggttgcaccggctggtggcggaggaggtggagaggagtgggagtcatatggaattggactgggacggagttatgcaagggtgttttcgtaaaatggacaccgaggtcgcaggaaatgcggcggttaggacggtgggttccacggcgcttgtcgccgtcgtcgcagaggcgcagattgtcgtcgctaattgcggtgattgcagggccgtgatgggaagaggaggcgaggccgtggacttgtctactgatcataagcccgacagacccgatgagttgatgcgaatcgaagaggctggtggaagggtcattaactggaatggccagcgcgtgcttggtgttcttgccacctcgcgatccataggcgatcagtaccttagaccttatgtaatatcaaaaccagaagtgacaatgaccaaacgtagcagcaaggatgagtttctcatactagcaagtgatgggttgtgggatgtgatgtccagtgaagttgcgtgccaagttgtgaggaaatgcctcaacgggcagattaggagagtgtgcaatggagttgagaatcatcagagtcgttctgccgaggctgcaggcctcttggctgagatagcattggcaaagggaagcagagataacatcagtgtcattgttgttgagttaagaggaacagtaacatctgattgaggcctcatttacagcctcaacatgtttttttttttcttcctttttcatttcctgccttgctgcttttggactaatatcaacacaggttatgcgtcctcaatgctacgagagattattatctactaaaacaataatgagtagatgcttccccacattactgttttaatttcttaaatatttaaaatgtcagagaaaatttgtttttgtctattaaaatttttcaagtttggctttagtctttgttatctaagattttttgacttaatcgaacaaaaacagtcgtagttttgttgatcgaagaaagtgaagtaaggagattcaagaggcttgaagtaacaagtttacaaaagaatttttttccgattatataaaaaaagatttaaagtagttataac

SEQ ID NO: 1701 - DNA, 1349 bp, Vigna unguiculata
cttatttccaccttattgtctattctcttctgctgtcttgtgttgtgttcagttcgttgcatgcaaaaacgactatgaagaagccaaaacgccactcgccgacggccaacgctgaccggcgagtggaccctgattccggtgagtttgtcgccaagatgaagaacggtcgccagagaaggcttaaaatcaggcaaatgaagatccgcatcaggaatggcaccgccggcgtctctccgcctccggccgaggacctggagggagggagcagagagattcatgagcacgtggagatatctttgtctttggcggcggcgtcgtcgtcctcagaggaggaggagcggtcatcgtcggagcgaaacgacggtgttttgtcgtacgggtccacgtctgtgattgggagcaggaaggagatggaggacgcggtgagtgcggagatagggtttgctgcgaaggaaagagggaagtacgacttcttcgcggtgtacgacggccacggcggagcgcaggtggcggaggcgtgtcgcgagcggttgcaccggctggttgcggaggaggttgagaggagtgagagtcacgtggaatgggactggcagggagttatggaagggtgtttccgtaaaatggacagcgaagtcgctggtaatgcggccgtcaggacggtgggttccacggcggttgtagctgtgatcgcggcggaggagcttgtggtcgctaattgcggtgattgtagagctgtgttgggaagaggaggtgaggccgtggacttgtctagtgatcataagcccgatagaccggacgagttgatgcgaatcgaagaggctggtggaagagtaattaactggaacggccagcgcgtgcttggtgttcttgctacttcaagatccataggagatgagtaccttcgaccttatgtaatatcggaaccagaagtgacagtgacgaagcgaagcaacaaggatgaatttgtgatactagcaagtgatggattgtgggatgttatgtcgagtgaagttgcgtgccaagttgtaaggaaatgcctgaatggacagattaggagaatgtgcaatggagttgggaagcatgaaaaccgtgccgcggaggctgcaagcctcttagctgagattgcattggcaaagggaagtagagataacaccagtgtcattgtagttgagctaagaggaacagtaacataacatctcagtgtgtgcaaaaacatgtactttcttctcttattcttgccttctacttttggactcatatccacccaggtcctgcatcctcaatgccacgagagatttctaccacataattacgagtacttggttcacaacgttagtgttttttctttt

SEQ ID NO: 1702 - DNA, 1349 bp, Vigna unguiculata
  misc_feature (409)..(409): n is a, c, g, or t
  misc_feature (810)..(810): n is a, c, g, or t
  misc_feature (1305)..(1305): n is a, c, g, or t
cttatttccaccttattgtctattctcttctgctgtcttgtgttgtgttcagttcgttgcatgcaaaaacgactatgaagaagccaaaacgccactcgccgacggccaacgctgaccggcgagtggaccctgattccggtgagtttgtcgccaagatgaagaacggtcgccagagaaggcttaaaatcaggcaaatgaagatccgcatcaggaatggcaccgccggcgtctctccgcctccggccgaggacctggagggagggagcagagagattcatgagcacgtggagatatctttgtctttggcggcggcgtcgtcgtcctcagaggaggaggagcggtcatcgtcggagcgaaacgacggtgttttgtcgtacgggtccacgtctgtgattgggagcaggaaggngatggaggacgcggtgagtgcggagatagggtttgctgcgaaggaaagagggaagtacgacttcttcgcggtgtacgacggccacggcggagcgcaggtggcggaggcgtgtcgcgagcggttgcaccggctggttgcggaggaggttgagaggagtgagagtcacgtggaatgggactggcagggagttatggaagggtgtttccgtaaaatggacagcgaagtcgctggtaatgcggccgtcaggacggtgggttccacggcggttgtagctgtgatcgcggcggaggagcttgtggtcgctaattgcggtgattgtagagctgtgttgggaagaggaggtgaggccgtggacttgtctagtgatcataagcccgatagaccggacgagttgatgcgantcgaagaggctggtggaagagtaattaactggaacggccagcgcgtgcttggtgttcttgctacttcaagatccataggagatgagtaccttcgaccttatgtaatatcggaaccagaagtgacagtgacgaagcgaagcaacaaggatgaatttgtgatactagcaagtgatggattgtgggatgttatgtcgagtgaagttgcgtgccaagttgtaaggaaatgcctgaatggacagattaggagaatgtgcaatggagttgggaagcatgaaaaccgtgccgcggaggctgcaagcctcttagctgagattgcattggcaaagggaagtagagataacaccagtgtcattgtagttgagctaagaggaacagtaacataacatctcagtgtgtgcaaaaacatgtactttcttctcttattcttgccttctacttttggactcatatccacccaggtcctgcatcctcaatgccacgagagatttctaccanataattacgagtacttggttcacaacgttagtgttttttctttt

SEQ ID NO: 1703 - DNA, 1573 bp, Glycine max
cgatagcgaacacaacacaacacacagaacgcagtgagagtaaagagaagcagtttcggtctcactcagtaaacaatgggcgacttcacggttgcgttaaaccctcccaaaaccttccgcgccgatattctcctatccaccaccaacaaccgcacttccccggcggcgcgtggctttcaaaccgtactcgcgttcaaaccaccgcgcgcttttcgaggaatccgcgcttcggtgatgccaagagagggtcaacaagcgtctctcggagacgcccttgtcaacactccgcgccgaagcgacttcgttgaggccatcagaagaaccgccgcactctccagctgcctctcagaaacgagcctccacgccaccgttcccggcctcgagtccaaaacccgcggcaaagttcgagatatatacgacgctggggattacctcgttttggtgaccactgatcggcagagtgcgtttgatcggattcttgcttccattcctttcaaaggccaggttctcaatcagacgagtttgtggtggtttgaaagaactaagcatatcgtctctaatgcggttgtattggctccagataacaatgttacaatagctaggaaatgttcagttttcccagttgagtttgttgctagagggtttgtcactggaagtactgatacatctctatggacagtctacaataaaggcgttcggaactattgtggaaatgtcattccagatggaatggtaaaaaatcagaagttgcctaaaaatatactcactccaacaaccaaggctgcagatcatgatgttcctatcactccagatgagattatagacaggggactgatgactcgagctgattatgtagaagttagtgaaaaagcattatccttgtttgaatatgggcagcaagtggctttggagcatggcctcatattggtagatactaagtatgagtttgggaaggcaaatgatggttcaattatgttgattgatgaggtccatactcctgattcaagtagatattggatagccaattcttacctggagcgctttcaaaatggtcttgagcctgaaaatattgacaaggagtttttgaggctgtggtttataagtcactgcaacccttatgaagatgaggtccttcctgatgctcctgaagatcttgtctgtgaattagcctggcgatacattttcttgtatgagactataacaaaatcaaagtttgaggtgccatcgactgaggagcctatacatgaccgaattacacgaaatgttgcatctgcactgtcatccctaaagtagcctgggaaattagggccgtgctgtaattctgtattttaatctttgtataaactatatcaaaaacttaaattaatggagaacttctccaagcaattttttatttttccaaagtataacataaagcagaaaggcaaaacaacagattcagaaatttgacaccttgtccttgtgattccttctttttttttttttttttttaagaataaagagctgtttctggaagcagaacccaatgtgttctatgccttgtatatttccttgtgacggtatgggaagtaaa

SEQ ID NO: 1704 - DNA, 1681 bp, Cajanus cajan
atgttataagtcaatttgtttcaagttttaacccttggcaaaacgcaacggtaggcaccacaacacagcgcgagaagcagcttcagtttcactctttcactaaacgatgggagacttcacggttgcgttaaaccctgccaaaaccttccgctccgagattctccccatcaatcgcacttccccggcggcgcttaggcccgccaccgcaatctcattcaaatcgcacaggcttcgaggcccagcaattcgcgcttcggtgatgccgagagagggtcagcagcagcaacaacaacccgctcttctcagcagtcctcgcaaaagcgaactcgctgacgtcatcagaagaagcgcactctccaactgcctctccgaaaccaacctccacgccaccgttcccggtctccagtccaaaacccgtggcaaagttcgagatatttacgacgctggtgaccatctcgttttagtgaccactgatcgtcagagtgcgtttgataggattctcgcttccattcctttcaaaggccaggttctcaatgagacgagcttgtggtggtttcaaagaactaagcatatagtttctaatgcagttgtatctgctccagataagaatgttacaatagctaagaaatgttcagttttcccagttgagtttgttgctagaggatttgtcactggaagtaccgatacatcgctatggactgtctacaataatggcgttcggaactattgtggaaatgtccttccagatggaatggtaaaaaatcagaagttgcctgaaaatatactcactccaacaaccaaggctgcagatcatgatgttcctgtcactccagatgagattatagaaaggggactgatgactcgagctgattatgtagaagcgagtgaaaaagcattatgcttatttgaatatggacagcaagtggctttggagcatggcctcatattggtagacactaagtatgagtttgggaaggcaaatgatggttcaattatgttgatcgatgaggtccatactcctgattcaagtagatattggattgccggttcttacctggagcgctttcaaaatggtctcgagcccgaaaatattgacaaggagttcttgaggctgtggtttaaaagtcactgtaacccatatgaagatgaggtccttcctgatgctcctgaagatcttgtttgtgaattagcctggcgatacattttcttgtacgagactataacaaaatcaaagtttgaggtgccattgaccgaggagcctatacatgatcgaatttcacgaaatgttgcatctgcactgtcatctttaaagtagcctgggaattttagtgccctcctgtagctctgtattttaatcccttactataaattatattaataacttaaattaatggagaacttttccaaacaagtttcaatgcttttcaaggcaatctagtttctagattgtcatgaagacagttttagaaattggacatcttgggattttattttttttccttttaaagaataatgagatgtttctgaaagcagagcccaatgtgtcctttgccttgtatattttccttgtgacagtatgagaattaataattatctgttcagtatgaggaagtatttatgcctgttactaccatctcatttccacctttgtttatcacccattctgccctccgaaggcagg

SEQ ID NO: 1705 - DNA, 1549 bp, Vigna unguiculata
ggtcagtaaacaatgggcgattttacggttgcgttaaaccctcccaaaaccttcggtgccgagattctatcacccatcaatcgcacttctgcggcggcgcgtgggcgcgtaaccaaaatcgctttcaaaccgcacggatttcgagcaatccgcgcctcggtgatgccgagagaaggccagcaacaaccgtctctgggagactctctcgtgaacagtcctcacagaaacgacgtcgttgatgttatcagaaggagcggactctctaactgcctctccgaaactaatctccataacaccgttcccggtctcgtgtccaaaacccgcggcaaagttcgagatatttacgacgccggggattaccttgttttggtgaccactgatcggcagagtgcgtttgataggattcttgcttccattcctttcaaaggccaggttttgaatgaaacaagtttgtggtggtttgaaagaactaagcagatagttcctaatgcagttgtatcggctccggataaaaatgttacaatagctaagaaatgctcagttttccctgttgagtttgttgcaagaggatttgtaactggaagtactgatacatctctatggacagtctacaacaagggttctcggaactattgtggaaatgtcctcccagatggaatggtaaaaaatcagaagttgtctgaaaatatactcactcctacaaccaaagctgcagatcatgatgttccagtcactccagatgagattatagaaaggggactgatgactcgatctgattatgaagcagtgagtgaaaaagcattatccttgtttgaatatggacagcaagtggcttcagagcatggcctcatattggtagacactaaatatgagtttgggaaggcaaatgatggttcaattatgttgattgatgaggtccatactcctgattcaagtagatattggattgccaattcttacctggagcgctttcaaaatggtcttgagcctgaaaatattgacaaggagttcttgaggctgtggtttaaaagtcactgcaacccatatgaagatgaggtccttcccgatgctcccgaagatctgttgtgagttatcctggcgatacattttcttgtacgagactataacaaactcaaagtttgagatgccattgacagaggagcctattcatgaccgaatttctcgaaatgttgcatctgcactgtcatctttaaagtagccgtggattttggggccatattgtagctcgtgttgtaatctcttactgtaatatatattaaaacttaaattaatggagaacttctccaaacaattttttatttttctaaagtaacttaaaacagagagagaacaattttcaatgctcttcgaatactttctagcttgtcatgacgacagtggtcggaaatttgacaccttgcagtttacttgtttttctaaaacagaaacgaataaagagctgtttctgaaaccagaacccaatgtgttattctttctcttgtatattcctcgtgacaacactatgggaagtaaatttcctcttcttttc

SEQ ID NO: 1706 - DNA, 1560 bp, Vigna unguiculata
agcagcttcagtttcagtaaacaatgggcgattttacggttgcgttaaaccctcccaaaaccttcggtgccgagattctatcacccatcaatcgcacttctgcggcggcgcgtgggcgcgtaaccaaaatcgctttcaaaccgcacggatttcgagcaatccgcgcctcggtgatgccgagagaaggccagcaacaaccgtctctgggagactctctcgtgaacagtcctcacagaaacgacgtcgttgatgttatcagaaggagcggactctctaactgcctctccgaaactaatctccataacaccgttcccggtctcgtgtccaaaacccgcggcaaagttcgagatatttacgacgccggggattaccttgttttggtgaccactgatcggcagagtgcgtttgataggattcttgcttccattcctttcaaaggccaggttttgaatgaaacaagtttgtggtggtttgaaagaactaagcagatagttcctaatgcagttgtatcggctccggataaaaatgttacaatagctaagaaatgctcagttttccctgttgagtttgttgcaagaggatttgtaactggaagtactgatacatctctatggacagtctacaacaagggttctcggaactattgtggaaatgtcctcccagatggaatggtaaaaaatcagaagttgtctgaaaatatactcactcctacaaccaaagctgcagatcatgatgttccagtcactccagatgagattatagaaaggggactgatgactcgatctgattatgaagcagtgagtgaaaaagcattatccttgtttgaatatggacagcaagtggcttcagagcatggcctcatattggtagacactaaatatgagtttgggaaggcaaatgatggttcaattatgttgattgatgaggtccatactcctgattcaagtagatattggattgccaattcttacctggagcgctttcaaaatggtcttgagcctgaaaatattgacaaggagttcttgaggctgtggtttaaaagtcactgcaacccatatgaagatgaggtccttcccgatgctcccgaagatctgttgtgagttatcctggcgatacattttcttgtacgagactataacaaactcaaagtttgagatgccattgacagaggagcctattcatgaccgaatttctcgaaatgttgcatctgcactgtcatctttaaagtagccgtggattttggggccatattgtagctcgtgttgtaatctcttactgtaatatatattaaaacttaaattaatggagaacttctccaaacaattttttatttttctaaagtaacttaaaacagagagagaacaattttcaatgctcttcgaatactttctagcttgtcatgacgacagtggtcggaaatttgacaccttgcagtttacttgtttttctaaaacagaaacgaataaagagctgtttctgaaaccagaacccaatgtgttattctttctcttgtatattcctcgtgacaacactatgggaagtaaatttcctcttcttttc

SEQ ID NO: 1707 - DNA, 1588 bp, Phaseolus coccineus
ttataagtcaagttgttttttaacccttcgcaaaacgcaaccatcgtcaacacagtaagagaagcagcttcagtttcagtaaacaatgggcgattttacggttgcgttaaacccttcccaaaccttgggcgccgagattctaccacccgtcaatcgcacttacgcggcggcgcgtgggcccgtaaccaaaatcgctttcaaaccgcacggatttcgagcaatccgcgcctcggtaatgccgagagaaggccagcaacaaccgtctctgggagactctctcgtgaacagtccgcacagaaacgacgtcgttgatgttatcagaagaagcggactctctaactgcctctccgaaactaacctccacaacaccgttcccggtctcgtgtccaaaacccgcggcaaagtaagagatatttacgacgctggggattacctcgttttggtgaccactgatcggcagagtgcgtttgataggattcttgcttccattcctttcaaaggccaggttctgaatgagacaagtttgtggtggtttgaaagaactaagcagatagtttctaatgcagttgtatcggctccggacaaaaatgttacaatagctaagaaatgctcagttttccctgttgagtttgttgcaagaggatttgtcactggaagtactgatacatctctatggacagtctacaataagggtgctcggaactattgtggaaatgtcctcccagatggaatggtaaaaaatcagaagctgtctgaaaatatactcactccaacaaccaaggctgcagatcatgatgttcctgtcactccggatgagattatagaaaggggactgatgactcgagctgattatgaagaagtgagtgaaaaagcattatccttgtttgaatatggacagcaagtggcttcagaacatggcctcatattggtagacactaagtatgagtttgggaaggcaaatgatggttcaattatgttgatcgatgaggtccatactcctgattcaagtagatattggattgccaattcttacctggagcgctttcaaaatggtctcgagcctgaaaatattgacaaggagttcttgaggctgtggtttaaaagtcactgcaacccgtatgaagatgaggtccttcctgatgctcccgaagatcttgtttgtgagttatcctggcgatacattttcttgtacgagactataaccaaatcaaagtttgagattccatcgaccgaggagcctatacatgaccgaatttctcgaaatgttgcatctgcactgtcatctttaaagtagcttgggaatttttggggccctattgttgctcgtgttgtaatctcttactgtaatatacattaaaacttaaactaatggagaacttctccaaacaattttttttctaaagtaatttaaactagaaagagataacaattttcaatgctctatgaatactttctagattgtcacgacatccttgcagtttccttttctaagaaacaaaaaaagaataaagggctgcttccgaaaccagaaaccaatgtatttttctgtcttgtatgttttcctcgtgacaacagtatgagaagtaaa

SEQ ID NO: 1708 - DNA, 1388 bp, Phaseolus coccineus
  misc_feature (1090)..(1090): n is a, c, g, or t
  misc_feature (1258)..(1258): n is a, c, g, or t
cttcagtttcagtaaacaatgggcgattttacggttgcgttaaacccttcccaaaccttgggcgccgagattctaccacccgtcaatcgcacttacgcggcggcgcgtgggcccgtaaccaaaatcgctttcaaaccgcacggatttcgagcaatccgcgcctcggtaatgccgagagaaggccagcaacaaccgtctctgggagactctctcgtgaacagtccgcacagaaacgacgtcgttgatgttatcagaagaagcggactctctaactgcctctccgaaactaacctccacaacaccgttcccggtctcgtgtccaaaacccgcggcaaagtaagagatatttacgacgctggggattacctcgttttggtgaccactgatcggcagagtgcgtttgataggattcttgcttccattcctttcaaaggccaggttctgaatgagacaagtttgtggtggtttgaaagaactaagcagatagtttctaatgcagttgtatcggctccggacaaaaatgttacaatagctaagaaatgctcagttttccctgttgagtttgttgcaagaggatttgtcactggaagtactgatacatctctatggacagtctacaataagggtgctcggaactattgtggaaatgtcctcccagatggaatggtaaaaaatcagaagctgtctgaaaatatactcactccaacaaccaaggctgcagatcatgatgttcctgtcactccggatgagattatagaaaggggactgatgactcgagctgattatgaagaagtgagtgaaaaagcattatccttgtttgaatatggacagcaagtggcttcagaacatggcctcatattggtagacactaagtatgagtttgggaagcaaatgatggttcaattatgttgatcgatgaggtccatactcctgattcaagtagatattggattgccaattcttacctggagcgctttcaaaatggtctcgagcctgaaaatattgacaaggagttcttgaggctgtggtttaaaagtcactgcaacccgtatgaagatgaggtccttcctgatgctcccgaagatcttgnttgtgagttatcctggcgatacattttcttgtacgagactataaccaaatcaaagtttgagattccatcgaccgaggagcctatacatgaccgaatttctcgaaatgttgcatctgcactgtcatctttaaagtagcttgggaatttttgggccctattcttgctcgngttgtaatctcttactgtaatatacattaaaacttaaactaatggagaacttctccaaacaattttttttctaaagtaatttaaactagaaagagataacaattttcaatgctcttcgaatactttatcg

SEQ ID NO: 1709 - DNA, 783 bp, Cajanus cajan
ggggactggatatttgacaataaagatccaaatttaaattattattatcattattccttttggtgccttatttcttagcctctcttggtataaatgtaatctcttggcatgcgtagtggattcatattcttatctaaccttctcactcaaactccttctaccctcattctctctactttctcttccttgcatctctaccttcctcttaccacaaggtaaacaacggagatggcagggtgcgaaaaagaagactatttcactgcccccaatgctgagacaacatccgcgggaaagtacggtaggcttgccccaaagaagaagcctttgatatcaaaagataatgaaagggcattctttgattcagctgactgggcattatgcaagcaaggtgctggagtgaatcaacaatctacaacagccgtggagacactgcaaccaaaactacagagaactccacatcagcagcttcctccaaggcgacctacatgcacacctggctaagataattttgttaattactctaatataatatgtaatgctctcaatttaataaaattttagtagtatttgcattactgaattatatattctatgcttgtattcagtaattgttcatccattgtaatgcaaggagagtagctttaataagcagaacaaggatttgctcagtcaattttactattccaaaactcatgattttcctgatcatgatctgatgtatattacaatttacctcatgttttctactattaacagttcaataaaaacttcatttcaattccc

SEQ ID NO: 1710 - DNA, 470 bp, Phaseolus coccineus
ctcttaccacacggtaaacaaaaatgtcagggtgtgacaaggaagactatttcactgccccggatgctgagacaacatctgggggaaagtatggttcacttgtcccaaagaagaagcctttgatatcgaaagacaatgaaagagccttctttgattcagcagactgggcattaggcaagcaaggtgctggagtgaatcaacaatctacagcagcagtggagacactgcgaccaaaactacaaagaactccacaccagcaactccctccaagacgacctgcatgcacatctggttgagataatttcgtgaataactctaatatggagaatagatttaataagtggaacaaggattgctcagtcagtttcagtgttacaaaaactaatgatgttcctgatctatgtatattacaatttacttcatgttttctattaattagcagttcaataaaagtttcatttcgattccta

SEQ ID NO: 1711 - DNA, 593 bp, Vigna unguiculata
ctccttcctgcatctctaccttcctcttaccacaaggtaaacaaaaaatgtcaggatgtgacaaggaagactatttcaccgcccaagatgctgagacaacatctggggggaagtatggtacacttgtcccaaagaagaagcctttgatatcgaaagataatgaaagagccttctttgattcagcagactgggcattgtgcaagcaaggtgctggagtgaatcagcaatctacagcagcagtggagacactgcgaccaaaactacaaagaactccacaccagcaactccctccaagacgacctgcatgcacatctggttgagataatttcgtgaataactctaatatgtaatgctccaactgcagtaattttttgcagcatttgcatcatgaatgtgtaataaataatttaaagtccattgaaatgcagggagaatagatttaataagtggaacaaggattgctcagtcaatttcagtgttgcaaaaactaatgatgttcctgatctctatgtatattacaatttacttcatgttttctattaactagcagttcaataatagtttcatttcgattcccaaaaaaaaaaaaaaaa

SEQ ID NO: 1712 - DNA, 641 bp, Vigna unguiculata
cctcattctctatactttcttctctttaacactttctctcacttttttctccttcttgcatctctaccttcctcttaccacaaggtaaacaaaaaatgtcaggatgtgacaaggaagactatttcaccgcccaagatgctgagacaacatctggggggaagtatggtacacttgtcccaaagaagaagcctttgatatcgaaagataatgaaagagccttctttgattcagcagactgggcattgtgcaagcaaggtgctggagtgaatcagcaatctacagcagcagtggagacactgcgaccaaaactacaaagaactccacaccagcaactccctccaagacgacctgcatgcacatctggttgagataatttcgtgaataactctaatatgtaatgctccaactgcagtaattttttgcagcatttgcatcatgaatgtgtaataaataatttaaagtccattgaaatgcagggagaatagatttaataagtggaacaaggattgctcagtcaatttcagtgttgcaaaaactaatgatgttcctgatctctatgtatattacaatttacttcatgttttctattaactagcagttcaataatagtttcatttcgattcccaaaaaaaaagaaaaaa

SEQ ID NO: 1713 - DNA, 809 bp, Cajanus cajan
tacttggatatttgacaataaagatccaaatttaaattattattatcattattccttttggtgccttatttcttagcctctcttggtataaatgtaatctcttggcatgcgtagtggattcatattcttatctaaccttctcactcaaactccttctaccctcattctctctactttctcttccttgcatctctaccttcctcttaccacaaggtaaacaacggagatggcagggtgcgaaaaagaagactatttcactgcccccaatgctgagacaacatccgcgggaaagtacggtaggcttgccccaaagaagaagcctttgatatcaaaagataatgaaagggcattctttgattcagctgactgggcattatgcaagcaaggtgctggagtgaatcaacaatctacaacagccgtggagacactgcaaccaaaactacagagaactccacatcagcagcttcctccaaggcgacctacatgcacacctggctaagataattttgttaattactctaatataatatgtaatgctctcaatttaataaaattttagtagtatttgcattactgaattatatattctatgcttgtattcagtaattgttcatccattgtaatgcaaggagagtagctttaataagcagaacaaggatttgctcagtcaattttactattccaaaactcatgattttcctgatcatgatctgatgtatattacaatttacctcatgttttctactattaacagttcaataaaaacttcatttcaaattaccaaaaaaaaaaaaaaaaagtaactaact

SEQ ID NO: 1714 - DNA, 588 bp, Glycine max
atattcttatccaaccttctcactcaaacctcttctatctcattgtctctacctctcttttctcccctttaatacctttttctctcactttctcttccttgcatctctaccttcctcttaccacaaggtaaacaaagatggcagggtatgataaggaagactatttctctgccccgaatgccgagacaacatgcgcgggaaagtacggtaggcttgccccaaagaagaagcctctgatatcgaaaaataatgaaagagcattctttgattcagcagactgggcattatgcaagtctcaacagcaaggtgctggagtgaatcaacaatctacaacagctgtggagacattgcgaccaaaactacagagaactccacatcagcagcttcctccaagacgacctgcatgcacatctggttgagataatttcgtgaattactctaatgtggagagtagacttaataagtggaacaaggatttgctcagtcaattttactattacaaaactcatgatgttcctgatctgatatatatatatttacttcatgctttctattattagcacttcaatgaaaatttcatttcatttc

SEQ ID NO: 1715 - DNA, 584 bp, Phaseolus coccineus
gatgcatattcttatctaaccctctcactcaaaccccttctacctcattctctctgctttcttctctttaacactttctctcactttctcctccttgcatctctaccttcctcttaccacaaggtaaacaaaaatgtcagggtgtgacaaggaagactatttcactgccccagatgctgagacaacagctgggggaaagtatggttcacttgtcccaaagaagaagcctttgatatcaaaagataatgaaagagccttctttgattcagcagactgggcattatgcaagcaaggtgctggagtgaatcaacaatctacagcagcagtggagacactgcaaccaaaactacaaagaactccacaccagcaactccctccaagacgacctgcatgcacatctggttgagataatttcgtgaataactctaatatggagaatagatttaataagtggaacaaggattgctcagtcagtttcagtgttacaaaaactaatggtgttcctgatctatgtatattacaatttacttcatgttttctattaattagcagttcaataaaagtttcatttcgattcccttttc

SEQ ID NO: 1716 - DNA, 683 bp, Lotus japonicus
ggatccatattcttatctaaccttctcactcaaacacccttctcacttcatttgtctctactttttttatcttttccccttaagaacttctcttcagtgttctcttccccgcatctctaccttcctcttaccacaaggtaaacgaagatggcagagtgtaacagggaagactatttcactgccccgaatgttgagacaacatccacggctaagaagtacggtgggcttgtcccaaagaagaagcctttgatatccaaagacaatgaaagggcattctttgattcagcagactgggcattatgcaagcaaggtgctggggtgaatcaacaatctactgcagctgtagaaactctgagaccaaaactccagagaactccacatcaacaacttccccccagacgacctgcatgcacatctggttgagataatttcggagagtagatgtaataaatgggtcgaggatgtgctcagtcaattttacgaagctcattatgttgttgatcttattgattgatatgtatattacaattcgcttgatgctttgaattattggcacatcaataaaaatccgtttcaattcctttttatttcttccatggagcttcgatccattgaacctaaagaggataattggatgtggtgggttcaatctcataattcaatatcacataatttcttcctac

SEQ ID NO: 1717 - DNA, 395 bp, Glycyrrhiza uralensis
gcttttgttctatcccattgtctctaccttttttttttttatctccccctttaggacttttctctctggttttctcttctctgcatctctaccttcctgtcaccacaaggtgaacggagatggcagagtgtaacagagaagactatttcgctgcccctgataatgctgagtcaacatccgcgggaaagaagtacggtgggcttgtcccgaagaaaaagcctttgatatccaaagataatgaaagggcattctttgactcagcagactgggcattatgcaagcaaggtgctggagtgaatcaacaatctacagcagccgtagagaccctacgaccaaaactacagagaactccacatcagcagcttcccccgagacgacctgcatacacatctggt

SEQ ID NO: 1718 - DNA, 622 bp, Medicago truncatula
aagggagtgagatgggatctcagatctaggagttccttgattgaagtcagtacggcatttggtgtggatgtatattcttatctaaccttctcactcaaacctctcttctttgtctctactttttatcttttttctttgggttttatctcttctcttgcatctctaccttgctcccaccacaaggtaaaggagatggcagagtttaacagagaagaatattttgctgccaataacattgagtcaacatccgtgggcaagaagtatggtgggcttgtcccaaagaaaaagcctttgatatccaaagataatgaaagggcattttttgattcagcagactgggcattatgcaagcaaggtgctggaatgaatcaacaatctacagcagccgtagagaccctacgaccaaaactacagagaactccacatcagcagcttcccccaagaagacctgcatgcacatctgggagattagattcaacaattggcacaaggatttgctcatgagttaattttataaatttcatgatgttctagctggtctcatgtatatatattaccattagttcacttgatgcttttgattattggcagttaaataaaagtctatttcaatttcttttta

SEQ ID NO: 1719 - DNA, 543 bp, Medicago truncatula
ctcaaacctctcttctttgtctctactttttatcttttttctttgggttttatctcttctcttgcatctctaccttgctcccaccacaaggtaaaggagatggcagagtttaacagagaagaatattttgctgccaataacattgagtcaacatccgtgggcaagaagtatggtgggcttgtcccaaagaaaaagcctttgatatccaaagataatgaaagggcattttttgattcagcagactgggcattatgcaagcaaggtgctggaatgaatcaacaatctacagcagccgtagagaccctacgaccaaaactacagagaactccacatcagcagcttcccccaagaagacctgcatgcacatctggttgagataaattcggagattagattcaacaattggcacaaggatttgctcatgagttaattttataaatttcatgatgttctagctggtctcatgtatatatattaccattagttcacttgatgcttttgattattggcagttaaataaaagtctatttcaatttcttttta

SEQ ID NO: 1720 - DNA, 463 bp, Cicer arietinum
cacttgtgctatattaattggctatgcttgtacatcatttaccatcacccttctttttgttattctctcctttctctaatattatcttgctctgttcgtaaagggagatggcagagtgtaatagagaagactattttgctgccaatgatgttgagtcaacatccgcagaaaagaagtatggtgggcttgtcccaaagaaaaagcctttgatatccaaagatactgaaagggcattctttgattcagcagactgggcattatgcaagcaaggtgctggagtgaataaacaatctacagcagccgtagagaccctacgaccaaaattacagaaaactccacatcagcggcttcccccaagaagacctgcatgcacatctggttgagataaatttggggagtagatctaataacttacacaaggatttgctcataagtccattttataaatctcgtgatgtttcta

SEQ ID NO: 1721 - DNA, 343 bp, Prunus persica
gtccttatttctgttgcatctctcactttgctcttccacaaggagagccaaagatggcggattgcaacagaggagaagactatttctctgcccaagaccatgaggcgtcaacagttgtccagaaatatggaggacttgcgccaaagaagaagcctttaatttcgaaggatcatgaacgtgccttctttgattcagcagattgggcactatgcaagcaaggtgcaggggtgaatccaaaatcaacagcagccgtggagaccttacggccaaaactgcagagaacgccacaccagcagctccctccaaggagacctgcctgtacatctgatcatgatatatagcc

SEQ ID NO: 1722 - DNA, 1047 bp, Glycine max
cttcttttcttaaatagatagatagaagaaaaggcttcaaaaccagtggtacatattatctcaagcaccatgtggatcagagggttctttcattttgttcctcccacgcatatttctgaccaaaaccattaacaaatcagtgacagaaaaaaaaatggttggtgactaaacagaaaaaataaataaaaaaagaacacaatcaaagcattaagagaggaataatgcaaatggcaattttgttaagaggaggagcacttggagattctagctttcgtttgtgttcattaacatcaacttcttctttgcatgtctcccaaaatgttgccatacccacctcatcatcatcatcatcatcactagtactacctttgattgcaagtaaatttaaaacggtcagcagaatcagaatcacctgctctgctgttcaagaatcatctcctagcacagcagctactgctgaaacaaaggaggaggtaaaggaagctccaaaagccgaaccggcaaagaaacctcctgctaaagctccagctaagcctctgcctcagatgatggaggaggatgtgatcccttcactgaaatcaatatttgaagcccaagaagatttctcaaatattgagctggtcttcaaggacaataagttggaaggttcctttttgaagaaaggcaacccctattcattttgggcattttttcccacaggaaaccttattggtccaaaggggttttctctgtcatcgtataactcgggagcaagcaccgttgagccatttctcattgatgaaaagaagattactgcaagacacattatcttttgggttaaaaaacgtttggcagcacaagggatcattcctgtatgggaagattaatcttttaaaaattaaattatactttggttgctaatgatgtggcatacaattcaatattctcttgttcctttcattaatgactatgatatacatagtggttgtgttggtcaatgtgccattgtacatgtctttcatcatagaacattttgttgatcaatgcacaagtttttgatcatttggt

SEQ ID NO: 1723 - DNA, 1087 bp, Cajanus cajan
tcctagattgtatatttatttatttattcttaaatagatagatagaagaaaaggcatcaaaaccagtggtacatattatctcaagcaccatgtggatcagagggttctttcattttgttcctcccacgcatatttttcactaaaaccattaacaaaccagtgacagaaaaaaaaatggttggtgactaaatagaaaaaaaaaaaaaataagagaacacaatcaaagcactaagagtggaagaatgcaaatggcaattttgttaaggggaggagcacttggagattctacctttcgtttgtgttcattaccatcaacttcttctttgcatgtctcccagaatgttgccatacccacctcatcatcatcaccaatactacctttgattgcaagtaaatttaaaacagccagcagaaacagaatcacctgctctgctgttcaagaatcatctcctagcacagcagctactactactgaaacaaaggaggaggtaaaggaagctacagaagctccaaaagctgcaccagcaaagaaacctcctgctaaagctccagttaagcctctgccccagatgatggaagaggatgtgatccctgcactcaaagaaatatttgaagcccaagaagatttctccaatattgagctcattttcaaggacaataagttggaaggttcatttttgaagaaaggcaacccctatacattttgggcattctttcccacaggaaatgtcactggtccaaaggggttttctttgtcatcgtataacgcaggagcaagcactgtcgagccatttcttattgatgaaaagaagattacagcaaaacacataatcttctgggttgaaaaacgtttggcagcacaggggatcattccagtatggaaagattaatctcttaaaaaatgaaattatactttggttgctaatgatgtacaatacaattcaatattctctgcgttcctttcattaatgactatgatatacatagtaattgtgttgatcattgtgtcaatgtaatagaaaatttagttcatcaatgcgcagtcagatcaataatataaaaaaatttaagtttttagtttatcaaa

SEQ ID NO: 1724 - DNA, 917 bp, Cajanus cajan
actaaaaccattaacaaaccagtgacagaaaaaaaaatggttggtgactaaatagaaaaaaaaaaaaaaataagagaacacaatcaaagcactaagagtggaagaatgcaaatggcaattttgttaaggggaggagcacttggagattctacctttcgtttgtgttcattaccatcaacttcttctttgcatgtctcccagaatgttgccatacccacctcatcatcatcaccaatactacctttgattgcaagtaaatttaaaacagccagcagaaacagaatcacctgctctgctgttcaagaatcatctcctagcacagcagctactactactgaaacaaaggaggaggtaaaggaagctacagaagctccaaaagctgcaccagcaaagaaacctcctgctaaagctccagttaagcctctgccccagatgatggaagaggatgtgatccctgcactcaaagaaatatttgaagcccaagaagatttctccaatattgagctcattttcaaggacaataagttggaaggttcatttttgaagaaaggcaacccctatacattttgggcattctttcccacaggaaatgtcactggtccaaaggggttttctttgtcatcgtataacgcaggagcaagcactgtcgagccatttcttattgatgaaaagaagattacagcaaaacacataatcttctgggttgaaaaacgtttggcagcacaggggatcattccagtatggaaagattaatctcttaaaaaatgaaattatactttggttgctaatgatgtacaatacaattcaatattctctgcgttcctttcattaatgactatgatatacatagtaattgtgttgatcattgtgtcaatgtaatagaaaatttagttcatcaatgcgcagtcagatcaata

SEQ ID NO: 1725 - DNA, 877 bp, Vigna unguiculata
ggactgaaagaaaaaaaaaatggttggtgactaaacagaaaaaaaagagagaagaaaagtaaaagaacacaatcaaagcatcaagagagaaagaatgcaaatggcaactttgttaagaggtggagcacttgcagattctagctttcgtttgtgttcattaccatcaacttcttctctgcatgtctctcagaatgttgccatacccacatcatcatcatcatcatcaccaatactacctttgattgcaagtaaacataaaacagtcagcagaagcagaatcacctgctctgctgttcaagagtcatctcctagcacagcagctactgctgaaacaaaggaggaggtaaaggaagctccaaaagctgcaccagaaaaaaaagctccagctaaagcaccagttaagcctctacctcagatgatggaggaggatgtgatcccttcactgaaagcaatatttgaagcccaagaagatttatcaaacattgagctagtctttaaggataataggttagaaggttccctcttaaagaaaggcaacccctactcattttgggccttctttcccacaggactcatcggtccaaaggggttttctctgtcatcatataacggaggagcaagcactgttgagccatttcttgttgatgaaaagaaggtgacagcaaaacacattatattttgggtggaaaaacgtttggcagcacaggggatccttcctatatggaaagattaatttgtaaaagatgaaattatagtttggttggtaatgatgtgtagcatacaattcaatattctcttgttcctttcattaatgactgctatacaaaatcattatgttcattgtacacgtcttcaatcataggatattttgttcata

SEQ ID NO: 1726 - DNA, 1216 bp, Phaseolus coccineus
tcccagtttctaagtttatttatttatttttcttaaacagatagatagaagaaaaggcttcaaaaatcagtggtacatattgtctcaagcaccatgtggatcacaagctagcttctttcattttgttcctcccacgcatatttctgaccaaaactgttaacaaaatcactgaaagaaaaaatggttggtgactaaacagaaaaaagagaaaagcaaagtaaaagaacacaatcaaagcatcaagagagaaagaatgcaaatggcaattttgttaagaggtggagcacttgcagattctagctttcgtttgtgttcattaccatcaacttcttctttgcatgtctctcagaatgttgtcatacccacctcatcctcatcatcatcaccaattctacctttgattgcaagtaaatataaaacagccagcagaaacagaatcacctgctctgctgttcaagaatcatctcctagcacagcagctactgctgaaacaaaggaggaggtaaaggaagaagctccaaaagctgcaccagcaaaaaaacctccagctaaagcaccagttaagcctctacctcagatgatggaggaggatgtgatcccttcactcaaagcaatatttgaagcccaagaagatttatcaaacattgagctagtcttcaatgacaataggttagaaggttcccttttgaagaaaggcaacccctactcattttgggcattcttccccacaggaatcactggtccaaaggggttttctctgtcatcatataatggaggagcaagcactgttgagccatttcttgttgatgaaaagaagatcacagcaaaacacattatcttttgggttgaaaaacgtttggcagcacaggggatccttcctatatagaaagattaatctctaaaagatgaagttatagtttgattgctgatgatgtagcatacaattcaatattctcttgttcctttgattattgaatcgtatacaaaatgattatgttgatcaatgcctcattgtacatgtcttcaatcataggatcttttggtgatcaatgcacatgtttatgataatttggtaacaaaacaacacattttaaatctcatttcaccttttccaggtactatcatgagtaatttggccataaaaaaatacgtgtaacttttccctattattctattgtttattgtcacgtaaatgtcaatttctagattttatgat

SEQ ID NO: 1727 - DNA, 845 bp, Phaseolus coccineus
tcactgaaagaaaaaatggttggtgactaaacagaaaaaagagaaaagcaaagtaaaagaacacaatcaaagcatcaagagagaaagaatgcaaatggcaattttgttaagaggtggagcacttgcagattctagctttcgtttgtgttcattaccatcaacttcttctttgcatgtctctcagaatgttgtcatacccacctcatcctcatcatcatcaccaattctacctttgattgcaagtaaatataaaacagccagcagaaacagaatcacctgctctgctgttcaagaatcatctcctagcacagcagctactgctgaaacaaaggaggaggtaaaggaagaagctccaaaagctgcaccagcaaaaaaacctccagctaaagcaccagttaagcctctacctcagatgatggaggaggatgtgatcccttcactcaaagcaatatttgaagcccaagaagatttatcaaacattgagctagtcttcaatgacaataggttagaaggttcccttttgaagaaaggcaacccctactcattttgggcattcttccccacaggaatcactggtccaaaggggttttctctgtcatcatataatggaggagcaagcactgttgagccatttcttgttgatgaaaagaagatcacagcaaaacacattatcctttgggttgaaaaacgtttggcagcacaggggatccttcctatatagaaagattaatctctaaaagatgaagttatagtttgattgctgatgatgtagcatacaattcaatattctcttgttcctttgattattgaatcgtatacaaaatgattatgttgatcaatgcctc

SEQ ID NO: 1728 - DNA, 739 bp, Vigna unguiculata
tggcaactttgttaagaggtggagcacttgcagattctagctttcgtttgtgttcattaccatcaacttcttctctgcatgtctctcagaatgttgccatacccacatcatcatcatcatcatcaccaatactacctttgattgcaagtaaacataaaacagtcagcagaagcagaatcacctgctctgctgttcaagagtcatctcctagcacagcagctactgctgaaacaaaggaggaggtaaaggaagctccaaaagctgcaccagaaaaaaaagctccagctaaagcaccagttaagcctctacctcagatgatggaggaggatgtgatcccttcactgaaagcaatatttgaagcccaagaagatttatcaaacattgagctagtctttaaggataataggttagaaggttccctcttaaagaaaggcaacccctactcattttgggccttctttcccacaggactcatcggtccaaaggggttttctctgtcatcatataacggaggagcaagcactgttgagccatttcttgttgatgaaaagaaggtgacagcaaaacacattatattttgggtggaaaaacgtttggcagcacaggggatccttcctatatggaaagattaatttgtaaaagatgaaattatagtttggttggtaatgatgtgtagcatacaattcaatattctcttgttcctttcattaatgactgctatacaaaatcattatgttca

SEQ ID NO: 1729 - DNA, 1071 bp, Medicago truncatula
tttctaaattaaatagatagatagaagaggcagaaaaatcagtggcacatattgtctcaaaaaccatgtggatcagaaggttcattcattttgttcctccaacgtatgcttctgacaaaaaccatcaataaaccagtaacagaaaatggaatagaaaataaaaaataataagaaaagaacacacaagaatcataatgcaaatggcacttttgttaagaggtggagcacttggagattctagctttcgtttgtgttctttaacttcaacctcttcttctttgcatgtctctcaaaatgttgtcatacccaactcaacatcatcaccaatattacctttgattgcaagtagatttaaagcagtaagcagaaacaagattacttgctctgcagttcaagaatcatctactagtacatcagctactgctgaaacaaaggaggaggtaaaggaagaagctccaaaagcagcagcagtaaagaagactcctgctaaagctccagttaagcctttacctcagatgatggaggaggatgtgattccttcattgaaagcaatattagaagcccaacaagatctctctgatattgagctggtttttcaggacaataagttggaaggttcatttctgaaaaaaggcaatccctattcattttgggccttctttcccacaggacttacaggtccaaaggggttttctctgtcatcatataactcaggagctagcactgttgaaccgtttctagttgatgagaagaaagttaattcaaaactcattgtcttttgggttgaaaaacgtttggcagcacaagggattattcctgtatggaaagattgattctcataaacaaattttcattttggttgcaaatgatgtagcatacatttcaccattctcttgtaccttggctcattgactatgtggtgtatggtatataaagtgttgttttgatcaatgtgcaactaattgtatatgattttatgaacacgtttgttgatcattgcctgggtttgtgatcattatttggttaaaaaaccacttttttaagctcatttcagattgtcacatggcctaa

SEQ ID NO: 1730 - DNA, 908 bp, Medicago truncatula
cagtggcacatattgtctcaaaaaccatgtggatcagaaggttcattcattttgttcctccaacgtatgcttctgacaaaaaccatcaataaaccagtaacagaaaatggaatagaaaataaaaaataataagaaaagaacacacaagaatcataatgcaaatggcacttttgttaagaggtggagcacttggagattctagctttcgtttgtgttctttaacttcaacctcttcttctttgcatgtctctcaaaatgttgtcatacccaactcaacatcatcaccaatattacctttgattgcaagtagatttaaagcagtaagcagaaacaagattacttgctctgcagttcaagaatcatctactagtacatcagctactgctgaaacaaaggaggaggtaaaggaagaagctccaaaagcagcagcagtaaagaagactcctgctaaagctccagttaagcctttacctcagatgatggaggaggatgtgattccttcattgaaagcaatattagaagcccaacaagatctctctgatattgagctggtttttcaggacaataagttggaaggttcatttctgaaaaaaggcaatccctattcattttgggccttctttcccacaggacttacaggtccaaaggggttttctctgtcatcatataactcaggagctagcactgttgaaccgtttctagttgatgagaagaaagttaattcaaaactcattgtcttttgggttgaaaaacgtttggcagcacaagggattattcctgtatggaaagattgattctcataaacaaattttcattttggttgcaaatgatgtagcatacatttcaccattctcttgtaccttggctcattgactatgtggtgtatggtatataaagtgttgttttga

SEQ ID NO: 1731 - DNA, 801 bp, Lotus japonicus
ggatcaacaaaccagtacagaaaaaatggttggtgattaaacagaaagaaaaaataacacaaaacaaaagtagcattaggataggaagcatgcaaatggcaatttcattaagaggaggagcacttggagatcccagctttcgtttgtgttcattaaactcaacttcttctttgcatgtttcccagaatgttgtggtacccacctcatcatcatcatcaccagtgctacctttgattgcatgcaaaattaaaacagccagtagaagcaagatcatctgctctgctgttcaggaatcatctcctagtacatcagctaccactgaaacaaaggaggaggaggtaaaggcagctccaaaagctgctgcagaaaagaagcctcctgctaaagctccagtaaagcctctacctcagatgatggaggaggatgtgatcccttcattgaaagaaatatttgaagcccaggaagatctttctgatattgagctagtctttcaggacaataagttagaaggttcctttttgaagaaaggcaatccctatttattttgggccttcttccccaccggaaaccttactggtccaaaggggttttctgtatcatcctataactcacgagcaagcactgttgagccatttcttgttgacgaaaagaaaattacagctaaacacattgtcttctgggttgaaaacgtttggcagcacagggatcattcctgtttggaaagatagtatgtcgaaataaatttcatttggttgcaatgatgtagcatacagctcatattctcgtcattggttatgacat

SEQ ID NO: 1732 - DNA, 906 bp, Cicer arietinum
aataataataataataaaaaaacgaacacagaagattcattaggaaaagaagaatgcaaatggcacttttattaagaggtggaacacttggagattctagctttcgtttgtgttctttaacttcatcctcttctgcttcgcatgtatctcaaaatgttgtcataccaacttcatcatcatcaccaatactacctttgattgcaagtagatttaaaacattcagcagaaacaagatcacttgctctgcagttcaagaatcatctactagtacatcaactagtgctgaaacaaaggaggaggtaaagacagttccaaaagcagcaacagaaaagaaggcacctgctaaagctccagttaagcctttacctcagatgatggaagaggatgtgattccttcattgaaaacaatattagaagcccaacaagatctctctgacatcgatcttgtctttcaggacaataagttggaaggttcctttttgaaaaaaggcaatccatattcattttgggccttctttcccacaggaattactggtccaaaggggtttgctctgtcatcttataactcaggagcaagtactgttgaaccgtttctgattgatgagaagaaaattacttcaaaacacattgtcttttgggttgaaaaacgtttggcagcacaggggattattcctgtatggaaagattgatgcttaaaaaggaatgtaaattttaattgcatatgatgtagcacactattcaatatcctcgtcccttggcttattgactatggtatacatacagtgttgttttgatcgatgtgcaattaattgtataagattttacgaacacgttttttgatcaatgcacaggtttttgatcatttggtattaagacattgttttaatctcatttcagatttataca

SEQ ID NO: 1733 - DNA, 821 bp, Trifolium pratense
  misc_feature (298)..(298): n is a, c, g, or t
  misc_feature (323)..(323): n is a, c, g, or t
  misc_feature (418)..(418): n is a, c, g, or t
  misc_feature (433)..(433): n is a, c, g, or t
  misc_feature (748)..(748): n is a, c, g, or t
  misc_feature (774)..(774): n is a, c, g, or t
caaaaaatgaaatagaaaataaaaataataacaaagaatgcaaatggcacttttgttaagaggtggaacacttggagagtctagctttcgtttgtgttcttttacttcaacctcttctttacatgtctctcaaaatgttgtcataccaaactcatcatcatcaccaatactacctttgattgcaagtagatttaaaacaatcagcagaaacaaaatcatttgttctgccgttcaagaatcatctactagtacatcagctactgctgaaacaaaggaggaagtaaaggcagcagctccnaaagcagcaacagaaaagaaggctnctgctgctaaagctccagttaagcctttacctcagatgatggaggaagatgtgattccttcattgaaagcaatattagaagctcaacaagatctntctgatcttcagctngtctttcaagacaataagttggaaggttccttttcgaaaaaaggaaatccctattcattttgggcattctttcccacaggacttactggtccaaaggggttttccttatcatcttataactcaggagcaagcactgttgaaccatttctggttgatgagaagaaagttactgcaaaactcattgtattttgggttgaaaaacgtttggcagcacaggggattattcctgtatggaaagactgattcttcaaaaagatttttcattttggttgcaaatgatgtagtagtatacagttcaatattctcttgtatctnggctaattgactgtggtatatggtanatataaagtgttgtttgatcaatgtgccattttttgtatgctttgaa

SEQ ID NO: 1734 - DNA, 3041 bp, Glycine max
attccctttattctctctctctctttccttcctttgatccatggaagcctgtgatctcttgtgatagttggtgtgttgggtagggaagggtttgaaagtgtcgtgtcttctaaggagctttcactgcacgacggtggccgaatcttcttgcttctttctctttccaagatatcctttgattcaactttggatcttcacctctgatttcctttcatttttcggtttatacacacttggggtttcccctcacccaactgtgtgcaacaaccacaaagtgtataccgtgtgttcttcctagaggggggaaaaatggctacactttcagatattggggttgcagctggcttgaacattttgagtgcatttattttctttgtggcatttgctattttgagacttcaaccttttaatgatcgggtatacttcccaaaatggtacctgaagggtttaagaacagatcctgtgcacggaggagcgtttgtgcgcaagtttgtcaatttagattggagatcataccttaggtttttgaattggatgccagctgcacttagaatgccggaacccgaactcattgaccatgctggattggactctgttgtttacttgaggatttacttgataggacttaaaatctttgttccaatagcatttctggcatgggcagttctggttcctgtcaacgccacaagtaccggtctagaaagcgctggtcgggacaacataacttcgagtgacattgataaactctcaatttcaaacgtccatagtcgatctgaaaggttttgggcacacatactagttgcttatgcatttaccttttggacatgctatattttactaaaggagtatgaaaaagttgcctcaatgagattgcaatttcttgcagctgaaaaacgccgacctgatcaatttacggtgctcgttagaaacattccaccagatcctgatgaatctgtaagtgagcttgtggagcacttttttctggtcaaccatccagataactatcttactcaccaggttgtttataatgcaaacaaacttgcaaagttggttaaaaagaagaagaagttgcagaattggcttgtatattatcaaaacaaagttgaaagaacttcagaaaggcctcaaataaagactggcttccttggtctttgcggaaacaaagtagatgctatcgatcatcacaacactgaaattgacaaactgtcaaaggaaatagcgttagagagggataatgtcagcaatgatcccaagtccatcatgcctgcggcatttgtttcgtttaaaacacgatggggtgctgcagtttgtgcacaaacccaacaaaccagaaacccaacaatgtggttgacagagtgggcgccagagccacgtgacatctattggtcgaatttggcaattccatatgtttccctcaccgtgagaaggttgatcatggctgttgcattcttttttctcaccttcttttttatgatcccaattgcaattgtacaaggtcttgcaagtattgagggaatccgcaaaagagcaccatggttaaatcctcttattgatattcctttcattaagtcgttcattcaaggttttctacccggtattgcattgaagctttttctcatcttcttgccaacaatattgatgatcatgtcaaaatttgaaggctttggatctatttcatctctggagagaagagcagcttctagatactatcttttcaattttgtgaatatatttcttgggaacatacttaccggaacagcatttgaacagctggactctttcattcaccaaccagccaatgaatatcctattacaattggcactgcaattcctttgaaagcaagtttcttcatcacttatataatggttgatggatgggctggtatagctgcagaggttttgatgttgaaacccctaatcatatatcacttgaagaattttttcttggtgaagactgaaaaggatagggaagaggctatggatcctgggagtattggcttcaacactggagaacctcgaatacagttgtactttttgctgggtctagtctatgcttcagttacacctactgttcttcctttcataatagttttctttgggctcgcctatgttgtgttccgtcatcagattatcaatgtttataatcaagagtacgagagtggtgcagcattctggcctgatgtccattttcgtgtcattattgcactgatagtgtcacagatagttctgatgggactccttaccactaaagaggctgcttcatcaactccatttctaattgtactcccagtactgacgatatggttccatatatactgcaaaggccgtttcgaacctgcatttgttagatatcccttacaggaagcgatgatgaaagacacattggaacgagctacagatcccaactttaacttgaaagcttaccttcagaatgcatatgttcatccagttttcaaagctagcctttttgatgaggacgaagaggacgaagaggtaatgagtctaaagttggaaactgagagtgtaactgtgcccacaaaacggcaatcaagaaggaacacaccattggctagcagaattagtggtgcatcatctccttctctgcctgatcatggcatccgaaatcataatccagagccataaatcatggaccaaggattcatatcattgttattggaccgaccacatatgtaacatacaatgggctacacatgcttccagcataaactgagagaagcaagctagtgtgatcggcacaaactgtaaggtagagattctttgatatattattatttccgattttgttaatagtgaatttgttcccttacaccacggaatgctgtaaattatcccagaacttgtcatggtttagatcgtgtgtatatttttttcttcttttttttaccttatgcttttccttcggattcagctcagtttatatgaggaaaaaaagtgtgtttgcacttgtgcacgtttttaagttttaacacaatcaatgaacgactttcctttacgtttaatatttgcctttttttagccac

SEQ ID NO: 1735 - DNA, 2781 bp, Phaseolus coccineus
tttcttttgattgttttacaggtgcatacagtgtgttctgtctagactttctagagggcaaagaaaatggctacacttgaagatattggggttgcggctgggttgaacattttgagtgcttttattttctttgtggcatttgctattctgaggcttcaacctttcaatgatcgtgtgtacttcccaaaatggtacctgaagggtctaagaacagatcctgtgcatggaggagcgtttgtgcgcaagtttgtgaatttagactggagatcatatattaggtttttgaattggatgccagctgcacttagaatgccggagcctgaacttattgaccatgctggattggactctgctgtttacttgaggatttacttgataggacttaaaatctttgttcctatagcattcctggcatgggcagttcttgttcctgtcaattccacaagtaccgggctagaaggggcaaaactggacaacataacttccagcgacattgataaactctcgatttcaaatgttcatagtgaatctcaaaggttttgggcacatattgttgttgcttatgcatttaccttttggacatgctatattttaaaaagggagtatgaaaaagttgccgcaatgagattgcaatttcttgctgcagaaaaacgccgtcctgatcaatttacggtgctcattaaaaacattccaccagatcctgatgaatctgtaagtgagcttgtggagcatttttttctggtcaatcatccagataactatcttactcaccaggttgtttataatgcaaacaaactatcaaagttggttaaaaagaagaagaagttgcagaattggcttgtatattaccaaaacaaacttgaaagaacctcagaaagacctcaagtaaagactggtttccttggtctttgcggaatgaaagtagatgctattgatcatcacaacactgaaattgacagattgtcaaaggaaatagctttagagagagatacggtcaccaatgattccaactctgtcatacctgctgcatttgtttcgtttaaatcacgatggggtgctgcagtttgtgcacaaacccaacaaaccagaaatccaacactgtggttgagtgagtgggctccagagccacgagacgtctattggtcaaacttgtcgattccttatgtttccctcagtattagaaggttgatcattgctgttgcattcttttttctcaccttctttttcatgatcccaattgcaattgtacaaagtcttgcaagtattgacggaatccagaaaagagcgccatggttggatcctattattaatgttcctttcattaagtcattcattcaaggttttctacctggtattgcattgaagctttttctcatctttttgccaacaatattgatgatcatgtcaaagtttgaaggctttggatctatttcatctctggagaggagatcagcttctagatactatcttttcaatcttgttaatatatttcttgggaacatacttaccggaacagcatttgaacagctggacactttcattcaccaacctgccaatgaatatcctataacaatcggcactgcaattcctttgaaagcaagtttcttcatcacctatataatggttgatggatggtctggtatagctgcggaggttttgatgttgaaaccgctaatcatatatcacttgaagaattttttcttggtgaagactgaaaaggatagggaggaagctatggatcctgggagtattggtttcaacacaggagaacctcgaatacagttgtactttttgctgggtttagtctatgctgcagtgacacctactgttcttcctttcataatagttttcttcgggctggcctatgttgtgttccgtcatcagataatcaatgtttataatcaagagtacgagagtggtgcagcattctggcctgatgtccactttcgtatcattcttgcgctgatagtgtcacagatagttctgatgggactcctgaccaccaaaaaggctgcttcatcaactccatttctcattgtactcccaatacttacgatatggttccatagatactgcaaaggccgctttgaatctgcatttgttaaatatcccttgcaggaagcaatgatgaaagacacattggaacgagccacagaacctaacctgaacttgaaagcttaccttcagaatgcctatgtccatccagttttcaaggccagcctcggtgaggacgatgacgaagacgaagaggctatcagtctgaagtgggaaactgagagtattgtgcccacaaaacggcaatcaagaaagaacacaccattgcctagcagaattagtggtgcatcatctccttctcttcctgatggcagtcgaaatcggccagagccataaatcatggaccaaggaatgatatcatcgttgttggagcaaccacaacactatgtgcatatcgattgacacgtgattccagcataaaccaagaaagctgaggggtaacaagctagtgttggactttgtgatcggcacgaacgaagtttaaaggtagagagattctttgataatatttcggattttgttaatagagaatttgttcctatgatgtagaatggtagttatactttcaaatatgtatcaccttggaatgctgtaaattatccaaaaactcatcatggtttaagattctgtgaataatcttctcccttttacctttgaattttcttctacttctgcacatctttaacactcaatcccttccttccttcctttctactaagtttcttc

SEQ ID NO: 1736 - DNA, 2681 bp, Trigonella foenum-graecum
gtttaagagtagaagaaaaaaaaagatggctacactagaagatatttctcttgcagctggaataaacattttgagtgcatttatcttctttgtggcatttgcaattttgaggcttcagcctttgaatgatagggtatacttcccaaaatggtatctcaagggtttaagaaccgatcctgtgcacggaggagcatttgtgcgaaagattgtcaatttagattggagatcatatattcggtttttgaattggatgccagctgcacttagaatgccagagcccgagcttattgaccatgctggattggactctgttgtttacttgaggatttacttgttaggacttaaaatctttgttcctatagcgttcctcgcttgggcggttctggttcctgtcaactggacaagcacggggctagaaaaacctgggataaaaaacataacttccagtgacattgataagatctcaatttcgaatgtccagcgtggatccgaaaggttttggtcacacatagtagttgcttacgcatttaccttctggacatgctatactttgatgaaggagtatggaaaagttgctgcaatgagattgcaatttcttgcagcagaaagacgtcgtcctgatcaattttcggtgcttgttagaaacattccaccagatcctgatgaatctgttggtgagcttgtggagcacttctttctggtcaatcatccggataactatcttactcaccaggttgtttataatgcaaacaacttagcgaagttggttaaaaagaagagtaagatgcagaattggcttgtctattatcaaaataagcttgaaagaacttcaaaaagacctgaaatgaagactggtttccttggtcttagtggaaagaaagtagatgctattgattattacaccactgagattgacaagttgtcaaaagaaatagctttggagagggataaggtcactaatgatcccaagtctaccatgcctgctgcatttgtttcttttaaaagtcgatggggtgctgcagtttgtgctcaaacccaacaaaccagaaatccaacaatttggttgactgagtgggctccagagccacgggacgtctattggccaaacttggcaattccatatgtttccctaactgttagaaggctgatcatagctgttgcgttcttttttctcactttctttttcatgatccccattgcaatagtacaaggtcttgcgagtcttgatggaatccagaaagcagcaccatggttgaagccgcttgttagtgtccctgtcattaagtcattcattcaaggttttctacccggtattgcattgaagctttttcttatctttttgccaacaatattgatgatgatgtcaaaatttgaaggctttggatctatatcatctcttgagagaagatcggcttctcgatattatcttttcagttttgtgaatatatttcttgggaacctacttactgggtcagcatttcagcagctcgacactttcattcaccaaccagccaacgaatatcccataacaattggcactgcaattcctttaaaagcaagtttcttcatcacttacataatggttgatggatggtctggtatagctgctgaggttttgatgttgaaaccgctaatcatgtatcacttgaagaatttcttcttggttaagacagaaaaggacagggaagaggccatggatcctgggagtattggtttcaacactggagaacctcgcatacaattgtattttttgctgggtttagtctatgctgcagtgacacctaccgttcttcctttcataataattttctttgggttggcctatgttgtgttccgccatcagataatcaatgtttataatcaagagtacgagagtggtgcagcattctggcctgatgtccatttccgtgtcattattgcactgttagtctcacagatagttctgatgggacttctgaccaccaaaaaggctgcttcatcaactccatttctcattgtgctcccgatactgacgatatggttccatagatactgcaaaggccgtttcgaatctgcatttgttaaatatcccttacaggaagcaatgatgaaagatacattagaacgagctacagaaccgaacctgaacataaaaggttaccttcagtatgcttatattcatccagtttttaaggctagccttgatgatgatgctgatgaggaagatgtaacgagtctaaagtgggaaactgagagtgctattgtacccacaaaacgtcattcaagaaggaatacaccattgcccagcaaaattagtggtgcatcatctcattctatgcttgatggcgttaaaaatgatccagagtcttagatcatccatggactaaaaaatgatgtcatgataaactaggatgtttgtgactgagtatattatatgatgagctacatcaatggacatgtggttgtagcatataagctgagaaagttgggtggtcttgtgcataagcgttgccacagctcgtagagattgtaaggcagagattctttcattatgtttcagattttgttaatagtgtgagtttgttcccttagtagatgttttttctagtttgtatcacctagcatttagagattgtaaggcataacattacaccactggatactgtaaattatccaaaaattgattatgactctaggttgtg

SEQ ID NO: 1737 - DNA, 2681 bp, Medicago truncatula
aaggaaaaaaagaatggctaaacttgcagatatttctcttgcagctggaattaatattttgagtgcatttatcttctttgtggcatttgctattttgaggcttcagcctttgaatgatagggtatacttcccaaaatggtatctcaagggtttaagaacagatcctgtgcacggtggagcgttcatgcgaaagattgtcaatttagattggagatcatatattcggtttttgaattggatgccggctgcacttagaatgccggaacctgagcttattgaccatgctggattggactctgctgtttacttgaggatttacttgttaggacttaaaatctttgttcctatagcattcctggcgtgggcggttctggttcctgtcaactggacaagcagtgggctagaaaatgctgggataaaaaacataacttccagtgacattgataagatctcaatttcgaatgtccagcgtggatcggaaaggttttggtcacacatagtagttgcttatgcatttaccttctggacatgctatactttgatgaaggagtatggaaaagttaccgcaatgagattgcaatttcttgcaacagaaaaacgccgtcctgatcaatttacggtgcttgttagaaacattccaccagatactgatgaatctgtcggtgagcttgtggagcacttctttctggtcaatcatccggataactatcttactcaccaggttgtttataatgcaaacaaattagagaagttcgttaaaaagaagagtaagttgcagaattggcttgtctattatcaaaataagcttgaaagaacttcaaaaagacctgaaatgaagactggtttccttggtcttcatggaaagaaagtagatgctatcgattattacaccactgagattgacaagctgtcaaaagaaatagctttggagagagataaggtcactaatgatcctaagtctaccatgcctgctgcatttgtttcttttaaaagtcgatggggtgctgcagtttgtgctcaaacccaacaaaccagaaatccaacaatttggttgactgagtgggctccagagccacgggatgtctattggcaaaacttggcaattccatatgtttccctaactgttagacggttgatcatagctgttgcgttcttttttctcacattctttttcatgatccccattgcaatagtacaaggtcttgcaagtcttgatggaatccagaaagcagcaccatggttgaatccccttgttcgtgtccctgttgttatgtcattcattcaaggttttctacccggtattgtattgaagctttttcttatctttctgccaacaatattgatgatgatgtcgaaatttgaaggctttggatctatatcatcgcttgagagaagatcggcttctcgatattatcttttctgtttcgtgaatatatttcttgggaacctacttgctgggtcagcatttcaacagctcgacactttcattcatcaaccagccaacgaatatcccataacaattggcactgcaattcctttaaaggcaagtttcttcatcacctatataatggttgatggatggtctggtatagctgctgaagttttgatgttgaaaccgctaatcatgtatcacttgaagaatttcttcttggttaagactgaaaaggacagggaagaggccatgaatcccgggagtattggtttcaacactggagaacctcgcatacaattgtattttttgctgggtctagtctatgctgcagtgacaccaactgttcttcctttcataataattttcttcgggttggcctatgttgtgttccgccatcagataatcaatgtttataatcaagagtacgagagtggcgcagcgttctggcctgatgtccatttccgtgtcatcattgcactgttagtatcacagatagttctgatgggactcttgaccaccaaaaaggctgcttcatcaactccatttctcattgtgctccctatactgacgatatggttccatagatactgcaaaggccgtttcgaatctgcatttgttaaattccccttacaggaagcaatgatgaaagatacattagaacgagcgacagaaccgaacctgaacgtaaaaggttaccttcagcatgcttatgttcatccagtttttaaggctagccatgatgatgatgctgatgaggaagatgcaatgagtctgaagtgggaaactgagagtgctactgtagccacgaagcgtcaatcacgaaggagtacaccattgcccagcagatttagtggtgcatcatctccgtctatgctcgacagcattaaaaatgatccagagtcatagatcattcatggaccaagaaatgtcatatcatcgacatgacaaagtaggatgtatgtgaatgtgagtatattatatgatgagctacaacaacggacatgcatgtggctctagcattcttgtgcaaaagcgttttggattttctggtcagcagatagcttgtagagactttaagactgatattctttcataatgtttcagattttgttaatagtgggtttgttccgttagtagatgaacatgtttttctagtttgtaccacctagcatttagagatttgcttaacattacaccacgggatactgtaaattatccaaaatttgattatgactctaggttgtgtgta

SEQ ID NO: 1738 - DNA, 3071 bp, Medicago truncatula
gaaacccaatctcaaccattatccatttttgtttctttctttaacatactagtttttttttagttcatagttggtgtgtacaagaggtaaagctacaattagcgtgacctctacggcggtgctttcattcaccgctaaactctgtcggaatcttcttcgctttcgcacgtttctaagatatcctttgataccctaattcctccatttaaactcgctttgagcttttcatcctcggcgacaacttcaaagtaagaggtgtgtttaagattagaaggaaaaaaagatggctaaacttgcagatatttctcttgcagctggaattaatattttgagtgcatttatcttctttgtggcatttgctattttgaggcttcagcctttgaatgatagggtatacttcccaaaatggtatctcaagggtttaagaacagatcctgtgcacggtggagcgttcatgcgaaagattgtcaatttagattggagatcatatattcggtttttgaattggatgccggctgcacttagaatgccggaacctgagcttattgaccatgctggattggactctgctgtttacttgaggatttacttgttaggacttaaaatctttgttcctatagcattcctggcgtgggcggttctggttcctgtcaactggacaagcagtgggctagaaaatgctgggataaaaaacataacttccagtgacattgataagatctcaatttcgaatgtccagcgtggatcggaaaggttttggtcacacatagtagttgcttatgcatttaccttctggacatgctatactttgatgaaggagtatggaaaagttaccgcaatgagattgcaatttcttgcaacagaaaaacgccgtcctgatcaatttacggtgcttgttagaaacattccaccagatactgatgaatctgtcggtgagcttgtggagcacttctttctggtcaatcatccggataactatcttactcaccaggttgtttataatgcaaacaaattagagaagttcgttaaaaagaagagtaagttgcagaattggcttgtctattatcaaaataagcttgaaagaacttcaaaaagacctgaaatgaagactggtttccttggtcttcatggaaagaaagtagatgctatcgattattacaccactgagattgacaagctgtcaaaagaaatagctttggagagagataaggtcactaatgatcctaagtctaccatgcctgctgcatttgtttcttttaaaagtcgatggggtgctgcagtttgtgctcaaacccaacaaaccagaaatccaacaatttggttgactgagtgggctccagagccacgggatgtctattggcaaaacttggcaattccatatgtttccctaactgttagacggttgatcatagctgttgcgttcttttttctcacattctttttcatgatccccattgcaatagtacaaggtcttgcaagtcttgatggaatccagaaagcagcaccatggttgaatccccttgttcgtgtccctgttgttatgtcattcattcaaggttttctacccggtattgtattgaagctttttcttatctttctgccaacaatattgatgatgatgtcgaaatttgaaggctttggatctatatcatcgcttgagagaagatcggcttctcgatattatcttttctgtttcgtgaatatatttcttgggaacctacttgctgggtcagcatttcaacagctcgacactttcattcatcaaccagccaacgaatatcccataacaattggcactgcaattcctttaaaggcaagtttcttcatcacctatataatggttgatggatggtctggtatagctgctgaagttttgatgttgaaaccgctaatcatgtatcacttgaagaatttcttcttggttaagactgaaaaggacagggaagaggccatgaatcccgggagtattggtttcaacactggagaacctcgcatacaattgtattttttgctgggtctagtctatgctgcagtgacaccaactgttcttcctttcataataattttcttcgggttggcctatgttgtgttccgccatcagataatcaatgtttataatcaagagtacgagagtggcgcagcgttctggcctgatgtccatttccgtgtcatcattgcactgttagtatcacagatagttctgatgggactcttgaccaccaaaaaggctgcttcatcaactccatttctcattgtgctccctatactgacgatatggttccatagatactgcaaaggccgtttcgaatctgcatttgttaaattccccttacaggaagcaatgatgaaagatacattagaacgagcgacagaaccgaacctgaacgtaaaaggttaccttcagcatgcttatgttcatccagtttttaaggctagccatgatgatgatgctgatgaggaagatgcaatgagtctgaagtgggaaactgagagtgctactgtagccacgaagcgtcaatcacgaaggagtacaccattgcccagcagatttagtggtgcatcatctccgtctatgctcgacagcattaaaaatgatccagagtcatagatcattcatggaccaagaaatgtcatatcatcgacatgacaaagtaggatgtatgtgaatgtgagtatattatatgatgagctacaacaacggacatgcatgtggctctagcattcttgtgcaaaagcgttttggattttctggtcagcagatagcttgtagagactttaagactgatattctttcataatgtttcagattttgttaatagtgggtttgttccgttagtagatgaacatgtttttctagtttgtaccacctagcatttagagatttgcttaacattacaccacgggatactgtaaattatccaaaatttgattatgactctaggttgtgtgtatattttttttttctctccctttgttaccttgtgcttttcctttgagatcgagctctgtttgtacacatttgtaacaaacaagaggttctctacgaaatattaccccacgttacttttgtc

SEQ ID NO: 1739 - DNA, 2990 bp, Glycine max
aagaagaaagctctggagacaaagaaagctctggagacactactgttgtatcactcagcgccagtgccttttgttttgttttatgatttttctctgtgcgtgtgactgtaaatcgtgaaggaggtggtggatgttaacgtgatggattcctgtttctgaactcaagaagcaggtgagagtggcgtgtgttgcacttgtactacccaaaaaaggttctttgtttggtttccaagatattacaactcatacacaaacttcaaacaaaaaacaccctttcaccctacgttgcatcttcaactctgcaacctcggaattctgtttaatgaaatgacgacgctgtcggatattggagttgctgctgccataaacatttccagtgcattgcttttctttgtggcatttgctattttgaggcttcaaccatggaacgatcgagtgtactttccaaaatggtatttgaagggtttaagaacagatccagttcatggaagaccgcttgtgagcaagttcatcaatttagactggagagcatatcttggctctttgaattggatgccagaagcacttagaatgccagaacctgagcttattgaccatgctggattggactctgctgtttacctgcggatttacttgatagggcttaaaatctttgttcctattgcgttcctggcttggattgttctggttcctgtcaattgcacaagtactggtctagaaggggcccagatgaaaaacataacctccagtgacattgataaactctcgatttcaaatgtccatagaggatctgaaaggttttggggacacatagtaatggcttatacatttaccttttggacttgctatgttttgctaaaggagtatgagaaggttgcaacaatgagacttggctttcttgcagcagaaaagcgtcgtcctgatcaatttacggtgcttgttagaaatattccacccgaccctgatgaatctgtgagtgagcttgttgagcacttctttctggtcaatcatccaggtcactatctgactcaccaggttgtttatgatgccaacaaacttgctaagttggttaaaaagaagaagaagttgaagaattggcttgtctactatcaaaataagcttgaaagaacttcaaaaagacctgaaataaagactggtttccttggtctttggggaaagaaagtggatgctattgatcatcacatcactgaaattgacaagttgtcaaaagaaattgttgaggagagggaaaatgtcacaaatgatcccaaggccatcatgcctgctgcatttgtttcatttaaaacaagatgggctgctgctgtttgtgcacaaactcagcaaaccagaaatccaacactttggctgactgaatgggctccagagccacgagatgtatattggcgaaacttgccaattccatatgtttccctcactgtcaggaggttaatcacagcagtggcattcttttttctcactttcttttttatgatccccattgcatttgttcaaactctggcaagtcttgatggaatccaaaaagcggcaccatggctgaagccacttgttgacatccctttcattaagtcattcattcaaggttttctgcccggtattgtgttgaagctattcctcatcttcttgccaacaatattgatgatcatgtctaaatttgaaggctatggatctatatcttctctggagagaagatcagcttctagatattatcttttcaattttgtgaatatattccttgggaacatacttactggaacagcatttcaacagctgagctctttcattcaccaaccagccaaccaatatcctgtaacaattggcactgctattcctttaaaagcaagtttcttcattacttatataatgattgatggatgggccagtatagctgcagaggttttgatgttgaagccgctaattgtttatcacttgaagaatttcttcttggtgaaaactgaaaaggacagggaagaggccatggatcccgggagtattggtttcaacactggagaacctcgtatacaattgtactttttgttgggtctagtatatgctgcagtgacacctgctgttcttcctttcataatagttttctttggcctggcctatcttgtgttccgtcatcagatcattaacgtttataatcaggagtatgagagtggtgcagcattctggcctgatgtccatttccgtatcgtgatggcacttctagtctcacagatagttctgatgggactcctcaccaccaagaaagctgcttcgtcaactccttttctcgttgtgctcccaatactaaccatatggttccataggtactgcaaaggccgttttgaatcagcatttgttaaatttcccttacaggaagcaatgatgaaagatacattagaacgaacaacagaacctaacctgaacttgaaaggttatcttcagaatgcctacgttcatccagtttttaaggacagcatggatgacgatgatgatgaggaagatatactcagtatggacttggaaactgaaagtgtgactgtgcgcacaaaacgccaatcgcgaaggaatacaccattgccaagcaaaaataatgatgcatcatctccttctctgtctgatggcattggaaatcatccagagccttaaagcaaaatgagatcactgtacattggactttaggccattattttctcaacagactaggatgatgtgcaagtgcaaatatagtaagctacatcacttgacaaagttgaggaagatgggttgtctcttgtagtgattcctgctgaaggaattgttttgaagtttttgccaggccgacgaaatcgctacacgtagactatctagtagatatttttgtaatgcttaggatttagttgaatactagtgaatttgcttccctaatagatgaacagaacaggttttgtcttttatgatccgtacattatattgcaagttacatagatgcttagcacttttttttt

SEQ ID NO: 1740 - DNA, 2667 bp, Glycine max
aaatgacaacgctgtcggatattggagttgctgctgccataaacatttccactgcattgcttttctttgtggcatttgctattttgaggcttcagccttggaacgatcgagtatactttccaaaatggtatttgaagggtttaagaacagatccagttcatggaagagcgcttgtgagcaagttcatcaatttagactggagagcatatcttagctttttgaattggatgccagaagcacttagaatgccagaacctgagcttattgaccatgctggattggattctgttgtttacctgcggatttacttgatagggcttaaaatctttattcctattgcattcctggcttggattgttctggttcctgtcaattggacaagtactggtctagaaggatcccagataaaaaacataacttccagcaacattgataaactctcggtttcaaatgtccatagaggatctgaaaggttttggggacacatagtaatggcttatgcgtttaccttttggacttgctatgttttgctaaaggagtatgggaaggttgcaacaatgagacttggctttcttgcagcagaaaagcgtcgtcctgatcaatttacggtgcttgttagaaatattccaccagaccctgatgaatctgtgagtgaacttgttgagcacttctttctagtcaatcatccagatcactatctgactcaccaggttgtttatgatgccaacaaacttgctaagttggttgaaaagaagaagaagtttaaaaattggcttgtctactatcaaaataagcttgaaagaacttcaaaaagacctgaaataaagactggtttccttggtctttggggaaagaaagtggatgctattgatcatcacatcactgaaattgacaagttgtcaaaagaaattgttgaggagagggaaaatgtcacaaatgatcccaaggccatcatgcccgctgcatttgtttcatttaaaacaagatgggctgctgctgtttgtgcacaaactcagcaaaccagaaatccaacactttggttgaccgaatgggctccagagccacgagatgtatattggcgaaacttgccaattccatatgtttccctcactgtcaggaggttaatcatagcagtgacattcttttttctcactttcttttttatgatccccattgcatttgttcaaactctggcaagtcttgatggaatccagaaagcagcaccatggctgaagccacttgttgacatccctttcattaagtccttcattcaaggttttctgcccggtattgtgttgaagctattcctcatcttcttgccaacaatattgatgatcatgtctaaatttgaaggctttggatctatatcttctctggagagaagatcagcttctagatattatcttttcaattttgtgaatatattccttgggaacatacttactggaacagcatttcaacagctgagctctttcattcaccaaccagccgaccaatatcctgtaacaattggcactgctattcctttaaaagcaagttttttcattacttatataatggttgatggatgggccagtatagctgcagaggttttgatgttgaaaccgctaattgtttatcacttgaagaatttcttcttggtgaaaactgaaaaggacagggaagaggccatggatcctgggagtattggtttcaacactggagaacctcgtatacaattgtactttttgttgggtctagtatatgctgcagtgacacctgctgttcttcctttcataacagttttctttggcctggcctatcttgtgttccgtcatcagatcattaacgtatataatcaggagtatgagagtggtgcagcattctggcctgatgtccatttccgtatcgtgatggcactgattgtctcacagatagttttgatgggactcctcaccaccaagaaagctgcttcatcaactccttttctcattgtgctcccaatactaaccatatggttccataggtactgcaaaggccgttttgaatctgcatttgttaaatttcccttacaggaagcaatgatgaaagatacattagaacgggcaacagaacctaacctgaacttgaaaggttatcttcagaatgcctatgttcacccagtttttaaggacagcatggatgacgatgatgacgaggaagatagactcagtatagacttggaaactgaaagtgtgactgtgcgcacaaaacgccaatcacgaaggaatacaccattgccaagcaaaaataatgatgcatcatctccttctctgtctgatggtattggaaatcatccagagccttaaggcaaaatgagataactgtacattcgaatttaggtcagtattttctcaacagactaggatgatgtgcaagtgcaaatatagtaagttgcatcacttgacaaagttgaggaagatgggctatctcttgtagtgacttctgctgaagcaattgttttgaagttttttccaggccgatgtaatcgctacatgtagactatctggaagatatttttgtaatgcttaggattttgttgaatactagtgaatttgcttccttattagatgaacagaagaggttgtcttttaagacctgtacattatattgcaagttacatagattatatacatatacattatatta

SEQ ID NO: 1741 - DNA, 2611 bp, Cajanus cajan
gaaatgacaacgctgtcagatattggagttgcagccgccataaacatttcaagtgcattgcttttctttttagcatttgctattttgaggcttcaaccttggaacgatcgagtgtacttcccaaaatggtatttgaagggtttaagaacagatccagttcatggaagagcgtttgcgagcaagttcatcaatttagactggagggcatattgtggatttttcaattggatgccagaagcacttagaatgccagaacctgagcttattgaccatgcaggattagactctgttgtttacttgcggatttacttgatagggcttaaaatctttgttcctatagcgttcctggcttggactgttctggttcctgtcaattggacaagtagtggtctagaaggtgcccagattaagaacataacttccagtgacattgataaactctccgtttcaaatgtccatagtcgatctgaaaggttttgggggcacataataatggcttatgcatttaccttttggacttgctatgttttgctaaaggactatgaaaaggttgcatcaatgagacttggctttcttgcagcagaaagacgtcgtcctgatcagtttacggtgcttgtaagaaatattccaccagaccccgatgaatctgtgagtgaccttgtggagcacttctttctggtcaatcatccaggtcactatctgactcaccaggttgtttacgatgcaaacaaacttgctaagttcgtgaaaaagaaaaagaagttgacgaattggcttgtctattatcaaaataaacttgaaagaacatcaaaaagacctgaaattaagactggtttccttggtctttggggaaagaaagtagatgctattgattatcacatcactgaaattgacaagttgtcaaatgaaattgttgtagagagggaaaaggtcataaatgatccgaagtctatcatgcctgctgcatttgtttcatttaaatcgcgatgggctgctgctgtctgtgcacaaactcagcaatccagaaatccaacactttggttgactgaatgggctccggagcctcgagatgtatattggcgaaacttgccaattccatatgtttctctcactgtcaggaggttaatcatagctgttgcattcttttttctcactttcttttttatgatccccattgcatttgttcaaactcttgcaagtctggatggaatccagaaagcagcaccatggctgaagccacttgtcaaaatccctttcattaagtcatttattcaaggttttctacccggtattgtgttgaagctgttccttatcttcttaccaacaatattgatgatcatgtctaaatttgaaggctttgaatctatatcatctctggagagaagatcagcttctagacactatcttttcaattttgtgaatatatttcttgggaacatacttactggaacagcatttcaacagctgagctctttcattcaccaaccagccaaccaatatcctgtaacaataggcactgctattcctttaaaagcaagtttcttcatcacttacataatggttgacggatgggccagtatagctgcagaagttttgatgttgaaacctctaatattttatcacttgaagaatttcttcttggtcaaaactgaaaaagacagggaggaggccatggatccagggagtattggtttcaacaccggagaacctcgtatacaattgtactttttgttgggtcttgtatatgctgcagtgacacctgctgttcttcctttcatcatagttttctttggcctggcatatgttgtgttccgtcatcagatcattaatgtatataatcaagagtatgaaagtggtgcagcattctggcctgatgtccacttccgtattgtgttggcactgatagtgtcacagatagttctgatggggctcctcaccaccaaaaaagctgcatcatcaactccatttctcattgtgctcccaatactaaccatatggttccataggtactgcaaaggccgctttgaacccgcatttgtgaaatttcccttacaggaagcgatgatgaaagatacattagaacgagcaacagaacctaacctgaacttgaaaggctatcttcagaatgcctatgttcatcctgtttttaaggacagcatggatgttgacgacgacgacgaagagatccttagtatggatttggaaactgaaagtgcgacagtgcgcacaaaacgccaatctcgaaggaacaccccattgcccagcaaaaataatgatgcatcatccctctctgtctgatggcattggaatcatccagagccttaaagcaaaatgagatcactgtacactttacctcattattttctaaatagattaggatgatgtggaagtgcaaatatagtaagctacatcagttgacaaagttgaggaagtgcagtggctcctgctgtgaaggaattgttttggagtttctgacaggcagatgaaatcactgtactgatgaggcatagtttttgtaatgctcatgattttgttgaatgctagtgaatttgcttccatagtggatgaatagattttgtcttttacatctgtacccccaagctcatagatg

SEQ ID NO: 1742 - DNA, 2946 bp, Phaseolus coccineus
gcagaagaaaggtctagacacaaactattccactgtctctgctcactgccttctgctttatgttttgttttgtgtgtgtgattgcataatcttcaaggtgggttcctgtttctgaactcaagcaggtgacagtggcgtgtgttctaataccacaaaaggttgcggaatcttgttccttgtctgctttgcaagatattccagctcgtacacacacacccttttaccccacgttgcatcatcttcaactctgcaacttattcgtaggaaggcgtttatcctttctataggaagagatgacaacattgtcggatataggggttgctgctgccataaacatttccagtgcattgcttttctttctggcatttgctattttgaggcttcaaccttggaacgatagggtgtactttccaaaatggtatttgaagggtttaagaacagatccaattcagggaagagcgtttgtgagcaagttcatcaatttagactggagatcatatcttgggtttttgaattggatgccagaagcaattagaatgccagaacctgagcttattgaccatgcaggattggactctgttgtttacttgcggatttacttgatagggcttaaaatctttgtccctatagcattcttggcttggactgttctggttcctgtcaattggactagtactggtctagaaggatcccagataagaaacataacttctagtgacattgataaactctctgtttcaaatgtccatagtcgatctgaaaggttctggggacacatagtaatggcttatgcctttaccttttggacttgctatattttgctaaaggaatatgggaaggtagcatcaatgagacttagttttcttgcggcacaaaagcgtcgtcctgatcagtttacggtgctcgttagaaatattccatcagaccctgatgaatctgtgggtgagcttgttgagcacttctttttggtcaatcatccagaccactatcttactcaccaggttgtttatgatgccaacagacttgctaagttggttaacaagaagaagaagttgaagaattggcttgtatactatcaaaataaacttgagagaacttcaaaaagacccgaaataaagactggtttccttggtctttggggaaggaaggtggatgctattgatcattacaccgatgaaattgacaagttgtcaaaagaaattgttgtagagagggaaaaggtcataaatgatcccaattctatcatgcctgttgcatttgtttcatttaaaacaagatggggtgctgctgtttgtgcacaaactcagcaaaccagagatccaacactttggttgactgaatgggccccagaaccacgagatgtgtattggcgaaacttgccaattccctatgtttccctcactgtcaggaggctaatcatagctgtggcattctttttcctcactttcttttttatgatccccattgcatttgttcaaaccctcgcaagcattgaaggaatccagaaagcagcaccatggctgaagccatttgttagcatgtctttcgtcaagtcattcattcaaggttttctgcctggtattgtgctgaagctattccttatcttcctgccaacaatattgatgatcatgtctaaatttgaaggctttgaatcaatttcatctcttgagagaagatcagcttctagatactatcttttcaattttgtgaatatattccttggaaacatacttaccggatcagcatttcaacagctgagttctttcattcaccaaccagcgaaccaatatccggtaacaattggtactgctattcctttaaaagcaagtttcttcattacttatataatggttgacggatgggcgagtatagctgcagaggttttgatgttgaaaccgttaattttttatcacttgaagaatttcttcttggtgaaaactgaaaaggacagggaagaggccatggatcctgggagtatcggtttcaacactggagaacctcgtatacaattgtattttttgttgggtctagtatatgctgcagtcacacctgctgttcttcctttcattatagttttctttggcttggcctatcttgtcttccgtcatcagatcattaacgtatacaatcaagagtatgagagtggtgcagcattctggcctgatgtccatttccgcatcatattggcactgatagtctcacagatagttctgatggggctcctcaccaccaagaaagctgcttcatcaactccttttctcattgtgctcccaatacttaccatatggttccataggtactgcaaaggccgttttgaatctgcatttgttaaatttcccttacaggaagcaatgatgaaagatacattagaacgagcaatagaacctaacctgaatttgaaaggttatcttcaaaatgcctatgttcatccaatttttaaggacagcatggaggaggagactgatgaggaggagatactgggtatggagtttgaaactgaaagtgcgattgtgcgcacaaaacgccagtcccgaaagaatacaccattacccagcacaaacaatgcatcatctctttctttctctgatggcactcaaactcatctagagccttaaagaaaaaaaggattcattattttgttgacagattaggataatgtgcaaatgcaaatacactatgctacatcaattgaggaagatgcctctcttttagtcactcttgctgaaagcaacatgaaattaccacaagcagagactataaggcatattttttgtaatgcttaggattttgttgattactagtgaattgtttccttaggggatgaaagaatatgagagagcctaactatttgtagggtgccatgaatgggataagggattagtccaaacatggataatgcacaatgtaattaatcagactgttttcattttaagcaatttaaaataa

SEQ ID NO: 1743 - DNA, 1296 bp, Glycine max
gcgttgttgttccatagataaaaataaacaaaaagaaaaatgagtactaagtactaataccatataataattattaaaacagaaagaggaggtactacttgtattgggtaacgcgctatggcgggcgaatcgggtggtagtgctacgaacttgaactttgatcttcccgaggaggtggtgcaagtgctaccgtccgatcccttccagcagctcgatgtggctcgcaagatcacttccattgctctatcgacacgtgtcaacaccctcgaatcagacctatcctcacttcgcgcccagatcgccgacaaagacaacctcatcgccgaccttcaatctcagctcgactccctcgacgcttccctctcccaaatcgccgccacactcttccaaaccgaacaggataaggagagcttgctccaggagaatgcttcgctttccgacaccgtcaaaaagctcaatcgagatgtctccaagttggaggttttcagaaagacgcttatgcaatcacttcaggaggatgatgataattctggaggaactccagacactgttgctaaaatacagagtcaagcaagtttgacttccacgtcgcagattggagataacgaagcttcattgccaccggctatatcttcttcaacaggaaattcatttgctgatgatcaggaatctgatgccataagacctagagtatcgcagaatctcctcttagcatctcaaggttccacccctcggataactcctcctggttcccctcctattctgtcggcatcagtatcacctacgagaacatccaaacctgtatctccacggcgacattcaatttccttttcaaccacaagaggcatgcatgatgacaggtcttcagtgttttcctcaatgtccttaacccatggttcaatatcaagctctgatgcaggaacaggatcacaaactggacgaacacgggtggatgggaaagagttttttcgccaagttaggaaccgtttgtcttatgagcaatttggtgcattcttggcaaatgttaaagaattgaattcccataaacaaacaaaagaggagacgctgcggaaagctgataaaatttttgggcctgaaaacaaggatctgtacactatatttgagggattgattaatcgcaatgtccattgacactgtgcttaggagaagttttattccaaattagtaataacggatactatcgtgtctccttatagcaactcgtttttttctctcctatgtataccatattatcacgttaattattgtctaatacaataattttttgaacatgaa

SEQ ID NO: 1744 - DNA, 1275 bp, Phaseolus coccineus
aaaataaacaaaaacaaaaacataaaatagtaatattaatattaaaatcagaaagaaggggtaaggaagggcaaagtaactcgcgctatggcggcggaatcgggtggtagtgccaacttcgaccttcccgaggagatgatgcaagtgctaccgtccgatcccttccaccagctcgatgtggctcgcaaaatcacttccattgctctgtcgacacgtgtcaacgccctcgaatcagagctgtccacacttctcactcagatcgccgacaaagacaacctcatcgccgaccttcaaattcaactcgactccctcgatgcctccctctccgaaaccgccgacaaactcctcctcgccgaacaagataaggagagcttgctgaaggagaatgcttcgctttccaacactgtcaaaaagctcaatcgagatgtctccaagttagaggttttcagaaagacgcttatgcaatcacttcaggaagaggatgataattctggaggagctccagacattgttgctaaaatacagaaccaatcaaatttgacttccacgtcacagtttcgagataatgacgcttcattggcaccgtctatatcttcttcaacaggaaattctttggtcgaagaacctgaacctgatgccccaagacctagagtaccacagaatctcctcttagcatctcaaggttccacccctcggattactccccctggctcccctcctagtctgtctgcatcagtatcacctacgagaacatctaaacctgtatctccaaggcgacattcagtttccttttcaaccacaaggggcatgtatgatgataggtcttcggtgttttcctccatgtccttaactcaaggttcaatatcaacctctgatgcaggaacaggatcacaaaccggacgaacacgggtggatggaaaagagttctttcgtcaagtcaggaaccgtttgtcttacgagcaatttggtgcattcttgggaaatgttaaagaattaaattcccataaacaaacaaaagaggagacgctacggaaagctgatgaaatttttgggcctgaaaacaatgatctgtacaatatatttgaaggattgattaatcgcaatgtccattgatattgcgcttaggggaagttttattccgagtttgtaatatcggatactatcctctcctttcccctctgtatatgagatgaaattatcacgttaattattttgtctgatacaataatctttgaaaatgaaaacctgtatatttcatttcacgaatcacattct

SEQ ID NO: 1745 - DNA, 1191 bp, Phaseolus coccineus
  misc_feature (1069)..(1069): n is a, c, g, or t
  misc_feature (1113)..(1113): n is a, c, g, or t
tggggtaaggaaaggcaaagtaactcgcgctatggcggcggaatcgggtggtagtgccaacttcgaccttcccgaggagatgatgcaagtgctaccgtccgatcccttccaccagctcgatgtggctcgcaaaatcacttccattgctctgtcgacacgtgtcaacgccctcgaatcagagctgtccacacttctcactcagatcgccgacaaagacaacctcatcgccgaccttcaaattcaactcgactccctcgatgcctccctctccgaaaccgccgacaaactcctcctcgccgaacaagataaggagagcttgctgaaggagaatgcttcgctttccaacactgtcaaaaagctcaatcgagatgtctccaagttagaggttttcagaaagacgcttatgcaatcacttcaggaagaggatgataattctggaggagctccagacattgttgctaaaatacagaaccaatcaaatttgacttccacgtcacagtttcgagataatgacgcttcattggcaccgtctatatcttcttcaacaggaaattctttggtcgaagaacctgaacctgatgccccaagacctagagtaccacagaatctcctcttagcatctcaaggttccacccctcggattactccccctggctcccctcctagtctgtctgcatcagtatcacctacgagaacatctaaacctgtatctccaaggcgacattcagtttccttttcaaccacaaggggcatgtatgatgataggtcttcggtgttttcctccatgtccttaactcaaggttcaatatcaacctctgatgcaggaacaggatcacaaaccggacgaacacgggtggatggaaaagagttctttcgtcaagtcaggaaccgtttgtcttacgagcaatttggtgcattcttgggaaatgttaaagaattaaattcccataaacaaacaaaagaggagacgctacggaaagctgatgaaatttttgggcctgaaaacaatgatctgtacaatatatttgaaggattgattaatcgcaatgtccattgatattgcgcttangggaagttttattccgagtttgtaatatcggatactatcctctnctttcccctctgtatatgagatgaaattatcacgttaattattttgtctgatacagaataaaaagttgatattgaacc

SEQ ID NO: 1746 - DNA, 1234 bp, Vigna unguiculata
gtaatattaatattaaaaacagaaacaaagggggtaaggtaacacccgctatggcggcggaatcgggtggtagtgcaaacttcgaccttcccgaggagatgatgcaagtgctaccgtccgatcccttccaccagctcgatgtggctcgcaaaataacttccattgctctgtcgacacgtgtcaacgccctcgaatcagagctgtccacacttcgcactcagatcgccgacaaagacaacctcatcgccgaccttcagtctcaaatcgactccctcgatgcctccctgtccgaaaccgccgacaaactcctcctcgccgaacaagataaggagagcttactgcaggagaatgcttcgctttccaacactgtcaaaaagctcaatcgagatgtctccaagttagaggttttcagaaagacgcttatgcaatcacttcaggaagaggatgataattctggaggagctccagacattgttgctaaaatacagaaccaatcaaattttacttccacgtcacagtttggagacaatgacgcaccattggcaccgtctatatcttcttcaacaggaaattctttggtcgaagaacctgaatctgatgcagcaccaagacctagagtacctcagaaccttctcttagcatctcaaggttccacccctcggattactccccctggttcccctcctagtctgtctgcatcagtatcacctacgagaacatccaaacctgtatctccaaggcgacattcagtttccttttcaaccacaagaggcatgtttgatgataggtcttcggtgttttcctccacttccttaactcaagcctcaatatcaacctctgatgcaggaacaggatcacaaaccggacgaacacgggtggatggaaaagagttctttcgccaagtcaggaaccgtttgtcttatgaacaatttggtgcattcttggcaaatgttaaagaattaaacgcccataaacaaacaaaagaggagacactacggaaagctgatgaaatttttgggcctgaaaacaatgatctgtacaatgtatttgaaggattgattaatcgcaatgtccattgatgttgtgctttggggaagttttattcccagtttgtaataatggataccatcctctccttatagcatctcctttcccccctgtatatcaaattatctcgttaattattatgtaacgcaataattttttgtatataaaaccagtatatttcatttca

SEQ ID NO: 1747 - DNA, 1277 bp, Vigna unguiculata
aaaaccaagaaaaacaaaaacatacaatagtaatattaatattaaaaacagaaacaaagggggtaaggtaacacccgctatggcggcggaatcgggtggtagtgcaaacttcgaccttcccgaggagatgatgcaagtgctaccgtccgatcccttccaccagctcgatgtggctcgcaaaataacttccattgctctgtcgacacgtgtcaacgccctcgaatcagagctgtccacacttcgcactcagatcgccgacaaagacaacctcatcgccgaccttcagtctcaaatcgactccctcgatgcctccctgtccgaaaccgccgacaaactcctcctcgccgaacaagataaggagagcttactgcaggagaatgcttcgctttccaacactgtcaaaaagctcaatcgagatgtctccaagttagaggttttcagaaagacgcttatgcaatcacttcaggaagaggatgataattctggaggagctccagacattgttgctaaaatacagaaccaatcaaattttacttccacgtcacagtttggagacaatgacgcaccattggcaccgtctatatcttcttcaacaggaaattctttggtcgaagaacctgaatctgatgcagcaccaagacctagagtacctcagaaccttctcttagcatctcaaggttccacccctcggattactccccctggttcccctcctagtctgtctgcatcagtatcacctacgagaacatccaaacctgtatctccaaggcgacattcagtttccttttcaaccacaagaggcatgtttgatgataggtcttcggtgttttcctccacttccttaactcaagcctcaatatcaacctctgatgcaggaacaggatcacaaaccggacgaacacgggtggatggaaaagagttctttcgccaagtcaggaaccgtttgtcttatgaacaatttggtgcattcttggcaaatgttaaagaattaaacgcccataaacaaacaaaagaggagacactacggaaagctgatgaaatttttgggcctgaaaacaatgatctgtacaatgtatttgaaggattgattaatcgcaatgtccattgatgttgtgctttggggaagttttattcccagtttgtaataatggataccatcctctccttatagcatctcctttcccccctgtatatcaaattatctcgttaattattatgtaacgcaataattttttgtatataaaaccagtatatttcatttcaataaaaaggaaaaa

SEQ ID NO: 1748 - DNA, 1484 bp, Cajanus cajan
aatacaaagaattttattattaaaggaaaaaaaagaagtatttagaatagtggatccatgtgatgagccaaagccaacccgctacccaccaaatgaagaagagaatcagagaagataaaataaacaaaaagaaaactagaaaagtgagtaagtagcatataataataatattaaaaagagagagagaagaagagaaggtataggcgatggcggcggaatcgggtggtagtacaaacttcgatcttcccgaggaggtggtgcaagtgctaccgtcagatcccttccagcaactcgacgtggcacgcaagatcacctccattgctctatccacacgtgtcaatgccctagaatcagacctctccacacttcgcgcccagatctctgagaaggatgacctcatcgccgaccttcaatctcagctccactctctccacgcctcactctccgaaaccgccgacaaactcctccgcgctcaacaggataaggagagcttgctcaaggagaatgattcgctttccaacaccgtcaaaaagctcaatcgcgatgtctccaagttagaggttttcagaaagacgcttatgcaatcacttaaggaggatgatgataattctggaggaaccgcagacattgttgctaaaatacagagtcaatcaagtttgacttccacgtcgcagtttggagataacgatgcttcattgccaccttctatatcttcttcaacaggaaattattttgctgaggatcaggaatctgatgccataagacctagagtaccacagaatctcatcttagcatctcaaacttccacccctcggattactccccctggttctcctcctagtttatctgcatcagtatcacctacgagaacatctaaacctgtatctccaaggcgacattcaatttccttttcaaccacgagaggcatgtatgatgacaggtcttccgtgtttgcctcgatatcaaccaatgaccctggaacaggatcacaaactggacgaacacgggtggatgggaaggagttctttcggcaagtcaggaaccgtttgtcttacgagcaatttggtgcattcttggcaaatgttaaagaactgaattcccataatcaaacaaaagaggagacgctacggaaagctgatgaaatttttgggcctgaaaacaaggatctgtacactatatttgagggtttgattaatcgcaatgtccattgacattgtgcccgggggagttttattccaagtatgtaataacggatactatcgtctccttatagcaactccttttttctccccttttgtatatgaaattatcacattgattattacctgataaataattttttaaacatgtaatttaatttgggcgaatggcattcttgataggaggaccaacaaggttgcataattgtagtggggatggggtgtatactgtaattttaatattcaatgccaagcatagcgtaatctatcttccttttctggaaa

SEQ ID NO: 1749 - DNA, 1340 bp, Cajanus cajan
cggggggagtaagtagcatataataataatattaaaaagagagagagaagaagagaaggtataggcgatggcggcggaatcgggtggtagtacaaacttcgatcttcccgaggaggtggtgcaagtgctaccgtcagatcccttccagcaactcgacgtggcacgcaagatcacctccattgctctatccacacgtgtcaatgccctagaatcagacctctccacacttcgcgcccagatctctgagaaggatgacctcatcgccgaccttcaatctcagctccactctctccacgcctcactctccgaaaccgccgacaaactcctccgcgctcaacaggataaggagagcttgctcaaggagaatgattcgctttccaacaccgtcaaaaagctcaatcgcgatgtctccaagttagaggttttcagaaagacgcttatgcaatcacttaaggaggatgatgataattctggaggaaccgcagacattgttgctaaaatacagagtcaatcaagtttgacttccacgtcgcagtttggagataacgatgcttcattgccaccttctatatcttcttcaacaggaaattattttgctgaggatcaggaatctgatgccataagacctagagtaccacagaatctcatcttagcatctcaaacttccacccctcggattactccccctggttctcctcctagtttatctgcatcagtatcacctacgagaacatctaaacctgtatctccaaggcgacattcaatttccttttcaaccacgagaggcatgtatgatgacaggtcttccgtgtttgcctcgatatcaaccaatgaccctggaacaggatcacaaactggacgaacacgggtggatgggaaggagttctttcggcaagtcaggaaccgtttgtcttacgagcaatttggtgcattcttggcaaatgttaaagaactgaattcccataatcaaacaaaagaggagacgctacggaaagctgatgaaatttttgggcctgaaaacaaggatctgtacactatatttgagggtttgattaatcgcaatgtccattgacattgtgcccgggggagttttattccaagtatgtaataacggatactatcgtctccttatagcaactccttttttctccccttttgtatatgaaattatcacattgattattacctgataaataattttttaaacatgtaatttaatttgggcgaatggcattcttgataggaggaccaacaaggttgcataattgtagtggggatggggtgtatactgtaattttaatattcaatgccaagcatagcgtaatctatcttccttttct

SEQ ID NO: 1750 - DNA, 1301 bp, Lotus japonicus
ggaaaaagtggcaggaaattatcgattaaccaactatggcggcggaatcgggagatttgaacttcgatcttcccgatgacctcgtgcaagtgctaccgtcagatcccttcgaacaactcgacctggcccgcaagatcacatccattgcgctttcagcacgtgtcaacgccctcgaatcagagtcgtcggaacttcgcgccaggatcgccgagaaggatcacctcatcgccgagcttcagtcgcagttggactccctcgacgccacactctccgccaccgccgataacctccaccgtgccgaacaagataaggagagtttgatcaacgagaatgcttcactttccaacactgttagaaagctcaatcgagatgtctccaagttggaggttttcagaaagacacttatgcgatcacttcaggaggaggatgataattctggaggagctccagacatggttgctaaagtacaaagtcaatcaagtttgacttccacgtctcagtttggagataatgaagcttcattaccaccatccgtatcttcttcagtgccctcaatttctgatactggaaattcttttgctgaggatcatgaatctgatgccataagacctagagtaccatatagtctcctcttagcatcccaatctaccacccctcggctcactccccctggttctcctcccagcctgtctgcatcagtatctcccacaagaacatctaaacctgtgtctccaaggcggcattcaatttcctttgcaacctcaagaggcatgcatgatgataggacttcagtgttttcctcgatgtcaagctctgactccggagcaggatcacaaactggacgaacacgggtggacggaaaggagttctttcgccaagtcaggaaccggttgtcttacgagcagttcggtgcattcttggctaatgttaaggagctgaattcccataaacaaacaagagaggtgacgctgcagaaagctgatgaaatttttggaccagaaaacaaggacctgtacaatatatttgaggggttgattactcgcaatgtccattgacattgtgcctaggagaagctttattccgagtttgtattccactgtatattacatgtttattagtgtgtaataaaacattttttgaacatgaaaaagcatgtgaatttgaattaacaaatgatatttcatgatagggcaacagggtttccactttccactggtttccttgtattggttgcaaagcatggagtaattattagaaaatacaaattataacaaaagatatattattgctgccgagcagag

SEQ ID NO: 1751 - DNA, 960 bp, Glycine max
acccttgttccttctcacttcacaacacctcacccattttccactctttcccttctaccttgttccacctcttaatttttctaacaaaatggaggaaagtgtgctaacaaagaggccaagagaagaagaacccctagagaacaaagatagtacttatgaattactagagtccttatcaaagaggcacaggtcatacaaccacatactctccctccttgaatcagaggaagatgactccacacaagacctatcttctctcatcacttccctccaacaagaaatcaccaattgtgcctctgattcggacacccttttgaaccaacacagcctcaccaacaccaccaccaccaccacaacaaatagtaatttagaggattgttcatcctcaacaactaaatattctagtgacatgatggaggaacatgatgacaaagaaggggtcatgagacaccttcttgaagcttctgatgatgaacttgggattccaaataaagaggatgaatcactcgatcttggtgaagatgggttcaagttcaacggtggagacatgttttcttcaatttgtgatgggttgttgtgggagcttgaagatgaagctgctaactactatgatcttttgcagtctcaactctttctctagttttttttttttggtgggggatagaaagtgaaaaaccatagttttcatgcgttcaagatgaaatccaaggaggaaaaaaatgaaaaatttactagtttttattttttcatttttttgtcccctctttttgtaaattaaaatcatgggacgtttatgtgtggttggttactacttggcaatatgtcgatctgtagaaaaagcagctaggcttatatattcacattacacaaagtaattaattagctagtaatgatcttctaaactatttcatatgttaattttattgacttttaagggtaaatgaaaattacttcttttta

SEQ ID NO: 1752 - DNA, 1375 bp, Solanum tuberosum
aaaaccctttgtttgagtgtgttaacaagaaagagatggctggtgaatttagctccctctttcacaagatcaagccttatttggctatggtatctttgcaatttgggtatgcagggatgtatattgtcaccatgatgtgtttcaaaagaggaatgagtcattggattcttgttgtctatagacatgcatttgccaccattgctgttgcaccctttgctatcgttctcgaaaggaaaataaggccaaagatgacactcaggatctttattaagatagtggctcttggttttctagagccagtgattgatcagaatttgtactatttgggactgaagagcacaactgcaacttatgcatctgcctttgttaatctcctcccagcagtaacctttattctggctgtaattttcagaattgagaaagtaaacctgaagaaaaaatcaagtatggcaaaggtgataggaacagcaataacagtggttggagcaatggtgatgactctttacaaagggccaatgttcaacctggtcccacgtcacggtggcgcccaccatgaagcctcaaccgcgacccctgagaattgggttgccggaaccattgagctcatcgcttgcattgttggttggtccggtttctttattgttcaatcgatgacactgaaggagtaccccgcagagttatctctagcagcatgggtatgtgtgatgggggtagtggaaggtggaattgttgcacttataatggaacgtgattggaatgcttgggttattggctttgactctaggctacttgctgctgcctattctggtattgtatgctcaggaattgcatattatgtgcaaagtgtggttaataaagtaaaaggaccagtatttgtgacagcctttagcccattaagtatggtcatcacttcagttcttgctgctattatcttggctgagtcagtccatcttggaagcttaattggagcagttatcatagtcgtgggactatattctgtggtgtggggcaagagtaaggaagggaaaggaaatcaaatcactagcaaagatcaagaattaccagttgtggatatcaaagaaagatcaactattgttgatgatattattgagaagaaaactccaatcttccaagagcattaacatgaccaaaaaacaaagaagatgtggtatctttaaatctgtaattttaatttttgacttgttgcaatgttaaattttttaagtgttgctgtaaaacaatgcactaatgttagtgatcaattgttgcttgatggaagggggaaaaaaaagtgtaatctactttttgtgtaaaagttaaggagtggtatctccatttgggaatgaaaaatgaaaatatttatattatgtacctc

SEQ ID NO: 1753 - DNA, 1374 bp, Solanum phureja
aaaaccctttgtttgagtgtgctaacaagaaagagatggctggtgaatttagctccctctttcacaagatcaagccttatttggctatggtatctttgcaatttgggtatgcagggatgtatattgtcaccatgatgtgtttcaaaagaggaatgagtcattggattcttgttgtttataggcatgcatttgccaccattgctgttgcaccctttgctatcgttctcgaaaggaaaataaggccaaagatgacactcaggatctttattaagatagtggctcttggttttctagagccagtgattgatcagaatttgtactatttgggactgaagagcacaactgcaacttattcatctgcctttgttaatctcctcccagcagtaacctttattctggcagtaattttcagaattgagaaagtaaacctgaagaaaaaatcaagtatggcaaaggtgataggaacagcagtaacagtggttggagcaatggtgatgactctttacaaagggccaatgttcaacctggtcccacgtcacggtggcgcccaccatgaagcctcaaccgcgacccctgagaattgggttgccggaaccattgagctcatcgcttgcattgttggttggtccggtttctttatcgttcaatcgatgacactaaaggagtatcctgcggagttatcactagcagcatgggtatgtgtgatgggggtagtggaaggtggaattgttgcactaataatggaacgtgattggaatgcttgggttattggctttgactctaggctacttgctgctgcctattctggtattgtatgctcaggaattgcatattatgtgcaaagtgtggttaataaagtaaaaggcccagtatttgtgacagcctttagcccattaagcatggtcatcacttcagttcttgctgctattatcttagctgagtcagtccatcttggaagcttaattggagcaattatcatagtcatgggactatactcagtggtgtggggcaagagtaaggaagggaaaggcaatgaaatcactagcaaagatcaagaattaccagttgtggacatcaaagaaagatcaactattgttgatgatattattgagaagaaaactccaatcttccaagagaattaacatgaccaaaaaacaaagaagatgttgtatctttaaatctgtaattttaatttttgacttgtttcaatgttaaattttctaagtgttgctgtaaaacaatgcactaatgttgtgatcaattgttgcttgatggaaggggaaaaaaaagtgtaatctactttttgtgtaaaagttaaggagtggtatctccatttgggaatgaaaaatgaaaatgttatattttatgtacctc

SEQ ID NO: 1754 - DNA, 1328 bp, Capsicum annuum
tcagcatagtagtgcttctttgtgtgtagaaagaagagatggctggtgcatttagctccttccttaacaaggtgaagccttatttggctatggtgtccttgcagtttgggtatgcagggatgtatattgtaaccatgatgtgcttcaaaaggggaatgagtcactggattcttgttgtctatcgacatgcatttgccaccattgctgttgcgccctttgctatcgttcttgaaaggaaaataaggccaaagatgacagtcagggtctttattaagatagtggctcttggttttctagagccagtgattgatcagaacttgtactatttgggactgaagagcacaactgctacctatgcatctgcctttgtcaatctcctcccggcagttacctttattctggctgtaattttcagaattgagaaagtaaacctgaagaagaaatcaagtatggcaaaggtgatagggacaacaataacagtggctggagcaatggtgatgactctttacaaaggccctatgttcaacttggtcccacacgctcacagtggcgtccaccatgaggccgcaggcgccactgctgagaactgggtcgctggaaccattgagctcatctcttgcattgttggttggtccggtttctttattgttcaatcgatgacactgaaggagtacccagcagagctatctctggcagcatgggtatgtgtgatgggtgtagtggaagggggaattgtagcacttataatggaacgtgactggaatgcatgggttattggcttcgactctaggctccttgctgccgcctattctggtattgtatgctctggaattgcatattatgtgcaaagtgtggttaataaagtaaaagggccagtgtttgtgacagcctttagcccattgagtatggtcatcacttcagttcttgctgctattatcttggctgagtcagtccaccttggaagcgcgattggagcaattatcatagtcatcggactttactcggttgtgtggggcaagagtaaggaggggaatggaaatgaaatcactggcaacgatcaagaattaccagttgtggacatcaaagagaggtcaacgattgttgatgataataacactgagaagaaggcttcaatcttccaagagctctaacatccaaaacaaagaagctgtactttttaagtttgtaattttaatttttgacttgttggattgttaaaacttccaagtgttgctttgaaacaatgctctaatattgtcaattaatgttgccctgatgaacaaaaatgtgtaatctacttttgtgtaaaagttaaggagtggtctctc

SEQ ID NO: 1755 - DNA, 1517 bp, Solanum melongena
agttagtgcaacaatgaataagctagactatattttggttttcaatatttctaatttataaaactcttataataataataataataattattggttaagctttttcacttttgcgtcgtgtataaaaggggacacacttgctatatttccataccccatcctaaaaccccttgtttgtgtgttagaaagaagagatggctggtgcatttagctccttccttaacaaggtgaagccttatttggctatggtatccttgcaatttgggtatgcaggaatgtatattgtgaccatgatgtgtttcaaaaggggaatgagtcattggattcttgttgtttatagacatgcatttgccaccattgccgttgcaccctttgctatcgttcttgaaaggaaaataaggccaaagatgacactaagggtttttattaagatattggctcttggtttcctagagccagtgattgatcagaacttgtactatttgggacttaagaacacaacggcaacctatgcatctgcctttgtcaatctcctcccagcagtaacctttgttctggctgtaattttcagacttgagaaagtaaacctgaagaagaaatcaagtatggcgaaggtgataggaacaacaataacagtggctggagcaatggtgatgactctttacaaagggccaatgttcaacctggtcccacatggtcatcgtgaggtcaaccatgaagctgcagccgcgaccgccgagaactgggtagccggaaccattcagctcattgcttgcattgttggttggtccggtttttttattgtacaatcaatgacactgaaggagtacccagcagagctatctctagcagcatgggtatgcgtgatgggggtagtggaaggtggaattgttgcacttataatggaacgtgattggaatgcttgggttattggcttcgactctaggctcctggctgctgcttattctggtattgtatgctcaggaatcgcatattacgtgcaaagtgttgttaataaagtaaaagggcctgtgtttgtgacagcctttagcccattaagtatggtcatcacttcggtacttgctgctattattttggctgagtcagtccatcttggaagtgtgattggagcaattatcatagtcatgggactatactcagtggtgtggggaaagagtaaggaagggaaaggaaatgaaatcactagcaaagaccaagaattaccagttgtggacatcaaagaaagatcaactattgttgatgataacattgagaagaaggctccaatctttcaagagcattaattaacacccaaaacaaaaaagttttatctttaaatttgtaattttaatttttgacttgttgcaatcttaaaatttttaagtgatgctgtaaaacaatgcactaatgttgtcaattgttggctgatgaagaaacatgtgtaatctactttctgtgtaaaagttaaggagtggtctctccatttgggaatgaaaaatgaagatgttttattttag

SEQ ID NO: 1756 - DNA, 1468 bp, Nicotiana tabacum
  misc_feature (1434)..(1434): n is a, c, g, or t
ccccagcctaaaactaaccccttcattctttgtgtgtagaaagaagagaaggagagaaatggcagaccaaatgttttgtggggcatttggcccattcctcaacaaggtgaagccttacttggctatggtttccttgcagtttggttacgcagggatgtatattgttacaatgatgtgcttcaaaaggggaatgagtcactggattcttgttgtctatcgccatgcatttgccacccttgctgttgcaccctttgccattgttcttgaaaggaaaataaggccaaagatgacactcagggtctttattaaaatattggctcttggttttctagagccagttattgatcagaacttgtactatgtgggactgaagagcacaactgcaacctatgcatctgcctttgtcaatcttctccctgccgtcacctttattcttgcagttattttcagaattgagaaagtaaacctgaagaagaaatcaagtatggcaaaggtgataggaacagcaataacagtggcgggagcaatggtgatgacactttacaaaggcccaatgttcaacctggtcccacactctcgcggcggcagccacactgcagccgccgcgtccacccccgagaactgggtcgccggaaccattgagctcatctcttgcattgttggttggtccggtttctttattgttcaatcgatgacattgaaggagtacccagcagagctatctctggcagcatgggtatgtgtgatgggcatagtggaaggaggaattgttgctcttataatggaacgtgattggaatgcatggaaaattggcttcgacgctaggctccttgctgctgcttattctggaatcgtttgctcgggaattgcatattacgtgcaaagtatagttaataaagttaaaggcccagtgttcgtgacagcctttagccctttgagtatggtcatcacttctgttcttgctgctattatcttggctgagtcagtccaccttggaagctgcattggagcagttatcatagtcatgggactttactctgtggtgtggggaaagagtaaggagggtaaaggaaatgagacaggaaaagaccaagaattaccagttgtggacatcaaagaaaggtcaaccatagttgacgatattagtgatgatgttacgactgtgaaatcaaaggttccagctgagaagaaggcttcaatcttgcaagagctgtagcatccaaaaatgaagctgtctttgcaattttaatttttgacttgttgcaatgtttaaatttctaagtgttgctttgaaacaatgcactaatgttgccgattgttcttgatgaaaaaaatgtgtaacctactttttgtgtaaaagtcaaggagtggtctctccatttgggaatgaaaaatgaaaatgttctaatttacccttaaaattaaatgggtagnaaaagcttcgcgttcagctttttattcttgagcg

SEQ ID NO: 1757 - DNA, 1339 bp, Nicotiana benthamiana
  misc_feature (1332)..(1332): n is a, c, g, or t
atctaaccccttcattctttgtgtgtagaaagaagagaaggagagaaatggcagaccaaatgttttgtggggcatttggcccattcctcaacaaggtgaagccttacttggctatggtttccttgcagtttggttacgcagggatgtatattgttacaatgatgtgcttcaaaaggggaatgagtcactggattcttgttgtctatcgccatgcatttgccacccttgctgttgcaccctttgccattgttcttgaaaggaaaacaaggccaaagatgacactcaggatctttattaaaatattggctcttggttttctagagccagttattgatcagaacttgtactacgtgggactgaagagcacaactgcaacctatgcatctgcctttgtcaatcttcttcctgccgtcacctttattcttgcagttattttaagaattgagaaagtaaacctgaagaagaaatcaagtatggcaaaggtgatcggaacagcaataacagtggcgggagcaatggtgatgacactttacaaagggccaatgttcaacctggtcccacactctcgcggcggcagccacactttagtcgccgcggcaacccccgagaactgggtcgccggaaccattgagctcatctcttgcattgttggttggtccggtttctttattgttcaatcgatgacattgaaggagtacccagcagagctatctctggcagcatgggtatgtgtgatgggcatagtggaaggaggaattgttgctcttataatggaacgtgattggaatgcatggaaaattggcttcgacgctaggctccttgctgctgcttattccggaatcgtgtgctcgggaattgcatattatgtgcaaagtatagttaataaagttaaaggcccagtgttcgtgacagcctttagccctttgagtatggtcatcacttctgttcttgctgctgttatcttagctgagtcagtccaccttggaagctgcattggagcaattattatagtcatgggactttactctgtggtgtggggaaagagcaaggaggggaaaggaaatgagacaggaaaagaccaagaattaccagttgtggacatcaaagaaaggtcaaccatagttgatgatattagtgatgatgttacaactgtgaaatcaaaggttccagctgagaagaaggcttcaatcttgcaagagctgtagcatccaaaaatgaagctgtctttccaattttaatttttgacttgttgcaatgtttaaatttttaagtgttgctttgaaacaatgcactaatgttgtcaattgttcttgatgaaaaaaatgtgtaatntactttt

SEQ ID NO: 1758 - DNA, 1422 bp, Nicotiana benthamiana
  misc_feature (979)..(979): n is a, c, g, or t
atctaaccccttcattctttgtgtgtagaaagaagagaaggagagaaatggcagaccaaatgttttgtggtgcaattggcccattcctcaacaaggtgaagccttacttggctatggtttccttgcagtttggttacgcagggatgtatattgttacaatgatgtgcttcaaaaagggaatgagtcactggattcttgttgtctatcgccatgcatttgccacccttgctgttgcaccctttgccattgttcttgaaaggaaaataaggccaaagatgacactcagggtgtttattaaaatattggctcttggttttctagagccagttattgatcagaacttgtactatgtgggactgaagagcacaactgcaacctatgcatctgcctttgtcaatcttctccctgccgtcacctttattcttgcagttattttcagaattgagaaagtaaacctgaagaagaaatcaagtatggcgaaggtgataggaacaacaataacagtggcgggagcaatggtgatgacactttacaaagggccaatgttcaacctggtcccacactctcgcggcggcagccacactgcagccgccgcagccacccccgagaactgggtcgccggaaccattgagctcatctcttgcattgttggttggtccggtttctttattgttcaatcgatgacattgaaggagtacccagcagagctatctctggcagcatgggtttgtgtgatgggcatagtggaaggaggaattgtagctcttataattgaacgtgattggaatgcatggaaaattggcttcgacgctaggctccttgctgctgcttattctggaatcgtttgttcgggaattgcatattatgtgcaaagtatagttaataaagttaaaggcccagtgttcgtgacagcctttagccctttgagtatggtcatcacttctcttcttgctgctattatcttggctgagtcagtccnccttggaagctgcattggagcaattatcatagtcatgggactttactttgtggtgtggggaaagagtaaggaggggaaaggaaatgagacaggaaaagaccaagaattaccagttgtggacatcaaagaaagatcaatcatagttgacgatattagtgatgatgttacgactgtgaaatcaaaggttccagctgatcagaagaaggcttcaatgttgcgagagctgtagcatccaaaaatgaagctgtctttgcaattttaatttttgacttgttgcaatgtttaaatttttaagtgttgctttgaaacaatgcactaatgttgtcaattgtttttgatgaaaaaaatgtgtaatttactttttgtgtaaaagtcaatgagtactggtctccccatttgggaatgaaaaatgaaaatgttttaatttacccttaatgggtagt

SEQ ID NO: 1759 - DNA, 752 bp, Solanum phureja
aacgcaattgtatctctcaattttcccctttgtgtattataatcatgagccgacatcctactatcaagtgggctcagaggtctgataagttgtttattacggtggagttaccggatgccaagaatgtgaagctgaaactggaaccagaaggaaaattcttgttctctgcaactgcaggagatgataatgtaccgtatgaagtggatctcgatctgtttgataaaattaatgttgatgagagcaaaagtagtactacctctagaagtatcgtgtatctagtgaagaaggcggaagagaagtggtggagcagactgataaagcaggaaggattacgtccggtatttttgaaagttgattgggacaaatgggttgatgaagatgaagaagacggtaaacctgagccggatatggatttcggtgacatggacttttcgaaactcaacatgggagaaggtcctagtgattttgatgctgatgtgcctgaggacgatgatgacagcgacactgaagaaattgaggaagaagaaaactctgaacctaaggcagcagtgcctctaagcaccgaacccaaagtgaaagcttgatgcgtttgtaacattgaaaacttttaaatgcttgagtttgagtctggtacttcatctagctatggttagagctgtagtgcaggaaatgtttgatgatcagttcatgatatatttgaaggatctgaaagtgctggtgtcctctttgaacgttgttatcatctactccac

SEQ ID NO: 1760 - DNA, 739 bp, Solanum tuberosum
ccaattttcccctttgtgtatataatcatgagccgacatcctactatcaagtgggcctcagaggtctgataagttgtttattacggtggagttaccggatgccaagaatgtgaagctgaaactggaaccagaaggaaaattcttgttctctgcaactgcaggagctgataatgtaccatatgaagtggatctcgatctgttcgataaaattaatgtcgatgagagcaaaagtagtactacctctagaagtatcgtgtatctagtgaagaaggcggaagagaagtggtggagcagacttataaagcaggaaggattacgtctggtgtttttgaaagttgattgggacaaatgggttgatgaagatgaagaagatggtaaacctgtgccggatatggatttcggtgacatggacttttcgaaactcaacatgggagaagatcctagtgattttgatgctgatgtgactgagggagacgatgatgacagtgacactgaagaagttgaggaagaagaaaactctgaacctaaggcagtagtgcctccaagcaccgaacccgaagtgaaagcttgatgcgtttgtaacattgaaaactttttaaatgcttgagtttgagtctgagtctggtacttcatctagctatggtttagagctgtagtgcaggaaatgtttgatgatcagttcatgatatatttgaaggatctgaaagtgctagtgtcctcattgatgattgaaaaaaaa

SEQ ID NO: 1761 - DNA, 796 bp, Solanum melongena
agagcaattttatacatcaaaatatctctcaattttcatctctgtgttttataatgatgagccgacatcctactgtcaagtgggcccagaggtctgataagttgtttatcacggtggagttgccggatgctgagaatgtgaaggtgaagctggaaccagaaggaaaattcttcttttctgcaactgcaggagctgatcatgtgccatatgaagtagatcttgatctttttgataaaattaatgttgatgagagcaaaagcagtcatacttctagacatatcgtgtatctaatcaagaaggcagaagagaagtggtggagcagactgataaagcaggaacgtttacgtccggtgtttttgaaagttgactgggacaaatgggttgatgaagatgaagaaaatgctgggccagatatggatttcggtgacatggacttttcgaaactcaacatgggagaaggtcccagcgattttgatgctgatgttcctgagggagacgacgatgacagtgacactgaagaagttgagggagaagagaactctgcacatagtgaacctaaggcagcagcgcctccgagcactgagcccgaggcgaaagcttgatgtgtaacatttgaaaacctctttaactgcttgatagtactatcactagcttagagctgtagtgcaggaaatgtttgatgtgatcagttcatgattatatatatttgaagaatctgaaagtgctggattttgttatcatgtactctgctcgcgcttttcggctgtatatgatttgtccaatgggattgagttac

SEQ ID NO: 1762 - DNA, 779 bp, Capsicum annuum
cttgtatgcaccaaaatatctcgtaatttcctccttgtctattctcctttctccagtgaaacgccataaccatgagccgacatcctactgtcaagtgggcccagaggtccgacaagttgtttatcacggtggagttgccggatgccaagaatgtgaagctgaaactggaaccagaaggaaaattcttcttttctgcaactgcaggagctgataatttaccttatgaagtggatctcgatctctttgataaaattaatgttgaggagagcaaaagtagcagcacttctagaagtatcgtgtatctagtgaagaaggcagaagacaagtggtggagcagactgatcaagcaggaaggtttacgtccagtgtttttgaaagttgactgggacaaatgggttgatgaagatgaagaagatggtaaacctgggccagatatggatttcaacgacattgacttttcgaaattcaacatggaagaaggtcctagcgattttgatgctgatgtgcctgaaggagatgacgatgatgacagtgacgctgaaggagtcgtggaggaagaagattctgcacatagtgaacctaaggcagcggtgcctcccagcaacgaacccgaagcaaaagctagcatttgaactttgagaacacatttaactgcttgagttaggtttggtacttttagttgtgattaaagctgtagtgcaggaaatgttgatgatgtatctgaaagtgaacttgtttctctccgtttgtagatgaaggtcatgctgtccgaaccccat

SEQ ID NO: 1763 - DNA, 785 bp, Capsicum annuum
acgaggcttgtatgcaccaaaatatctcgtaatttcctccttgtctattctcctttctccagtgaaacgccataaccatgagccgacatcctactgtcaagtgggcccagaggtccgacaagttgtttatcacggtggagttgccggatgccaagaatgtgaagctgaaactggaaccagaaggaaaattcttcttttctgcaactgcaggagctgataatttaccttatgaagtggatctcgatctctttgataaaattaatgttgaggagagcaaaagtagcagcacttctagaagtatcgtgtatctagtgaagaaggcagaagacaagtggtggagcagactgatcaagcaggaaggtttacgtccagtgtttttgaaagttgactgggacaaatgggttgatgaagatgaagaagatggtaaacctgggccagatatggatttcaacgacattgacttttcgaaattcaacatggaagaaggtcctagcgattttgatgctgatgtgcctgaaggagatgacgatgatgacagtgacgctgaaggagtcgtggaggaagaagattctgcacatagtgaacctaaggcagcggtgcctcccagcaacgaacccgaagcaaaagctagcatttgaactttgagaacacatttaactgcttgagttaggtttggtacttttagttgtgattaaagctgtagtgcaggaaatgttgatgatgtatctgaaagtgaacttgtttctctccgtttgtagatgaaggtcatgctgtccgaaccccat

SEQ ID NO: 1764 - DNA, 1444 bp, Nicotiana tabacum
acattctgtctttcttcttcttcccttagattcaacgaggcgatttttccattattttgctatgattctttctaaaaaacacatttttttgctatttgtgtcaatttctttgcttctaattccagcaagcgctatcagaggatttattgagaagcctaaggcaaattttgatggatatttgagatatgttgaatctccagagtatagaaatagcgaagaatgtccaattttagagtcagatttatcagtttgtgacccaaatttgatacatatagctatgactcttgattcacattattttagaggttcaatagcagcagtacactcagttttaaagcatacttcttgtcccgaaaatatttatttccatttcgtgacctccaaagatttcgattttcaacagttgacacaaacagttatgtctatatttccatctctgagcttcaaagtttacagctttgatgaattacgtgtcaagaatttgatatcatcttcaattcgtcaagctcttgataatccattaaattatgctagaacttatttagctgagattattgagcattgtgttgaaagggtaatttatttggattctgatgtgattttagttgatgatattcaaaagctatggtcgatttcattaactggttcaagaattattggagctccagaatattgtcatgctaatttcagaacatatttcaatgacaatttttggtctgacacaaaattctcaaaggtatttcaaggtaaaaagccatgttattttaatacaggggtaatggtaatggatttaggaaaatggagaaaaggagattatactgaaaagattgaaaattggatggaaatacaaaagaagaagaggatatatgaattgggatcattgccaccatttatgttagtatttggaggagaaattgaaggaattgatcataaatggaatcaacatggattaggtggagataatttggtgaatagttgtagaacattgcatccaggtccagttagtttattgcattggagtggtaaaggtaaaccttgggttagacttgatcaaggaaatccttgtcctgttgatcttttatgggcaccttatgatttgtatagattgagccttcacttatagattgagccttcagattgtgatctgatagtgtaaaatttattttaggctattagtgtataggagtttaaattcttttttctttttcttttttccattgtgaaaattctttgattctttttcctcattggggagaagttgagaaacaccgtctgtacttgatagtgttaggtacaggggacgattttgatgagtctcctgtgagtgattttgtgtgtgtataagagcaaacgattgaataaagggaattttacctctctgaaaatttctcttgtaatcagagtagtcttttgatattttcgtcaagtttcataagagaaaagg

SEQ ID NO: 1765 - DNA, 1631 bp, Solanum lycopersicum
attctagtacacgtgtcaagactatccatcttcattcacactcaaaatcctttcgcttcaaataggaccacattctgttttacttcacatcacctctaacaataaaatttctgtcagaaaaaaaaaaacaggtgctccaaaatacaatgggcatgggcaaggaaactctctccaccacagatacaaccggcgctaccttcaagctagttggcttcaataatttcatccgcgctaatccccgttccgatttcttctccgttaaacgcttccaccacatcgaattctggtgcggcgatgcaaccaatacatctcgtcgtttctcttggtctcttggcatgccgattacagcaaaatcagacctctccaccggaaattcagttcatgcgtcgtatctcctccgttctgtttcaggcgaacttcaatttgttttcactgctccttattcgccgtcaatttcagtaccgtcaacggcaggtatacctagtttttccacccctacttatcgggattttacggcgaagcatggtcttggtgttcgtgctgttgcgttggaggtggagaacgcttacctggcgttctccgctagtgtggctcgtggggcgaaaccccggtttgaacctgtaacgattgatgagcatgtggctgttgctgaagttcatctatatggcgatgtcgttttgcggtttgtgagtcttgttaaagatgcggataccctcattttcctaccaggttttgaggccatggatgaaacatcatcattcaaggaactggattatgggattcaccgactggaccatgccgttgggaatgtgccggagttgggtcctgtagtggactacatcaaggcatttacggggtttcatgaatttgcggagtttacagctgaagatgttggaactgctgagagcgggctgaactcagttgtgttggcaaacaatgacgagacagtattgcttccgttgaatgagccggtatatggaactaaaaggaagagtcaaattcagacttatttagagcataatgaaggggcaggagtgcaacatttagctttggttactgaggatatattcagaacattgagggaaatgtggaaaaggagtggagttgggggatttgaattcatgcctgcacctccgcctacttattataagaatttgagaagtagggccggggatgtactcagtgacgaacaaatccaggcgtgtgaagaattggggatcttggttgacagggatgatcaggggactctgcttcagatatttaccaagcctgtgggagacaggccaacaatatttatagaaataattcagagaatcgggtgcatgctcaaagatgaaaaaggacaagtctatcagaagggcggttgtggaggcttcggtaagggaaacttctctgagctgtttagatcgatcgaggaatacgagaagatgcttgaagccaaacatgttaatcaagtagctgctgtcgaatgaatatatacgagcattagcttgcaatctaattgaaatttgaaaggggcatctaagcttccatttgatctttctacaattaattatgaaataaaaaatagctgttgtgtaaatagcatggagggaaacaaagtcaagtaatttaagtataatgttgatcat

SEQ ID NO: 1766 - DNA, 439 bp, Petunia hybrida
caggccaacaatatttatagaaataatccagagaataggttgcatgctcaaagatgaagaagggcgggtttatcagaagggcggatgtggaggtttcggtaaggggaacttttcagagctctttagatctatcgaagaatacgagaagatgcttgaagctaaacatgttaatcaagtagctgctgcttgaatatacaagcatgagctttttttctgccctgtccaaatgacatttacaggtggacaaagggcgtttagtatttgatgtgtctattattaatgaaagaaatagcttctgtatataagtttatctgacatgctctttgtgtgaagagttgctacggaatagaaggacgaaaactttagcaatttagtgcaaggatgattgtaccagttgaaagagtatactattaatcataagtgctgtattctgttacaa

SEQ ID NO: 1767 - DNA, 1633 bp, Solanum tuberosum
gatcttaacaataaaatttctgtcagagtctaaaataaactctaaaataccatgggcatgggaaaagaaactctctccaccaccactacagatgaaaccggcgctactttcaagctaggcttcaacaatttcatccgcgctaatccccgttccgatttcttctccgttaaacgcttccaccacatcgaattctggtgcggcgatgcaaccaatacatctcgtcgtttctcatggtctctcggcatgccgattacagcaaaatcagacctctccaccggaaactccgttcatgcttcttatctcctccgttctgtttccggcgaacttcagtttgttttcactgctccttattcgccgtcaatttcagtaccgtcaacggcaggtatacctagtttttcaacgtctactcatcgggattttacggcgaagcatgggctcggtgttcgtgctgttgcgttggaggttgagaatgcttacctggcgttctccgccagtgtgtcccgtggggcgaaacctcggtttgaacctgtaacgattgatgagcatgtggctgttgctgaagttcatctatatggcgacgtcgttttgcggtttgtgagttttgttaaagatgaggatagcctcattttcctaccaggttttgaagcaatggatgaaacatcatccttcaaggaactggattatgggattcgccggctggaccacgccgttgggaatgtgccggagctgggtcctgtagtggattacatcaaggagtttacggggtttcatgaatttgcggagtttacagctgaagatgttggaactgctgagagcgggctgaactcggttgtgttggcaaacaatgacgagacagtgttgcttccgatgaatgagccggtatatggaactaaaaggaagagtcaaattcagacttatttagagcataatgaaggggcaggagtgcaacatttagctttggttacagaggatatattcagaactttgagggaaatgaggaaaaggagtggagttgggggatttgaattcatgccttcacctccacctacttattataagaatttgaaaagtagggctggggatgtactcagtgacgaacaaatccaggcgtgtgaagatttgggaatcttggttgacagggatgatcaggggactctgcttcagatatttaccaagcctgtgggagacaggccaacaatatttatagaaataattcagagaatcggttgcatgctcaaagatgaaaacggacaagtctatcagaagggcggttgtggaggcttcgggaagggaaacttctcagagctgtttagatcaatcgaggaatacgagaagatgcttgaagccaaacatgttaatcaagtagctgctgcttgaatatatacaagcattagcttgcaatctaattgaaatttcaccggggcatctaagcttacatttgatgtctctactattaattatattaatgatgaaatgaaaaatagcttatgtatataagttttatttgacgtgctattaggtaaatagtcaataaaatatggagggaaacaaagtcaagtaatttaagtataatgttgatcataagttctgtaaaatatccctttagtagtgctttgagtttcatggtcgatag

SEQ ID NO: 1768 - DNA, 1596 bp, Solanum phureja
tctaaaaataccatgggcatgggcaaagaaactctctccaccaccaccacagatgcaaccggcgctactttcaagctagttggcttcaacaatttcatccgcgctaatccccgttccgatttcttctccgttaaacgcttccaccacatcgaattctggtgcggcgatgcaaccaatacatctcgtcgtttctcatggtctctcggcatgccgattacagcaaaatcagacctctccaccggaaactccgttcatgcttcttatctcctccgttctgtttccggcgaacttcagtttgttttcactgctccttattcgccgtcaatttcagtaccgtcaacggcaggtatacctagtttttcaacgtctactcatcgggattttacggcgaagcatgggctcggtgtttgtgctgttgcgttggaggttgagaatgcttacctggcgttctccgccagtgtgtcccgtggggcgaaacctcggtttgaacctgtaacgattgatgagcatgtggctgttgctgaagttcatctatatggcgacgtcgttttgcggtttgtgagttttgttaaagatgcggattgcctcattttcctaccaggttttgaagcaatggatgaaacatcatccttcacggaactggattatgggattcgccggctggaccacgctgttgggaatgtgccggagctgggtcctgtagtggattacatcaaggcgtttacggggtttcatgaatttgcggagtttacagctgaagatgttggaactgctgagagcgggctgaactcggttgtgttggcaaacaatgacgagacagtgttgcttccgatgaatgagccggtatatggaactaaaaggaagagtcaaattcagacttatttagagcataatgaaggggcaggagtgcaacatttagctttggttacagaggatatattcagaactttgagggaaatgaggaaaaggagtggagttgggggatttgaattcatgccttcacctccgcctacttattataagaatttgaaaagtagggctggggatgtactcagtgacgaacaaatccaggcgtgtgaagatttgggaatcttggttgacagggatgatcaggggactctgcttcagatatttaccaagcctgtgggagacaggccaacaatatttatagaaataattcagagaatcggttgcatgctcaaagatgaaaacggacaagtctatcagaagggcggttgtggaggcttcgggaagggaaacttctcagagctgtttagatcaatcgaggaatacgagaagatgcttgaagccaaacatgttaatcaagtagctgctgcttgaatatatacaagcattagcttgcaatctaattgaaatttcaccggggcatctaagcttacatttgatgtctctactattaattatattaatgatgaaatgaaaaatagcttatgtatataagttttatttgacgtgctattaggtaaatagtcaataaagtatggagggaaacaaagtcaagtaatttaagtatgatgttgatcataagttctgtaaaatatccctttagtagtgctttgagtttcatggtcgata

SEQ ID NO: 1769 - DNA, 3038 bp, Solanum phureja
ctctctactctactaatcactttctctctctactttaactatactctggactgtgtattcctatttcacaacatatagcttcttgattaattatttaattagtagtactattaactactacaacgtattaattaaattttttattttttattttcatagacctcatatatatgaaaggcctttccaagaagagtagattgaaagagtgattttttttttctttcgttttcacgggtgagcacctgtagtgattggatccatacttctactgcattatattctcaaccccttttctttctctctctatttttttgttctttctctctctaaacaatccaaaatttgtttcgaatgtgagagaagagtgggagctcaagttcaggaagaagactgggaattcttgatttgtgggaatttgatagaaagttgaaagcttttttgctattaagaaactgggtttcatttattttttggtttaaggttggaacatgtcaaggccactccatagaggtgtgtcaggtggggggaggttatcagttaatggccctgatttctgggatgattctcagatgaaagataaaatagaaaaggaagatttggagcgtaatcgctcgcctggtgatcagacttattcgcctaccaaattcctttgccggattctgtttccagataattctccttcaaaacataatttgggtgaaaatggcttactttctgatccatttagccctggaactggaagaaatagacttaagtatgctttgggtttgatcaggctgagcttagttggcatagtacttcttgcccttactggatccttttggtggacaatttcgataacctcctcgtcgagaggtcatatataccatggatacaggcagcttcaggagcaagtagtatcggatttgaaagacattggacagctctctcttggtgctgcaaatgtgaaggatatagaatactgtcctcctgaatctgagaactttattccatgtttcaatgtgtcagaaaatcttgatttgggcctttctaaaggcgaggaggttgaccgccattgtggacctggttcaagacaaaattgcttggtacttccccctgttaattacaagattcctcttaggtggcctacgggtagagatgtcatttggcatgcaaatgttaatattactgctcaagaggtactctcctctggaagtatgacaaaaaggttgatgatgttggaagaagagcagatttcctttcggtcagactctgccatgtttgacagcattgaagactactcacatcaaatagcagaaatgattgggctacggaatgagtcaaactttgtacgagccggggtccgaactatcttggatattggatgtggttatggcagttttggggcacatctcttttctagccaactattgaccatgtgtgttgcaaactatgaagcttcaggcagtcaagttcagctgacacttgaaagaggtcttcccgcaatgattggatcatttaattcaaagcagttgccttatccatctctttcctttgatatgatacattgtgcggaatgtcatgttgactgggatcagaaagatggtatttttcttgttgaagttgatcgattgttaaggcctggtggatattttgtctggacttcaactgttacgaatactcagcgctccgtccgcaacaaagtgagcctgaaaaaatggaactttgtccggaattttgctgaaagtatgtgctgggagctgttaccacaacaagatgaaactgttgtatggaagaagacaagtttaaagaaatgttattttgcaaggagaccaggtgttggaccttctatctgcagtaaaggacaggacattgaatccccatattatcgacctctacaagcatgcattgctggaacccaaagccgccggtggattcctattgaagaaaggacaaagtggccttctagggccaaattaaactccagcgaacttaagattcatggtttgttagctgaagctcttgctgaggattcccttaactggaattcagcagttaacaattattggtcacttctttcacctttaatattttccgatcacccaaagcgacctggtgatgatgatccttctcctccctataatatgcttagaaatgtgctggacatgaatgcccattttggtggtttgaatgctgctctactggatgctagaaagtcagtgtgggtcatgaatgttattcccactagtgggccaaactatcttcccctaattatcgacaggggattcgttggtgttttgcatgattggtgtgaggcatttccaacatatccaagaacttacgatctggtacatgctaatggacttctgtcaatggaatttggccaacatagcagatgtccgatgtttgacctgtttattgagatggatcgtgttcttcgtccggagggctgggtgattttacgcgacactgtccctcttattgaattagcaagatctcatgcagcacggttgaaatgggacgcgagagttatagaggtagaaagcagtgatgagaagctactaatttgccagaaaccattttcaagaagacaagcaagctaaaaattgtcaaggatctcaagattgtagatgataatagtcatttgtttgttggatcatattattaaacagcaaaaatttcacacggaaagggcggtaactaaattttttggacagtcagaaaagcacgagagcacaagaagagaagacaacagaatggttctgcaaagggacctaaaccacaactcctatgtagccgtaaggcgtacatagggccatgtaattacacatttgaggcacagtgcaagtgggaattgttttggggctatagttttttccttgtgatgtctcattttattataactatacaagcaaaaaccatatgttgattgaaattgtgaaggtattatagaataagggcaatcctagctgctgtagcatatctcatttgctttggcttttgactcctttttgatagttcattcttgatactctggcaagtgattccagttcagtttc

SEQ ID NO: 1770 - DNA, 2459 bp, Capsicum annuum
aggttggaacatgtcaaggccactccatagaggtgtgtcagttggggggaggttatcagttaatggccctgatttctgggatgattctcaaatgaaagataaagtagaaaaggaagatttggagcgtaatcgatcacctggtgatcagacttatttgtctaccaaattcctttgccgggttttgtttcctgataattctccatcgaaacatagtttgggtgaaaatggcttaatttctgatccttttagccctggagcaggacgaaatcgacttaagtatgctttgctattgatcaggctaagcttagttttcataataattcttgctcttacgggatcattttggtggacaatatcgataacctcctcatcgagaggtcaaatataccatggatacagaaaacttcaggagcaagtagtatcggatttgagggatataggacagctctctcttggtgctgcaaatgtgaaggatgtggaatattgtcctcctgaatctgagaactttattccatgtttcaatgtgtcggaaaatcttgacttgggcctttctaaaggcgaggaggttgaccggtactgtggacctggttcaagacaaaattgtttggtacttccccctgttaattacaagattcctctaagatggcctaccggtagagatgtcatttggcatgctaatgttaatattactgcacaagaggtactctcctctggaagtttgacaaaaaggttgatgatgttggaggaagaacagatttcctttcgttcagactctgcgatgtttgacagcattgaagactactcacatcaaatagcagaaatgattgggctacggaatgaatcaaactttgtacaagctggagttcgaactatcttggatattggatgtggttatggcagtttcggggcacatcttttttctagccaactgttgaccatgtgtgttgcaaactatgaagcttcaggcagtcaagttcagctaacacttgaaagaggtcttcctgcaatgattggatcatttaattcaaagcagttgccttatccatctctttcctttgatatgatacattgtgcagaatgtcatgttgactgggatcagaaagacggcattcttcttgttgaagttgatcgattattaaggcctggtggatattttgtctggacttcaactgttacaaatactcagcgctccgtccgcaacaaagtgagtctgaaaaaatggaactttgttcggaattttgctgaaagcatgtgctggaagctgtcggcacaacaagatgcaactgttgtatggaaaaagacaagtttaaagaaatgttatgttgcaaggagaccaggtgttggaccttctctctgcagtaagggacaggacattgaatccccgtattatcgacctctacaagcttgcattgctggaacgcaatgccgccggtggattcctattgaggaaaggacaaagtggccttctagggctaaattaaactccagcgaacttaagattcatggtttgtcatctgaagctcttgctgaggattccctcaactggaattcagcagttaacaattattggtcacttctttcacctttaatattttctgatcacccaaagcgacctggtgatgatgatccttctcctccctataatatgcttagaaatgtgttggacatgaatgcccattttggtggtctgaatgctgctctactggatgctagaaagtcagtgtgggtcatgaacgtgattcccactagtgggcctaattatcttcccctaattctcgacagaggatttgttggagttctgcacgattggtgtgaggcatttccgacatatccaagaacttacgatctgatacatgctaatggacttctgtcgctggaattcggtcaacatagcagatgtccgatgtttgatttgtttattgagatggatcgtgttcttcgtccagagggctgggtgattatacgggacactgtccctcttattgagttagcaagagctcatgcagcaagattgaaatgggacgcaagagttgtagaggtagaaagcagtgacgagaagctactaatttgccagaaaccattttcaagaagacaagcaagctaaaaatgggcaaaggatctcaaggttgtagatgatagtagtcaattatttgttggatcatattattaaacagtataaatttcacacggaagggtcgggaacgggaatttttggacagtcaagaaagcaagaagagaagaaaacaaatggttctttgccaaggaccaaaccacaaatcctatgcagccgtaaggtgttcatagggccatgtaattacacatttgaggcacagtgaaaatgggaattgtttagggctatagttttttttccatgtgacgtctcattatactacacaacaacaaatatgttgattgaaattgtgaaggtatttatttatagaagaataagggcaatccta

SEQ ID NO: 1771 - DNA, 1371 bp, Solanum phureja
gatagagttggttgagataaactttattatcctcaagcagcaaaaaacagaagaaaattttaccaagaatgattcatcttatgcccctaaaaattcaatcttgatgcttcccagtttactatttggtaccttgaatcataaaaatataccctttttgtagatagaagaaaagaaatgctaatgatacagtccaccatttcacctcccctgcaaaaatctgttcttgttccagctaaaactgcaacaagttggagtaaacatggctgttttcgttttcttgatttaaatggtgggtgtggttcaaaatcagcttcttatcactttccaagaagacccattaagggaaattcaattcagctgaagatttatgcaaggaaatcagaatcattcccaattttgctttcagagaaagttgatgaattgccagagaagttgctgaatggcggagatattactattagtagtggacaggttctttctctatctgctatctcatgtgggtctatcttctggttgacatctgggcaagtggcatcagcaagtgaaggtgtcagagtaaatatggtttatgaggtcggagagttatttgaactgggaatccagcttacttacctgcttttactactagcattgcttggggttgggagtttctttgtgattcggcaagtccttgttcgcagagagcttgatctttctgccaaagaattgcaagagcaagttagaagtggtgatgccagtgcgacagagctttttgaacttggagctgtgatgttgaggagaaaattctacccagctgctaccaagttccttcttcaggcagtagaaaagtgggatggagatgatcaggatcttgcccaagtttacaatgcccttggtgtcagttatgtacttgatgggaaaattgacaaaggaattgctcagtttgagaatgctgtaaaagttcaacctggttatgtcacggcatggaacaaccttggtgatgcgtatgagaaaaccaaagacttaacatctgctctaaatgcatttgaagaggtacttctttttgatcctaacaacaaaatagctcgtcctaggcgcgatgcattgaaggacaaagtaacaatgtacaaaggagtatcggtgaaatctaagaagagttgatatagctagccggttagttcttttacacgcttatgctgattatctttttgaggagctctttttattctctttatccgcgttctcctacacaagtggaattcgttgtcatggccatgttgaagttttggatgttccataatagaattcttcatccttctgtcttttgtgtaaatgaaatgaacagtgtctattctactttatttgcatagaatcaggagaactgttgatgat

SEQ ID NO: 1772 - DNA, 1342 bp, Capsicum annuum
ttttttaccaagaatggttcttgaaatgccccaaaaaattctatcttgatgcttccaagtttactgtctattaccaactatcactcagacaatcagaaaaatagacccttatagcagaaagaagaaaagaaatgctaatgatacagtctaccatttcacctcctgtgcaaaaagccgtacttgttccagctaaaattgcagtaagtggtaaacatgcctgttatcttgctttaaattgtgggtttggttcacagtcagcgtattttccctttccaaggagacccatcaagcgaaattcaattcagctgcagatgttagcaaggaaaacagattcattcccacttttgttttcagagaaagttgatgaatcgccagagaagttgctaaatggtggagatattactattagtattggacaggttctctctctatctgctttctcatgtggatctatcttctggttgacatctgggcaagtggcatcagcaagtgaaggtttcagagtaaatatgatctttgaggtcggagagttatttgaattgggaatccagcttacttacctgcttttactactatcattgcttggggttggaagtttctttgtgattcggcaagtccttgtccgcagggagcttgatctgtctgccaaagaattgcaagagcaagttagaagcggtgatgccagtgcaacagagctttttgaacttggagctgtgatgttgaggagaaaattctacccagctgctatcaaataccttcttcaggcagtagaaaagtgggatggagatgaccaagatcttgcccaagtttacaatgcccttggtgtcagttatgtacttgatggaaaaattgacaaaggaattgcccagtttgagaatgctgtgaaagttcaaccaggttatgtcacagcatggaacaacctaggcgatgcatatgagaaaaccaaagacttgacatctgctctaaaagcatttgaagaggtccttctttttgatcctaataacaaaatagctcgtcctaggcgtgatgcattgaaggataaagtaacgatgtacaaaggagtatcggtgaaatctaagaagagttgatatagcgagcacgtcagtgcttttacacgcttgcgctgattatctgtttgagctctttttattttctttttcccctttttccgcttctcctacacaagtagaatttcgttgtcatggctttgttaaatttttggatgttccacaacagaggtgggcaagaagttttttaacttcttcatcattctgtctttggtgtatatgaaattgacagtgtatattctactttatttgcatagaattgggcggacggtgat

SEQ ID NO: 1773 - DNA, 1347 bp, Capsicum annuum
agaaattttttaccaagaatggttcttgaaatgccccaaaaaattctatcttgatgcttccaagtttactgtctattaccaactatcactcagacaatcagaaaaatagacccttatagcagaaagaagaaaagaaatgctaatgatacagtctaccatttcacctcctgtgcaaaaagccgtacttgttccagctaaaattgcagtaagtggtaaacatgcctgttatcttgctttaaattgtgggtttggttcacagtcagcgtattttccctttccaaggagacccatcaagcgaaattcaattcagctgcagatgttagcaaggaaaacagattcattcccacttttgttttcagagaaagttgatgaatcgccagagaagttgctaaatggtggagatattactattagtattggacaggttctctctctatctgctttctcatgtggatctatcttctggttgacatctgggcaagtggcatcagcaagtgaaggtttcagagtaaatatgatctttgaggtcggagagttatttgaattgggaatccagcttacttacctgcttttactactatcattgcttggggttggaagtttctttgtgattcggcaagtccttgtccgcagggagcttgatctgtctgccaaagaattgcaagagcaagttagaagcggtgatgccagtgcaacagagctttttgaacttggagctgtgatgttgaggagaaaattctacccagctgctatcaaataccttcttcaggcagtagaaaagtgggatggagatgaccaagatcttgcccaagtttacaatgcccttggtgtcagttatgtacttgatggaaaaattgacaaaggaattgcccagtttgagaatgctgtgaaagttcaaccaggttatgtcacagcatggaacaacctaggcgatgcatatgagaaaaccaaagacttgacatctgctctaaaagcatttgaagaggtccttctttttgatcctaataacaaaatagctcgtcctaggcgtgatgcattgaaggataaagtaacgatgtacaaaggagtatcggtgaaatctaagaagagttgatatagcgagcacgtcagtgcttttacacgcttgcgctgattatctgtttgagctctttttattttctttttcccctttttccgcttctcctacacaagtagaatttcgttgtcatggctttgttaaatttttggatgttccacaacagaggtgggcaagaagttttttaacttcttcatcattctgtctttggtgtatatgaaattgacagtgtatattctactttatttgcatagaattgggcggacggtgat

SEQ ID NO: 1774 - DNA, 990 bp, Solanum tuberosum
gaacagaagaaaattttaccaagaatgattcatcttatgcccctaaaaattcaatcttgatgcttcccagtttactatttggtactttgaatcataaaaatataccctttttgtagatagaagaaaagaaatgctaatgatacagtccaccatttcacctcccctgcaaaaatctgttcttgttccagctaaaattgcaacaagtgggagtaaacatggctgttttcttgatttaaatggtgggtgtggttcaaaatcagcttcttatcactttccaagaagacccattaagggaaattcaattcagctgaagatttatgcaaggaaatcagaatcattcccaattttgctttcagagaaagttgatgaattgccagagaagttgctgaatggcggagatattactattagtagtggacaggttctttctctatctgctatctcatgtgggtctatcttctggttgacatctgggcaagtggcatcagcaagtgaaggtgtcagagtaaatatggtttatgaggtcggagagttatttgaactgggaatccagcttacttacctgcttttactactagcattgcttggggttgggagtttctttgtgattcggcaagtccttgttcgcagagagcttgatctttctgccaaagaattgcaagagcaagttagaagtggtgatgccagtgcgacagagctttttgaacttggagctgtgatgttgaggagaaaattctacccagctgctaccaagttccttcttcaggcagtagaaaagtgggatggagatgatcaggatcttgcccaagtttacaatggccttggtgtcagttatgtacttgatgggaaaattgacaaaggaattgctcagtttgagaatgctgtaaaagttcaacctggttatgtcacagcatggaacaaccttggtgatgcgtatgagaaaaccaaagaattaacatctgctctaaatgcatttgaagaggtacttct

SEQ ID NO: 1775 - DNA, 1344 bp, Nicotiana tabacum
  misc_feature (382)..(382): n is a, c, g, or t
  misc_feature (714)..(714): n is a, c, g, or t
  misc_feature (777)..(777): n is a, c, g, or t
  misc_feature (801)..(801): n is a, c, g, or t
  misc_feature (816)..(816): n is a, c, g, or t
  misc_feature (870)..(870): n is a, c, g, or t
  misc_feature (888)..(888): n is a, c, g, or t
  misc_feature (900)..(900): n is a, c, g, or t
  misc_feature (969)..(969): n is a, c, g, or t
  misc_feature (1012)..(1012): n is a, c, g, or t
tcatgcggccgctgccccaaaaaattcaatcttgatgcttccgagttcactctctaattcagaaatagattaagaaaagacccttaaagcagaaaagaaatgctgatgatacagtccaccatttcacctcctgtccaaaaaacactacttgttccagctcaaattgcagcaagtggtaaacatggctgctatcttgctttacatggcggatttggctcaacatctgcttattttcattttccaagaagacccatcaagcgaaattcagttcagctgcagatttttgcaaggaaagtagaatcattctcacttttggtccagagaaagtgatgaatcatcagagaagttgctgaatgtggagatattactactagtaaagganaggttctttctctatctgctttctcatgcgggtctatcttctggttgacatccgggcaagtggcatcagcaagtgaaagtgtcagagtaaacatggtttatgaggtcggagagttatttgaattgggaatccaacttacctacctgcttatactactagcattgcttggtgctggaagcttctttgtgattcggcaagtccttgtccgcagagagcttgatctttctgccaaagaattgcaagagcaagttagaagcggtgatgccagtgcaacagaactttttgaacttggagctgtgatgttgaggcgaaaattctacccagctgctacnaagtacctgcttcaggcagtacaaaagtgggatggagatgatcaggatcttgcccaagtttanaatgcccttggtgtcagttatgtncttgatgagaaaatngacaaaggaattgctcagtttgagaatgctgtaaaacttcaaccaggttatgtnacggcatggaacaacctnggcgatgcgtangagaaaaccaaagacttaacatccgctctaagagcatttgaagaggtccttctttttgatcctaataanaaaatagctcgtcctaggcgcgatgcattgaaggataaagtanagatgtacaaaggagtacctgtgaaatctaagaagagttgatgatatagggagcttgttagttatttttacatgccttgtgctaattatatattgaggagcttgcttcttttatcttttccccctttacagcggtctttcttctacacgagtgaaatgctgtcaatgtggctatcttgaatttccggatgttcataacagaagagggcaagcagttctatgaacttcttcatccctatgtctttggtgtaaatgaaacgaacagtgtctattctactttatctgcatataatcaggaggacacttgatgctccagcggccgctctggactgc

SEQ ID NO: 1776 - DNA, 1467 bp, Petunia hybrida
ggttgagataaactttattatcttcattcattcaaccaacaaagggaaaaacgaagagaatgatttttaaaagaattgaatgttgatgcttccaacttcacttcctgctatcaactaaattagagatattaagaaatggtaatgatacactctaccatttcactacctcctctgcaaaaaactcttcttcttccaagtggttttcttgctttacatggacgatttggctcatccttagcttcttctcactttccaagaagacccatcattaaccgcaattccattcagattttcgcgaggaaattagaatcattctcacattttgttccagagaaagtcgatgaattgtcagagaagttgctgaatggtggagatatcactattagtagaggacaggttctttctctatctgctttctcatgtgggtctatctgctggttgacatctgggcaagtggcgtcagcaagtgaaggtgtcagagtaaacatggtttatgaggttggagagttatttgaactgggaatccagcttacctacctgcttttacttctagcattgcttggggttggaagcttttatgtgattcggcaagtccttgtccgcagagagctcgatctttctgccaaagaattgcaagagcaagttagaagtggtgatgccagtgcgacagagctttttgaacttggagctgtgatgttgaggcgaaaattttacccagctgctataaagtaccttcttcaggcagtagagaagtgggatggagatgatcaggatcttgcccaagtttacaatgcccttggtgtcagttatgtgcttgaagggaaaatgacaaaggaatgctcagttgagaatgctgtaaaacttcagccaggttatgtcacagcatggaacaacctggtgacttacgagaaaaccaaagagttaacatctgctttgaaggcatttgaagaggtccttctttttgatcctaataacaaaatagcccgtcctaggcgcgacgccttgaaggataaagtaaagatgtataaaggagttgctgtgaaatctaagaagagttgatacaggagctcgttagtgtttgtacgcggtaatgcattaggagtttgcctttttttccccttccggctgtctttcttctataaaagtgaagtcatcgtgccaatattgaactttggatgtttcatcacagaagtgggaagcagttttgaacttcttcatccctctgcgtttggtgtaaatgaatagtgtctattctattttatctgcatagaatcaggaggacgattgatgcttccttatcttctgtttcaagtttatttcccatttcttagccttgaaaaggcttcatcttgtcttatagaagttaagcagcaaagccaaaattcgacatctgattcgattgatgtcggatggatggatccgtttgatgctatgaatggttgatacatacaataaaaacatacccaa

SEQ ID NO: 1777 - DNA, 3542 bp, Solanum phureja
tatccccggtccgtatttgcatattcaactagtacaaatttccgcaatctttacatatatatgtttttttactgaacgttccgtccaataaaaaatcgtcatgtaaagtaaaaatgaaatgcttttgtgtaactggagataaaactgagagtgagcagagacacatatatatagtgctttgatacagacatgagaactggttgtgtacgcagaaataatggaagaagaaaacaagcaatctcctcttataccaccattgccaagagatccaagaggttcactagaagttttcaatccttcaacttactcttcccgatcaacaaatccagttttccgatcacaatcttcatggaaaaattggaccggcggcgagtccattaccggtagtaccatccctgaaatagaggaaaaaccagagcaaatcgcaattcccaaatcgagtaacgaaaatgaagaaatcgtcacttcatggatggcaattgctccggcttcagcgaaattgacttctccgattactcagaaatcaattaccggtggtgagaaggttaattcgaaggcggcagtggatgaagttggtgctgctgcacagagagcagcggagtggggacttgtgttgaaaactgatgatgagactgggaaattgcaaggagttaaagttagaacttctggagatgatgcgaatggtaaaacagaaacttctcgaagagattccggcaactctggtcggagttccggcgaattttctgatgatggagctggtaaagagaggggaattccaagagtttcagaggatttaagagatgccttatcaacatttcaacaaacatttgtggtatcggatgcaaccaaacccgattacccgattctgtatgcaagtgctggatttttcaagatgacgggttatacatcaaaggaggttataggcagaaactgtcggttcatgcagggttcgggtacggatcctgaggatgtggctaagatccgagaagcattgcaaacgggttcaacttactgtggaagattactaaattacaagaaggatgggacccctttttggaatctcctcactattgcacctatcaaagatgatgctggcaaagttctcaaattcattggaatgcaagttgaggtaagcaagcacacagaaggctccaaggaaaaaactgtccgacccaacggccttcctgaatcattgatacgctatgatgtgcgtcagaaggagatggctaataattcagtgaatgagttattgaaagaaataaaacatccaagaagggcaagagcacttagtgaatcaacaaataatagaccaactttcatgagaaagtcagaaggagatcaagttgaacaagacaagcaggatgttggcattactactcataagctaaatttagtgaataaagcaccagcaagaagacattcacatgctggtactagaaccaccgccatgaagatggagaaaattaacgaagaccctgaaaagaaacctaaaaaatctgctcgtctatctttcatggggattatgaagaaaaaacgttctagtactaccatgactactgatgatgatgattttgaggcaaggatgacaatggataatgacgatgacgatgatgatgagagtgacaacgatggacgaccagttagtgttgatgacaaagtgaggaagaaggaaatgaggaaaggtattgatttagcaacgactcttgaacgtatcgagaagaactttgtcattactgatccaaggctgcctgataatcctattatttttgcatcggatagtttcttggagctgacagagtacagccgtgaagaaatcttgggaagaaactgcaggtttcttcaaggtcctgaaactgatccagctactgtgaagaaaatcagacaggcaattgataatcaaactgatgtcactgtccagcttattaactacactaagactggcaaaaagttctggaacttgttccaccttcagcctatgcgtgatcagaagggagaggtacagtacttcattggagtgcaactagatggaagtcagcatgtagagccacttcacaacagtatccctgaagacaaggcaacagagagtgcaaagctgataaaagaaactgctggaaatgttgatgaagcagttcgagagcttccagatgccaattcgaaaccagaggatttgtggcgaaatcattcaaaagttgttcagccaaagcctcacaggaaggacagcccatcttggaaagcaatacaaaagattatggagagtggagaaccgataagcttgaagcattttaagccaattaaaccactgggatcgggagatactggcagtgtgcatttagtggagctttgtggaacagaccagcactttgcaatgaaagcgatggataagagtataatgcttaaccgaaacaaggtgcatagagcttgtgcagaacgagaaatcctagatatgttggaccacccttttcttcccgcactttatgcatcttttcagaccaaaacccatatctgtctaataactgattactaccctggtggagagctgttcatgcttctagatagacaacaaacaaaggtgttgaaggaagatgctgcaaggttctatgctgctgaagtagtgatagcgttggagtaccttcactgtcaaggtataatttatagggatctgaagcctgaaaatgtcttgcttcagagtggtgggcatgtatctttaacggattttgatctttcctgtttgacatcttgcaagccacagcttttagttccagaaatcaatgaaaagaagaaacatcaaaaaggccaacagaatccaatcttcatggctgaacctatgcgtgcatcaaattcttttgttggaactgaagaatacatagctccggagatcataactggagcagggcacactagtgcagtggattggtgggctcttggcattcttttgtttgaaatgttgtatggttatacaccattcaggggaaagacaaggcaaaagacattctcaaatatactacataaggatttaaaattcccaggaagcatacagtctagtctccatgcgaagcagttaatgtacagattgttgcacagagatcccaaaaacaggttaggatctcgtgaaggagcaaacgaaatcaagcagcatccgttcttccggggtgtgaattgggcattaattcgttgcatgaaccctcccaaactagattctgctccttttttgggaactgaagctgagaaagaaggaaacgacatcaatcctgagatggaggatttacaaacaaatgttttctaaaagttgttgcagaaatgaaaatatttatatcccaattaaatcaagtgcatgagtggagaaaagtggccttcagaccctccttgcaacagttaattacttgttgattttgtaaaaaataaaatgatggtttttcatttgttattttttcttcctttgatggtttgtgttgttctttttatatgcatagtttggttgttttgtaattcttaactcatgaattcctcagtagatgttgagttaattaatttgttaagcctaa

SEQ ID NO: 1778 - DNA, 1514 bp, Solanum phureja
ccttcttgtattcctttcttcactttaatggaagctcaataactttcattatatagtgaagagaagtattttctcaagaaaaacccagatgaaaatgggttattttgggtttgatttttctagttttcaatcgattacagcattttgtttgttattgatgcttgggttttcgttttccccaattgggtgtctagggattcgtagttttcctgaggagagacgatttacagaagcgccggagtatagaaacggcgttcaatgtccggtgacggcggaaactcaaaatatggttcatgtagcgatgacgcttgattcagaatatctcagaggatctatggcggctatacactcagttctccgtcattcatcttgccctgaacatatcttcttccatttcatcgctgctgagtttgacccgtctagtccacgggttttaacccagctagtccgatctatcttcccttcactcaacttcaaagtctatatattcagagaagatacagttctaaatctcatttcatcttcgatccgtcacgcacttgaaaacccattaaactacgcccggaattacctcggtgatatgcttgacccgtcggtaacccgggtcatttacctcgattccgatatcatcctcgtcgatgatatcgaaaagctatggaaaacccctctttccggttcccggattatcggagcaccggaatactgccatgcaaatttcacaaaatacttcaccgattctttctggtccgacccggatttaccccgggtattcgggtcacgaaacccgtgttacttcaacaccggtgtgatggtaatggatttgcagaaatggagagaaggtgattaccggaaaaagatagagaaatggatggagttacagagacaaagaagaatttacgaactgggttcattgccgccgtttctgcttgtttttggtgggctcgtcgagcccattaatcaccggtggaatcaacatgggctcggcggcgacaatgtaatgggctcgtgtagatcattacatccaggcccagtaagcttgttacattggtctggtaaaggaaaaccatgggccaggcttgatgaaaaaaggccttgtccattggattatctttgggagccttatgatttgtataagcccaagcccaaatcaaggcccaattatcaaaggagtaaaatgagactttatcaacatcataatttggattattctagtagtaatatactttttggttactccaattatttcatttgatttttttttttttgacaaggttgatttaagtgattctttgatagccttgtacagattgattagttggaaaaaaaataaaaaaatgagagagagagatagtgaaaaattaatgtgatttgtttagagattaaagttgattacacgaaattttattactagttccattgacttggaacaatttttgagacaaatttagtttgttgtgtattatgtatccactatgtgtttgatatttgtattgagttggactaaatttgaattc

SEQ ID NO: 1779 - DNA, 1160 bp, Solanum tuberosum
gccttcttgtattcctttcttcactgtaatggaagctcaataactttcattatatagtgaagagaagtattttctcaagaaaaacccaaagacccagatgaaaatgggttgtttggggtttgatttttctaattttcaatcaattacagcattttgtttgttgttgatgcttgggttttcgttttccccaattgggtgtctagggattcgtagttttcctgaggaaagacgatttacagaggcgccggagtatagaaacggcgttcaatgtccggtgacggcggaaactcaaaatatggttcatgtagcgatgacgcttgattcagaatatctcagaggatctatggcggctatacactcagttctccgtcattcatcttgccctgaacatatcttcttccatttcatcgctgctgagtttgacccgtctagtccacgggttttaacccagctagtccgatctatcttcccttcactcaacttcaaagtctatatattcagagaagatacagttctaaatctcatttcatcttcgatccgtcacgcactcgaaaacccattaaactacgcccggaattacctcggtgatatgcttgacccgtcggtaacccgggtcatttacctcgattccgatatcatcctcgtcgatgatatcgaaaagctatggaaaacccctctttccggttcccgaatcatcggagcaccggaatactgccatgcaaatttcacaaaatacttcaccgattctttctggtccgacccggatttaccccgggtattcgggtcacgaaacccatgttacttcaacaccggtgttatggtaatggatttgcagaaatggagagaaggtgattaccggaaaaagatagagaaatggatggagttacagagacaacgaagaatttacgaactgggttcattgccgccgtttctgcttgtttttggtgggctcgtcgagcccattaatcaccggtggaatcaacatgggctcggcggcgacaatgtaatgggctcgtgtagatcattacatccaggcccagtaagcttgttacattggtctggtaaaggaaaacatgggccaggcttgatgaaaaaaggccttgtccattggattatctttgggagccctatgatttgtattagcccaagcccaaatcagg

SEQ ID NO: 1780 - DNA, 1657 bp, Nicotiana benthamiana
ctctctatttatggtaataaaattagaagtgattttttgagtaataataactgaatacagtctttttgttcgaatttaccattgttgaacgaatctggatgttcaatatgtatatatatggtaatttattgaccattctttggcctttccttttccagaactctccctttccttcgattctttccttcaccatagtgctgtatcaataatgttgcattaatgtatagggagagaaaatacttgacaacattaaaaccatattttctcaacaaagaaaaaaaaacccagaaacccagatgaaaatgggtcgttttgggttttttgatattaaagtggtttgttttctgttagctctatcgttttcgcggtgttatgggattcgtagttttcctgaggagagaagatttgcggaggcgccggagtacagaaacggcgtcgaatgtccggcaacggcggagggtaaaacgttatcgtcttgttatccctcattggtccacgtggcgatgacgttggattccgagtacctccgtggatccatggcggctgttcactcagtcctccgccacgcgtcttgcccagaacacgtcttcttccacttcatcgccgctgagttcgacgcgacgagcccccgcgtgttgactcagctggtcagatccatttttccttcgctcaacttcaaagtctacattttcagagaagacacagtcctaaatctcatctcttcatcgatccgacaagctctcgaaaacccgttaaactacgcccgaaactatttgggcgatatgctcgacccttgtgtgacacgtgtcatttacttagactccgacgtagtactcgtcgacgatattcagaagctgtggaaggtgaatcttaccgggtcccgaatcatcggagcaccggaatactgccacgcgaatttcacgatatacttcaccgatacattctggtccgacccggtattgccccgggtgttcgggtcgagaaatccatgttattttaacacgggcgtaatggtaatggacttgaagaaatggagagaaggaaattacaggcaaaaaatagagaggtggatggagttacagagacagaagaggatttacgaattgggctcattaccgccgtttttgctggtatttggtgggctcgtcgagcccattaatcaccggtggaatcaacatgggctcggcggtgataatgtaaaaggctcgtgtaggtcattacatccaggcccagtaagtttgttacattggagtggaaaaggaaaaccatgggttagacttgatgagaaaagaccatgtccgttggattatctttgggagccttacgatttgtacaagcacaggagcaaagtgagagttattcatcatcttaatttgggttattctactagtactaatccttttggttactctaattatttcatttgattgatcattcttttacacttgtttggttgacaaggtgatttaagtgattctttgatagccttgtacagagtgattagatggaaaaaagtgagaatattgatggcataggtgaaaagtttaatggggatgtaatgtgttttatttgatggattataataagcagcagaagtaattttagtattaaatcacatgtaatttagacaattaatataatcgagatttcacgggtt

SEQ ID NO: 1781 - DNA, 1698 bp, Nicotiana benthamiana
ctctctctatttatggtaatacaattaaagtgagtttttgagtaataatctctgaatacagtctttttgttcgaatttaccattgttgaatgaatctggatgttcaatatgtatatatatatggtaatttattgacctttctttggcctttccttttccagaactctcccttcccttctattctttccttcaccataatgctgtatcaataatgtcacattaatatatagggagagaaaatacttgagaacgttaactatattttctcaagagaggaaaaaaacccagaaacccagatgaaaatgggtcgttttgggttttttgatattacagtggtttgttttctgttagctctatcgttttcgcggtgttatgggattcgtagttttcctgaggagagacgatttgcggaggcgcctgagtacaggaacggcgtcggatgtccggcgacggcagagggcaaaacgttatcgtcttgtgatccttcattggtccacgttgcgatgacgctggattctgagtacctccgtggatccatggcggctgttcactcagtcctccgccacgcgtcttgcccagaacacgtcttcttccacttcatcgccgctgagttcgacgcgaccagcccgcgcgtgttgacgcagctggtccgatccattttcccttcgctcaacttcaaagtctacattttcagagaagacacagtcctaaatctcatctcctcttcgatccgacaagctctcgaaaacccgttaaactacgcccgaaactatttgggcgatatgctcgacccatgtgtgacacgtgtcatttacttggactccgacgtagtactcgtcgacgatattcagaagctatgggaggtgaaccttaccgggtcccgaatcatcggagcacccgaatactgccacgcgaatttcacaatatacttcaccgattcattctggtctgacccggttttgccccaggtattcgggtcaagaaacccgtgttatttcaacacgggcgtaatggtaatggacttgaagaaatggagagaaggaaattacaggcagaaaatagagaggtggatggagctacagagacagaagaggatttacgaattgggctcattaccgccgtttttgcttgtatttggtgggctcgttgagcccattgatcaccggtggaatcaacatgggctcggcggtgataatgtaaagggctcgtgtaggtcattacatccaggcccagtaagtttgttacattggagcggaaaaggaaaaccatgggttagacttgatgagaaaagaccctgtccgttggattatctttgggagccttatgatttatacaagcacaggagcaaagtgagagttaatcatcatcttaatttgggtttttctactagtactaatccttttggttactctaattatttcatttgattcttcattcttttacacttttttttggtttacaaggtggtttaagtgattctttgatagccttgtacagattgattagttggaaaaaaaaggagaaaatattgatgggcatagttgaaaattttaatggggatgtaatgtgtttatttaggagttaaagattattacattaatttttttggctggttccacggacttgtaacaattttgttgaagtgattcaaattgtacgttgggacttgggatattgaggaataactcgtttcttctt

SEQ ID NO: 1782 - DNA, 1520 bp, Solanum phureja
gaattttgaagtattataacgcattatcttacatttataataattctgtttccattattgctcttggattatcaataaattgaaaattctgaaatttgggtcagcgacttaaatgctaccctacgtattcacatgcaaagtgtgcttggttgttagctttaattacggaggtcataggaagaagcaactaagttttttttttccctttttgggatttatacgcttcacaggtgaatcatcggatagagtagcagaaacaacagttcatcctggatttgtagttgtctggagttttacggtgatgtcggtggaagaacggccgtcgactttagtggtggatccgttgttgaaggatctgagtgagaagaaacagaatttccggcgaaacgtggtgtcgcttgcggcggagctcaaggaggttcgcagccgtcttgcttatcaagaacagtcttttgttcgtgaaaccctaaccagacaggatgcagagagtaaagctaagaaaatggaagaagagataaacaaattgcagaagaatttggaggaaaagaatggagagcttcaattttcagctttaaacactgagaagtatgtcaagcagttggatgacctcaaatcacaactctctgctactcaagcaactgcagatgcaagtgctgcatcagctgaatctgcacagcttcagtgtttggtgcttttgaaagagttggatgagaaaaacagttcactgaaggaacatgaagttcgtgtaaataaacttggtgagcaattagatcttttgcagaaggatcttcaagcaagagaatcatcccaaaggcaattgaaagatgaagtagtgagaatcgagcatgatatcatgcaagcattagcaaaatctggggcaaacacagattgtgaactgaggaaggtcttagatgaggtctctccaaagaacattgagaagatgaacaagctgttgactaacaaagatgaagaacttgccaaactcagggacgaaatcaggatcatgtctgcccactggaagctaaaaaccaaggagttggaatctcagttagaaaagcatcgtagggctgatcaagagttgaaaaagaggattatgaagttggaattctgtctccaagagactcgaactcaaactcgcaagcttcaaaggatgggggaacgacgtgacaaagctattaaggaactgagagaccaattatcaactaagcaagtcggaacttcaaacaacaataatcagaacttctgggatacctcaggattcaaggttgtcgtttcaatgtcgatgttgatgttagtcctcttttctaagcggtaatacttaccattagtatagttgacaatgtaaaaaggagaagtgtagctagttacaaattaggaaaagctgtagagctactgtttcatatattagaatgttaatcatactatatgggggcctatctttttgtacgggcatcacaactgaatccatcatctcgatgttcaattattagatatatatacatgcgttttaacttaacgtt

SEQ ID NO: 1783 - DNA, 1316 bp, Amsonia hubrichtii
agtcatgagatgtggatggtagcttgaaattgattgcagaagtggtcacactcaagagggctagtagttttattgctgatgcagtgtagctgagaaggaaaggaggtactaggcttcatcaccaccctggattttggctggtgcgaaagttttaggcagtaatgtcatcatcgttgacggaaaggccgtcgtcgtcatcttcaacttcgtcgacggtatcgttgtcctcgttgacggcgggaagagagaaggatatagatcctttgttgaaggatctgagtgagaagaagcagagcttccggaggaacgtggtctcgctggcggcggagctcaaggaggtccgcaaccgcctctcttctcaagaacagtcatttgctcgggaaaccctaacccggcaggaagcagagaccaaagcaaggaaaatggaagaagagataaataggttgcagaggaacttggaggagagaaacagtcagcttcaggcttcagcatctactacccacaagtacataaaagaattggatgatcttagatcacagctttcggccactcaagcaactgcggatgcaagtgctgcatctgctcaatctgcacaacttcagtgtttggcactcttgaaagaactagatgagaagaacagttctttgaaggagcatgaaactcgtgtaaataagatgggtgagcaattagatctcctgcagaaggatctccaggcaagggaattttctcagaagcaactgaaagatgaagtgttaagagttgagcatgacatcatgcaagcattagccaaagctggggcagaccaagactgtgaactgaggaagatactagctgaggtttccccaaaaaattgtgaaaagatgaataagcttttgactgctaaggatgaagaaatagccaagctgagggatgaaatcaggattatgtctgcacactggaagcttaagaccaaagagttggaatcccagttagagaaacatcgtagagctgaccaggagctcaagaaaagggttctaaaattagagttttgtctccaggaagcgcgtgctcagactcgcaagctccaaaggatgggagaacgacgggacaaagctctgaaagaactcagggatcagttagcaacaaagcaaggtgcacccgcaaatatcgagaagcagaatttctgggaaacctcagggttcaagattgtggtttcaatgtccatgttaatcttagtattattttcaaagcgttaggtccatagatattagtattgtacaaaatcatgggattcctagaatccatctagaggagattaggggaagctgtaggcactc

SEQ ID NO: 1784 - DNA, 2076 bp, Solanum phureja
cagaaagtgaaaaaacatggggatagaaagtgaagtaccggaatcaggaggaggaatcaggcgaagaaattgtgtgtgcacaaaagacgattttctgccggaggaatcgttcaagagctggggaaattacgcgaatgcgctgaggcaaactccgacgaggttaatcgaacgggcgttgacgcgatcgagtgacgaagcagagctggaggcgaagtcacggagtcaccatgaaatgaagaagacattgacatggtgggacctaatatggttcgggatgggagcggtgattggagcaggaatcttcgtactgacggggcttgaagcgagccaggatgcaggccctgctgttgtactgtcgtatgcagtttccggcgtctccgccttgctctctgtcttctgctacactgagtttgccgttgagatccctgttgcaggtggttcatttgcctacttgagggtggagcttggtgactttgtggcctttattgctgctggaaacatccttcttgaatatgtgattggtggtgctgcagtggctcgttcatggacctcatactttgcaactctattgaacttcaagtctgacaaattcctcatcacggctcatggtttagccaagggctacaaccaacttgacccaatcgctgttgcggtctgcttcattatctgcatcattgccattcgtagcacgaaaggatcttctcgtctcaactatgttgcctcgatcattcacattgtggtgattgttttcatcatcatctgtggcctaatcaaggcagataccaagaactacactccttttacgccatttggtgctcgtggcattttcaaagcttctgcggtgttgttctttgcttatgttggttttgatgctgtgtcgactatggctgaggaaactaaggatccggctcgagatatccccattggcctagttggatctatggtgatcaccactactgtgtactgtttattggctataacactctgtcttatgcagccttatcagagcattgatcctcatgctccgttttctgtggcgttcaaagctgttggatggagttgggcgcaatatattgtggctgcaggtgcgttgaaaggaatgacctcagtgttgcttgtaggcgcggttggtcaggctcgttatctcactcacattgcgcggactcacatgatgcctccgtggttttcctatgttgatgaaaaaacagggactcccgtcaatgccacggcggtcatgatgtctgctactgcaatcattgccttcttcacgaagctcgaaattctctccaatctcttgtcaatctccacccttttcatcttcatgctcgtggccctcgctctcctcgttcgtcgttactatgtgagtggtgtgaccacagatgcaaaccgcaacaagctaattatatgcctattgctcatcctcgggtcctcaatcgccacagctgcttactggggacttagcgagaaaggatggattgcatactgctttactctgcctatttggttttcagcaactgcaggaatttgtattttcattcctcaggctcgtaatccgaagctttggggtgtgcctcttgtaccttggttgccatcattatcaatagctatcaacattttcctactaggctcgatagataaagattcattcatcagatttgctggctggacaggttttcttttggcctattacttttttttcgggctgcatgcttcttatgacacagcaaaggaattcgaaaagagcaaagggtggaagaacaatattgaagaaggaaatggtacttctaatgtggttgttagcaaagatgttcctattgctcctgttgcttctgggaactgaattagttgtgtctaaatgatagtacaatgttacgttcctagctagtcctcctattttatttgtcttgatatatgcatatgatgttagtccgtttgtacagagtctgtttctaaagtagacaagtaaaagttgctgcattgtactagtattaaacattgtgcagactatcttacgacggctttgtacccttctggcatatgccgctttggattataaaggagatgggaaggttactt

SEQ ID NO: 1785 - DNA, 2731 bp, Solanum phureja
agttgcttgagttgcctctgagggtatgcaaagaatcttaacattttgttgtattttggtttagtaagaaaaaaaatggagagttgttgaatttcttttatagtgtaacagaaaaacttgttcttgaatttttcaagatctggtgaatttgttgttgaaagtagcttaaatggctccaagattgaatttttctgactggtggggtaaagataaacaaaggggaacaccagttatagtgaaaatggagaaccccaatttctccattgttgaaattgatggtcctgatgctgcatttaagcctatagagaagagtagaggcaaaaatgctaaacaagtgacatgggttttgttgcttaaggctaaccaagctgttggttgtgttgcttggcttgcaacaattttgtggagtttaattggtactatcaagaataggttgattttgagaaaaggggtttctcttgcaagtgaaaaacttggaaagagtaatctactttttagaataatcaaagtttgtttgggggtttctttggttatgttagcttttgaagtgattgcttacttcaaaggttggcattattttcagaatccaaatttgtatgtaccacatacttctgatgttttggggttgtttcatataatatatgttgtttggttggattttcgcgctgattatatcgcgccttcagttcaaaaactctccacattctgtactgttttattcctaattcagtcgttagatcgtttggtactttgtttgggttgcttttatattaaatgcaagaagattaagccaaggattgaaggggatccctttaaatcagatgatcttgagggatcaaacaacagttactaccctatggttcttgtgcagattcctatgtgtaacgaaaaagaggtatatgagatgtctatatcagcagtttgccaacttgattggccaaaagaccgtttgttgattcaaattcttgatgattccgacaatgagtgcatccaagacttaataaagtcagaggtcgcgaaatggaaccacaagggtgtcaacataatttacaggcaccgtctggttagaactggttacaaagccgggaacttgaagtccgcaatgagttgtgactatgtgaaggattatgaatttgttgcaatctttgatgcagactttcaaccaactccagattttcttaagcaaacagtcccgcatttcaaggacaaccccgagctaggattggttcaaacaagatgggcatttgttaacaaggatgagaacttgctgactcgtctacaaaacattaatctgtgttttcattttgaggtggaacaacaggtgaatggagtattcttgaacttctttggtttcaacggaactgctggtatttggagaatcaaagctttggaagagtctggaggttggcttgagaggacaaccgtggaggatatggatattgctgttcgtgcgcatctcaacggttggaagttcatatatcttaatgatgtgcgggtcctgtgtgaagttcctgaatcttttgaagcttataggaagcagcaacatcgatggcattcgggccccatgcaacttttccgagtttgtcttcctgctattgtttcttccaagatatcaatatggaagaaagccaacttaatacttcttttctttttgttgagaaagctcattcttcccttctattcattcacattgttttgtgtagttcttcctctaaccatgttcatcccggaagccgagctccctttctgggttgtttgctacatacccattcttatgacacttctaaacattcttccagcaccaaaatccattcctttcatcgccccgtacctccttttcgaaaacactatgtcagtgacaaagttcaatgctatggtatctggacttttccaattgggaagttcgtacgagtgggttgttaccaaaaaagcaggaaggtcttctgaatccgacctattggccgctgctgaaaaagatttgaaagcatttggagcaccacagattagcagaggggcttcggaaagtgaactttctgagctgaaccgattgaacaaacagaaagatgaaacttctacacctgtcaagaagagcaacaaaatatacagaaaagagctagctcttgctttcttactcttaacggcgtcagctagaagccttttatctgctcatggtctccacttttacttccttcttttccaaggagtgacattcctcctcgttggtcttgatcttatcggagagcagattagttaatattgctcaagagaggagaaagagcaacctacatattgtatttcaagaactgatacacttcctctcatctgaactttgtaccggcagaacaacagagtccagggaatagctcgtatatttccagatatcgatttctgctatatgaaatgaagccaattaggattttgtacgcgagactattatgtcatgcctgtgtgagttctctaatatctttagttagggttattattgtcagtcttttacatagagtcaattgtttgtcaataatactataggtagaagcaatctcatttttttttacttcatttatttctcatttgggatttctcaaaagcagtacttgtgttgttcaaggcatttcacattcatcatattatgtatataaggatttaaaatggcctaaataaggcctagtcaaacttgcctttcaaattcttggaattgtctgttgtaatgaataagacactttaccatcca

SEQ ID NO: 1786 - DNA, 3639 bp, Theobroma cacao
atatcattaatgccttattacgatatgtaattaattttatgaaattttttatataaagaattaatcaaaataatattggtagaatatatgatgcgtgttattatatcgtataccgtatttacgtgctaaaatataattaaattttttttgggtgaatgacaaatgtgttattttactattttttaatactaataagattaagtagtctagctggagtgtgtgttggcgacggaagtccaatctaagttagtcagtgtcttctagtattgcttaattaatgcttcttaactggcttcgcagattccattcttaagctaaaaatatgtgcgccaaagaaaagagtaaattctgggtgggacgttaaaaatggaggggtttgcttgtttggattatcagaccataaataaaaattaaaaaaaagaaccgcatggtgtggtgttagggggtcttacagctgcagatacctttcctcttaatgttgttttcccatgttgggtttgtcttctagactgcccttagctactgcaaactacaaacaacctccgacactccgttttcttcgcttctcccttgctacatttttctctacaatggagagcctgaagctgactcctttccccttgtaatttggggatcctggttcttgtgcacggttgttcattttggctgcttgttgcctgttgaagtaaagagtaagacccaccgtgcaggaaatggctccaagattagatttctcgaattggtgggcaaaggataccaggaaaggaacaccggtggtagtaaagatggagaacccgaactactctgttgtagaaatcgacggcccagatgctgcattcaggcctgtggaaaagagcagagggaagaatgccaagcaagtgacttgggttttacttctcaaggctcatcgtgctgtcggttgtgttgcttggattgctacactcttctgggcattgcttggtaccataaagaggaggttgatcttcaggcaagatgttgctctggctagtgaaaagttggggaaaggaaaactgctcttcacagtcattaaagtcttcctggcgacttccttgacaattctcgcttttgaggttgctgcttatttcaagggttggcactattttcagaatcccggtttgcacattccgaggactagtgatatccagggcttgctccacttggtttatgttacttggttgtcatttcgggccgagtacattgcaccgctaattcaagctttgtctaaattttgtgtagctctgttccttatccaatctgcagatcgtatgatactttgcttgggctgcttttggattaaatacaagaagattaagccgagaattgtgggggatccgttcaagtcagatgatgtcgagggatcaggctatgagtaccccatggttcttgttcaaatcccaatgtgtaatgagagggaggtatatgagcagtctatctctgccgtctgccaacttgattggccaaaggatcgattattgattcaagttcttgatgattctgatgacaaaagcacccagtgtttaattaaagcggaggttgcgacatggaaccaaaggggcatcaacataatttatcgacatcgcttggtaagaactggttacaaggctgggaatcttaagtctgcaatgagctgcgagtatgtacaggcctatgagtttgtagcaatatttgatgctgatttccaacctaacccagattttctaaagcaaacagtgccacatttcaaggacaatcctgagttaggtttagtgcaagctagatgggcttttgtgaacaaggatgagaatttgttgactcgtctccagaacattaatttatgcttccactttgaagttgaacagcaagttaatggtgtatttttaaatttctttggttttaatggaactgctggtgtttggagaattaaagctcttgaggaatctggaggctggcttgaaaggacaactgtagaggatatggacatagctgttcgcgctcatctcaacggttggaaattcatcttccttaacgatgtaaaggtcctttgtgaagtcccagagtcttatgaagcatacaggaagcagcaacatcgctggcattcaggacctatgcaccttttccgcttatgccttccagcaatcataacttccaagataccaatatggaagaaagcaaacttaatactgctattttttttattgaggaaacttatccttcccttctactccttcacattgttttgcataattcttccgctaaccatgtttgtaccagaggctgagcttcctgtttgggtcatttgttatgtacctgtgtttatgtcattcctcaacatccttccagccccaaaatcattccctttcattgccccttaccttctatttgaaaacaccatgtctgtgaccaaattcaacgcaatggtatctggattattccagttgggtagctcctatgagtgggttgtcaccaagaaggctggcaggtcatcagaatctgacttactggctgctgttgagagggaatcaaagacaacgaaccagctgcaaatccagagaggagcttcagaaagtgagctcactgaattaaaccgattaaaggaacagaaagaagtggctcctacacctgttaagagggtcaataagatatacaggaaagagctcactctggcattcctcctactcacagcttccattaggagtctgttagcggcgcaaggagtacatttctacttccttctcttccaaggggtgacctttctcctagtgggtctggatttaataggagagcagatgagctaacactgcatggaagctagagagaaagcttaaggtgctaaaactcagccaatattcttcctatcgactgacaaaagctggtttttggctgtgcagttgaacttttcttttccttcaggcaaatggttaagggtaccatccagttcaatgaccaaagttttatttcctatatcagctttgagatgccccaatagaagttttttattcatcaaaactctattctccgtagtctcagtttttatttacattttatatctttattttttttcacattgggtagtggtcattgtattcttccttaggccgttgaaccattgttgttgctataggtaggatttgtatttcccatttcatacatcactcttgattcttgcttgagtgtggttttggcactaaagattcaagccatatttgtatttgtaaagttcgaaaagcttgagcaaggcataagaatgagcttgcttcatgcctttctggttctcggattccatgttcactctgcgatatgtaaaacatcattcttgtacattgtgttctatctaatataacaaataatttccatcttcttctgatctttgttgccttcagtttgcaatttgttcatatttggcacgtgcacatgtgtgattcaataatgtaaagtgtcggcaggcaaaaggggatgaaccaaaacgtggtggtgggggtggctgaaggtttgagttcgttcatgtgtgcatcacattcccattaaaaaggttgacatggctggggccaagagatctttggtgggcatatgctgattccgtttctttgcaaatgctgtggtaatgagttgtgttccccaggagctcaagacaaacttgat

SEQ ID NO: 1787 - DNA, 2474 bp, Manihot esculenta
cttttttttttttcctcctaatggctccgagattggatttttcagagcggtggacaaaagatagcaaaaagggaactccagtggtagtgaaaatggagaaccccaactactctattgtagaaatcaacggtccagatgctgcatttcagccagttgaaaagagcagaggcaagaatgctaagcaagtgaggtgggtcttgctcctcaaggctcaccgagctgtcggttgtgttgcttggctagctactttcttctggtctttgcttggggccattaagaagaggttgatcttcagacaaggagttacagtggccagtgagaagttgggtaaagggaaactggtgcttagggtcatcagagtctttctagtgacttctctggcaattttagcttttgaagtggttgcttatttgaaaggttggcattattttgataatgctaatctacacattccaaggactctggatttgcaaggcttgcttcacctggtttatgtttcttggttaacatttcgggctgattacattgcacctccaattcaagctctgtcaaaattctgtgtcgttttgttccttatccaatctgcagatcgtttgattctttccttaggttgcttttggattaaatacaagaagattaaacccaggattagtggggatcctttcaagtcagatgatgcagaggcaccaggctatgagtatcctatggttcttgttcaaatcccaatgtgcaatgagagggaggtgtatgagcaatctatctctgcagtctgccaacttgattggccaaaggaccgattactgattcaagttcttgatgattctgatgaggagaacacccaacgtttgattaatgcagaggtttctaagtggagccaaaagggtatcaacataatttataggcatcgtgtggttagaactggttataaagctggcaatctgaagtctgcaatgagctgtgattatgtgaaggattatgagttcgttgcaatattcgatgcagattttcaacctaatcctgacttccttaagttaactgtgcctcatttcaatggcaatcctgagcttgggttggttcaggcaagatgggcctttgtgaacaaggatgaaaatttgttgactcgtctccagaacatcaatttgtgttttcattttgaggttgaacagcaagttaatggtgtattcttaaacttctttggttttaatggaactgctggtgtttggagaattaaagcccttgaggagtctggtggatggcttgaaaggacaactgtagaggacatggacatagctgtccgtgcgcatctcaatggttggaaattcattttcctcaatgatgtaaaggttctttgtgaagttccggagtcctatgaagcttataggaagcaacaacatcgctggcattctggccccatgcaactttttcgcttgtgtcttccagcaattataacttctaagatagcaatatggaagaaagcgaacttaatcctactgtttttcctactgagaaaactcatccttcccttctattcctttacattgttctgcataattcttcccctaaccatgtttgtccctgaggctgaacttcctatgtgggttatctgttatgtgcctgttttaatgtcattcctcaacattcttccagccccaaaatccttccctttcattgtcccctacctcctctttgaaaacacaatgtcagttaccaaattcaatgctatggtatctggattattccagttgggtagctcttatgaatgggttgtcaccaaaaaatctggtaggtcatcagaatctgacttattggctgctgccgaaaaggatttgaaggccacaaatcaaccacagatgcaaagagtagtttctgagagcgagcttggagagttgaaccgattgaaggaacagaaagaatcagcctctaaacctgttaagaaagtgaacaagatttacaggaaagagcttgctctggcattcctcctactcacagctgcagtcaggagcctgttgtctgctcaaggagttcacttctacttccttctcttccaaggtgtaactttccttcttgtgggtcttgatctaattggtgagcaaatgagctaagaaattataaggatgacacgaagaaatcgaaacacacgcatctacttggactcggctaatccgcttcataacagtttcccatcactgttgcaactgagtaagctcagtcctgatctctttctttggaaaacagtggtgaaggggtatcgtctagtacaataaaatgatttttcattttctacatttgatttaaagactataggatggtctctattcgtcaatcacccaccaacactagtcacactctcttatatttattgttccacatagagtatctaccattgtagctccccttaagcattgaattgttgttggttgctataggatggatatttatgttccaatttttttacagtcgacttatattcttgc

SEQ ID NO: 1788 - DNA, 2704 bp, Populus trichocarpa
atgttgtttgtaaagttgtgttaaagatagagaagaaaaatggctccaagattggatttttcagattggtggggaaaagatagcaaggagggaacacctgttgtagtgaaaatggagaatcctaactattctgtcgtggaaatcaatggtccagattctgcatttaggccagttgagaagagtagaggcaagaatgcaaagcaagtcacatgggttttgctcctcaaggctcatagagctgttggttgtgttgcttggttagctactgtcttttgggccttgctagggactataaagaagaggttgatctttagacaaggtgttgctgtggctactgagaagttaggcaaagggaaaatggtacttaaaatcattagagtatttttggttgcttctttggcaattttggcttttgaagtggttgcctatctgaaaggttggcgttattttgagagtgctaatttgcatatcccaaggaccttggatttgcaaggctggcttcatgtggtttatgttgcttggttaacattcagggctgattacattgcgcccttaattcaagctctctctcaattctgtgttgttttgttccttattcaatctgtagatcgtttgatactttgtttgggttgcttttggattaaatacaagaagattaagccaaggattgaagtggatccattcaagtcagatgatgttgaggcatcaggctacgagtatcccatggttcttgttcaaatcccaatgtgtaatgaaagagaggtgtatgagcagtctatctctgcagtttgccaaatggattggccaaaggatcgaatactgattcaagttcttgatgattctaatgatgagagcatccaatggttaatcaaggcagaggttgctaagtggaaccaaaagggtgtcaacataatctataggcatcgtttgattagaactggttacaaggctggaaatctcaagtctgcaatgggctgcgattatgtaaaggattatgagtttgttacaatttttgatgctgatttccagcctaatccagacttccttaagctgacagtgccgcatttcaagggaaatcctgaactggggttggttcaggcaagatgggcatttgtgaacaaggatgagaatttgttgactcgtctccaaaacattaatttgtgttttcactttgaggtggaacagcaagttaatggaacattcctaaatttctttggtttcaatggaactgctggtgtttggagaatcaaagcccttgaagagtctggtggatggcttgaaaggacaactgtagaggacatggacatagctgtccgtgcacatctgaatggttggaaattcatcttccttaatgatgtgaaggtcctctgtgaagttcccgagtcctatgaagcttacaggaagcagcaacatcgttggcattccggtccaatgcaacttttccgcttgtgtctgccagcaattataacctctaagatggcattttggaagaaagcaaacttaatattcctattctttctattgagaaaacttatccttcctttctattccttcacactgttctgcataattcttcctttaacaatgtttgtccctgaggctgagcttcctatgtgggttatttgctatgtgcctgtcttgatgtcattcctcaacattcttcctaccccaaaatccatcccttttattgttccttaccttctctttgaaaacaccatgtcagttaccaaattcaacgccatggtatctggtttattccagttgggtagctcatacgagtgggttgtcaccaagaaggctggtaggtcatcagaatctgacttactggctgctgctgagagggactcaaagacaatgaaccaagcccagatatgcagaggagcttctgagaccgagcttgaactgttaaaccaattaaaggaacaaaaagaagcaaatcctacacctgttaagaaagtgaataagatatacaggaaggagctcgctctagcattcctcctactcacagcttctgtcaggagcttgttatcggcccagggagtccacttttacttccttctcttccaaggtgtgactttccttgtcgttggtcttgatctgattggagagcaaataagctaagcgtaaactaaagcaagatagagtacaatacacttccaatcaagttcaggtaacctgcaaatatccaccctatctggatcgacttgcacttaaaaggaagttcggtcctttctttcctttgcaaatggtggtgaagaatagccttcaattcaataaaacgaagtcattttcaacctgtgatttgaaagctctagaattttctctattcagaaatccctctccatactgtggtcatacttcctcttattattgttatttttttcacataggatatcggatcatcgttagttttcctcgggcattgaattgttgctggttgtcatgggtaggatattaggtttcaatttttttacagttgacttatattcatgtttgggtgtgtgatttagcagcattcaaggttcaagccatatttcctcttgtaaagtccaaaaagtttgagtgaagtcaaagcataagcttgcttaatgctgtctggtttccagattttatccttataatgtgtaacatgtaaaagaactactatatgtacattttcacatgttctgttttatccaaggtaacaagtaatccctctctccac

SEQ ID NO: 1789 - DNA, 2890 bp, Eucalyptus grandis
accaggttggttgtggcttgtaagagggggtgagagcctttttgggaagcattaaaagaacctctccagcactctcctcctcttggctctctttttctgccacattcatcgccaacagtgaaagggaagaggcccttgaaatgctttccttccagtgttcttccttcactgggtccacttctctctgatcagttgtagcaatgagggaattcctttcatcattctgagatctgggttcacacgctaaagagtggatttccaagtctcactgtgctcttggggtctttattcctcggtcgtctgtttctgggtttcaagattttccaagggcctcgcgggagaaatggctccaagattggatttttcagattggtgggcgaaggagaacaggaagggaacccctgtggtggtgaaaatggagaacccgagttactctgtggttgaaattgatggcccagatgctgcattcaggccggttgagaagagcagaggcaaaaatgcaaagcaggtgacttgggtcttgcttctgaaggccaaccgtgcagtgggttgtgtggcttggttagccactgtgctctgggcattgcttggcaccatcaagaagaggctgatcttcaggcaaggagtggccatggagagtgataaaatggggaaaggaaggttgttgttcagggtcataagagcgttcttggtcacttctctggtaatcctgggttttgaggtggtcacttatttcaaaggctggcactatttcgagcgcccaaacttgcacataccacggaccactgatgtccatggcttgctccacacgatttatgtcgcttggctgacttttagagctgattacattgccccaccaattcaagcactctccaagttttgcgtggctctgttcttgatccaatccgtggatcggatgatactctgcctcggttgtttgtggataaagtacaagaaagtcaagccgaggatcgagagggatccattcaaatcggatgatgccgaggggattggatgcgagtaccccatggttcttgttcagatcccaatgtgcaatgagagagaggtatatgagcaatctatctctgcagtctgccaaattgactggccgaaggaccgtctacttatccaagttcttgatgattctgataacgagagtatacagtgcttaattaacgcagaagtggccaaatggagtcagcggggcatcaacataatttatcgacatcgtttggttcgaactggttacaaagctggaaatctcaaatctgctatgagctgtgactatgtgaagggttacgagttcgtcgcgatctttgacgcagatttccagccgactcccgatttcctaaaacagactgttccacattttaaggataatcctgaactgggattggtccaggctaggtgggctttcgtgaacaaagacgagaacctgttgactaggcttcaaaacattaacctgtgtttccacttcgaggtagaacagcaggttaatggagtgttcctgaatttcttcggtttcaatggaactgctggtgtctggaggatcaaagctcttgaagaatctggaggctggctcgaaaggacaaccgtagaggacatggacattgcagtccgtgcgcaccttaatggttggaaatttatcttcctagatgatgttaaggtactctgcgagcttcctgagtcatatgaagcctataagaagcagcaacatagatggcattctggtccaatgcaactttttcgtttgtgtctacctgcaattgtaacttccaagatctctgcttggaagaaggcgaatctcatactcttattctttctacttaggaaactcattcttcccttctactccttcaccttgttctgcataatccttccactaaccatgttcgtccctgaggctgagcttcccatgtgggtcatatgttacgtgcccgttttcatgtcattcttaaacatcttccctgctccaaagtccttccccttcatcgtgccttacctcctgttcgaaaacaccatgtctgttaccaaatttaatgcaatgatatctggactattccagctcggcagctcttatgaatgggttgtcacgaaaaaggctggcaggtcatcagaatctgacctgcttgctgctgccgagagagagacaaagagcacaaaccaacaacaactaactagaggatcctctgagagtgagcttcaagaattgaccaagttaaaggaacagcaaaatgaagtgactattacaccagttaagaagaccaacaaaatttacaggaaagaactcgttttggcattcctcctgctgacggctgccgtgaggagtctcttggctgctcaaggagtccacttctacttcctgctcttccagggtgttactttcctccttgtgggccttgatctgatcggcgagcagatgagctaaagttactcaagtcctgctactacaacgaatcggggaagtcgtcagcctagaaaattaaagaagctgataccagcatccacagcccaaactgagaaaattcttcactaccatgctcagttgcaaaaatggtaattgttcagactacataagctgaacccttcagtctccagtgtgaagcctccataggtttttatttatttatttttccttaattgactactgtgtacaataaattgtttcaagttactctgattcatgttgttcgttataggttgggggaaacaaattaatgtcatattctactctttttcttcttcttttttccttttttggtttttctagacctattggaaaagagttcttttccagggttgtgatttggcatctcatcttggaagccatattgtacaaggagaaaataacacaaagttgggagttcacttgcttgatattttctttgtt

SEQ ID NO: 1790 - DNA, 3340 bp, Vitis vinifera
tttggatttgaggaagaaaataagaaaaattcttacccatcctgcattattttatgtatttgtttgtgtaaagtgaaagtggattggttgtccctctccctttgaagcaatccgagtgtagaatctatgaaggtgatgatgggacttttccaccattgtagggctcagttggggagatcaaggaccccttgagcattgggatctccgttttttgtggctatgtgttcagcctcatttagtcagttcttgttaataaatattgtcgcctggatcgttcgccactaaagaatggagtgtccatttccagtcaacaagcctgtactgtgtttgctcagggttttacagtagcggacagatacctttcctcataatggtgctttcccatgttgaatgtctcgtggggagcctttgagagagtgcaaagaacctcccacccactctccttttccctgcctttttccttgctgcatttggggttcaatggagagctgaaactctgattgtggtgatctagtttttttgcggttgcttctcaaatgggagttcatttcttgattttgtgatctgggttgtgaagatttgttgagaatattcgagtttttgaggttttgcgtggtgggttggggatacttttggttagttcttgtgcgtttgatactagttcaccataagaggaaatggctccaagattggatttttcggatttgtggggaaaggatacaaggaagggcacgccggtggtagtgacaatggagaaccccaactactcagttgtagaaatcgatggcccagactctgcattccggccggtcgaaaagagcaggggcaagaatgccaagcaggttacatgggtcttgcttctaaaggctcatcgtgccgtgggttgtgttgcttggcttgctacagttctctgggcattgctgggaaccattaagaagaggttgatttttaggcaaggagtagctatggagagtgagaagacggggaagggaaaactgctgtttagaatcatcaaagtcttcttagtcacttccttggcaattctttcttttgaggtggttgcttatttgaaggggtggcattatttccggaatcctaatttacacattcctcggacctcagatttccagggcttgctccacatggtttatgttgcttggttgactcttcgggctgattacattgcccccctaattcaagctctctctaaattctgtgttgctctcttcctaatccagtctgcggatcgaatggtgctctgcttaggttgtttatggatcaaatacaagaagattaaaccaaggattgatggggatccattcaaattggaagatgttgagggatctggctatgagtaccccatggttcttgttcaaatcccaatgtgtaatgagagggaggtgtatgagcagtccatctctgctgtctgccaaattgattggccaaaagatcgcttgctgatccaagttcttgatgactctgatgatgagagcattcagtgtctaattaaagcagaagtctataactggagtcagcagggtatcaacatagtctatcggcatcgtttggttagaaccggttacaaagccgggaatctgaagtctgccatgagctgtgactatgtgaagaattatgagtttgttgcgatttttgatgcagatttccagccaaacccagatttccttaagcagacggttccacactttcagggcaatccagacttggggttggttcaagctagatgggcttttgttaacaaggatgagaacttgttgactcggcttcaaaacattaatttgtgtttccattttgaagtggaacagcaggttaatggggtattcctaaatttttttggctttaatggaactgctggtgtttggagaatcaaggctttggaggattctggaggttggcttgaaaggactactgtagaggatatggacatcgctgttcgagcccatctgaatggttggaaattcatattcctcaatgatgttaaggtcctctgtgaagttcctgaatcttatgaagcttacaggaagcagcaacatcgatggcattctgggcctatgcaacttttccgattgtgtctcccagctgtcataacttctaagatatcaatatggaagaaagccaacatgctactactgttcttcctattgagaaaacttatccttcccttctattcttttacattgttttgcataattctccctttaaccatgtttgttcctgaagcagaacttcctgtgtgggtcatctgttatgtgcctgtttttatgtcattcctcaacattctccctgccccaaaatccttccctttcattgttccctacctcctctttgaaaacaccatgtcagtgaccaaattcaatgcgatggtctctggactgttccagttgggtagctcatatgagtggattgtcactaagaaggccggccgagcatcagaatctgacttattagctgctgcagagagggactcaaagacagtgaaccaacccctgattcacagaggagcttctgagagtgaactctctgagctgaaccgtttgaaggagcagaaagaatcaactcctccagccgttaaaaaaatcaacaagatatataggaaagagctcacactggccttcctcctactcactgcctctgtgaggagcctattagcatcccagggagtccatttctacttcctgctctttcaaggggtgacctttcttcttgtgggtcttgacttaattggagagcagatgagtcagtgatgcattgaattggaagcaaaggaagaggacaccagacatacccacctgtttaaactctgctgaagtgaatgattgcagcaaaagattgtggtggtggtgcagttgaggaagtcacaatccttttatccttggccaatggcagcaaaggggtgcctgagtttagttcaataaatttacatttttttttccctttaaatatcttatttgaagtgtccaataggattttctctatttattgatcattctccataccagatagcattttttttttaagcacataggatttctcattgtaatctacctcaggtcttgaatgcagttggttgttatatagttagaatcagcctcagagtcttcatttacttcctttttttttttgttttaccttttatagatggcttcctcttcttgcttggtgtgatttggtattagactcaaggccatattgtattactccaatcccaaagtttgaatgaggcccaaatgtgagcttgctttctggtttttcagattccaaaaaaggcctagatgtgaacatgtataatgcctcgtctttacatttgcaattgttttttttt

SEQ ID NO: 1791 - DNA, 2901 bp, Gossypium hirsutum
atgttgcctctgtcttctagcatctaccttctcactcttactctcaccctttcctttcccttctcactacttacttactccacacttcttcttcttctgttctacatttttgtctacaatggataccctcaaccttccttctttcaccatttgagtctgggttccttttggtcttcttcattacctgacctttgagatctagttttcaacatttgttgtttgctggttgtagtgtgagcaagacccattgaactgaaaatggctccgagcttagatttctcgaattggtggccaaaggatgctaggaaagggacacccgtggtagtaaaaatggagaaccctaactactcagtggtggaaatcgacggcccagatgctgcattcaggcctgtggaaaaaagcagaggcaaaaatgcaaagcaagtgacttgggttttgcttctcaaggctcatcgtgccgtcggttgtctcgcttggattgcttcattcttctgggcattgcttggaaccataaagaaaaggctgatctttaggcaagatgttgcaatggccagtgaaaaactggggaaaggaaagctgctcttcacagtcattaaagccttcctagtgacttccctcacaattctggccttcgaagttgtggcttatctcaagggatggcattattttcgaaatccaagtttgcacattccgaggagcactgatatccagggcttgcttcacttggtttatgtcacttggttgtcggtccgggccgattacattgcaccaccaattcaagctttgtctaaattttgtgtagctttattccttatccaatctgtagatcgtatgatacttagtttaggctgcttttggattaaatacaagaagattaaacccagaattgagggggatcctttcaagtcagatgatgttgagggatcagcctatgagtatcccatggttcttgttcaaatcccaatgtgtaacgagagagaggtttatgagcagtctatctctgctgtctgccaacttgattggccaaaggaccgattattggttcaggttcttgatgattctaatgacgaaagcatccagtatttgattaaagcagaggttgctaagtggaaccaaaagggtgttaacataatttatcggcaccgcttggtaagaactggttacaaggctgggaatctcaagtctgcaatgagctgcgagtatgtacaggcctatgagtttgtagcaatatttgatgctgattttcaacctaaccctgattttctaaagcaaactgtgccacatttcaaggacaatcctgatttagggttagttcaggctagatggacatttgtcaacaaggatgagaatttgttaactcgtctccagaacattaacttatgtttccactttgaagttgagcagcaagttaatggtgtatttttaaatttctttggttttaatggaactgctggagtctggagaattaaagctcttgaggaatctggaggttggcttgaaaggacaactgtagaggacatggacatagctgttcgtgcacatctcaatggttggaaattcatcttccttaatgacgtaaaggtcctttgtgaagtccccgagtcgtatgaagcatacaggaagcagcaacaccgctggcattcaggacctatgcacctcttccgcttatgccttccagccatcataacttccaagatagctatatggaaaaaggcaaatttaatactgctattctttctattgaggaagcttatccttcctttctactcgttcacattgttttgcataattcttcctctaaccatgttcgtaccagaggccgagcttcctgtttgggttatttgttatgtacctgtttttatgtcattcctcaatattcttccatcccccaaatctttccctttcattgtcccttatcttctatttgaaaacaccatgtctgtgaccaaattcaatgcaatggtatctggattattccagttgggtagctcctatgagtgggttgtgaccaaaaaggctggcaggtcatcagaatctgacttactggcttccgctgagagggaatcgaagataatgaaccaactgcaaattcagagaggagcttcggaaagtgaactttctgaattaaaccgattgaaggaacagaaagaggcggctcctgtacctgttaagagggtcaataagatatacaggaaagagctcactctggcattcctcctgcttacagcttcggttaggagcctgttatcggcacagggagtacatttctacttcctcctcttccagggggtgacttttctcctagtcggtctagatttaataggagagcagatgagctaatgctgcatggaagcttgaaagaaatcaaaatgtgctaagactctctccatttccaccgacaaaagctggtttctggctgtgcagtcgaagtttttctcctcaggaaatggtttaacggtaccatcctggtgctcaataaccaaagtttcattctctacgtcagcattgaatgccgaattgaaggtttttattcgtcagtaacactactttctgtattcacagtttctatctacttctaatatccttttatatatatatatttcacattggatagtggtcattgtattcttagggattgaaccatttgttattattgttgttagacttataggtagattttgtacttcagtgttcatgtttcaccctgattcttgattgtgtggtttggcaatgaagattcaagccatattgtatttgtaaaagcttggaaagcttgcttgatgtcctttgtggctctcagagtccaaatttactatgagataatgtaaaaaacatccaatatttgtacattgtgttctatctaatatataacaaataattcctaacaaaaaaaaaactaaa

SEQ ID NO: 1792 - DNA, 3419 bp, Gossypium raimondii
acttggagtgaagtcgaagagattttgagtaatgtttccttttactttttgatagcagatggtatagataatgtataagctaacgacatacgcagcgaagaacagagagtaaattgcggatgtgaagttaaaaatggaaggggtgagagcttgttttgaattgattgttagacaaagaaaacccacatggtgaggtggtgtttgggttcttaccacactgcactgcagacacctttcccacataaaataaatttgttttcccatgttgcctctgtcttctagcatctaccttctcactctcactctcactctcaccctttcctttcccttctcactacttacttgctccacacttctttttcttctgttctacattttgtctacaatggataccctcaaccttccttctttcaccatttgagtctgggttccttttggtcttcttcattacctgacctttgagatctgggttttcaacatttgttgtttgctggttgtagtgtgagcaagacccattgaactgaaaatggctccgagcttagatttctcgaattggtggccaaaggatgctaggaaagggacacccgtggtagtaaaaatggagaaccctaactactcagtggtggaaatcgacggcccagatgctgcattcaggcctgtggaaaaaagcagaggcaaaaatgcaaagcaagtgacttgggttttgcttctcaaggctcatcgtgccgtcggttgtctcgcttggattgcttcattcttctgggcattgcttggaaccataaagaaaaggctgatctttaggcaagatgttgcaatggccagtgaaaaactggggaaaggaaagctgctcttcacagtcattaaagccttcctagtgacttccctcacaattctggccttcgaagttgtggcttatctcaagggatggcattattttcgaaatccaagtttgcacattccgaggagcactgatatccagggcttgcttcacttggtttatgtcacttggttgtcggtccgggccgattacattgcaccaccaattcaagctttgtctaaattttgtgtagctttattccttatccaatctgtagatcgtatgatacttagtttaggctgcttttggattaaatacaagaagattaaacccagaattgagggggatcctttcaagtcagatgatgttgagggatcagcctatgagtatcccatggttcttgttcaaatcccaatgtgtaacgagagagaggtttatgagcagtctatctctgctgtctgccaacttgattggccaaaggatcgattattggttcaggttcttgatgattctgatgacgaaagcatccagtatttgattaaagcggaggttgctaagtggaaccaaaagggtgttaacataatttatcggcaccgcttggtaagaactggttacaaggctgggaatctcaagtctgcaatgagctgcgagtatgtacaggcctatgagtttgtagcaatatttgatgctgattttcaacctaaccctgattttctaaagcaaactgtgccacatttcaaggacaatcctgatttagggttagttcaggctagatggacatttgtcaacaaggatgagaatttgttaactcgtctccagaacattaacttatgtttccactttgaagttgagcagcaagttaatggtgtatttttaaatttctttggttttaatggaactgctggagtttggagaattaaagctcttgaggaatctggaggttggcttgaaaggacaactgtagaggacatggacatagctgttcgtgcacatctcaatggttggaaattcatcttcctcaatgacgtaaaggtcctttgtgaagtccccgagtcgtatgaagcatacaggaagcagcaacaccgctggcattcaggacctatgcacctcttccgcttatgccttccagcaatcataacttgcaagatagctatatggaaaaaggcaaatttaatactgctattctttctgttgaggaagcttatccttcctttctattcgttcacattgttttgcataattcttcctctaaccatgttcgtaccagaggccgagcttcctgtttgggttatttgttatgtacctgtttttatgtcattcctcaatattcttccatcccccaaatcgttccctttcattgtcccttatcttctatttgaaaacaccatgtctgtgaccaaattcaatgcaatggtatctggattattccagttgggtagctcctatgagtgggttgtgaccaaaaaggctggcaggtcatcagaatctgacttactggcttctgctgagagggaatcgaagataatgaaccaactgcaaattcagagaggagcttcggaaagtgaactttctgaattaaaccgattgaaggaacagaaagaggcggctcctgtacctgttaagagggtcaataagatatacaggaaagagctcactctggcattcctcctgcttacagcttcggttaggagcctgttatcggcacagggagtacatttctacttcctcctcttccagggggtgacttttctcctagtcggtctagatttaataggagagcagatgagctaatgctgcatggaagcttgaaagaaatcaaaatgtgctaagactctctccatttccaccgacaaaacctggtttctggctgtgcagtcgaagtttttctcctcaggaaattgtttaacggtaccatcctggtgctcaataaccaaagtttcattctctacgtcagcattgaatgccgaattgaaggtttttattcgtcagtaactctactttctgtattcacagtttctatctactttctaatatctttatatatatatatatttcacattggatagtggtcattgttttcttaggggttgaaccatttattattattgttgttacagacttataggtagattttgtacttcagttttcatgtttcaccctgattcttgattgtgtggtttggcaataaagattcaagccatattgtatttgtaaaagcttggaaagcttgcttgatgtcctttgtggctctcagagtccaaatttactatgagataatgtaaaaaacatccaatatttgtacattgtgttctatctaatatataacaaataattccttttcccccaatgtgtctttgcaatttgttcatatttggcatgtgtgagaatgtgattcaataatgttggaagtgtcggtgagcaaaaggagatgaaccaaacgtggtggtggttgcgggtggttcgtgtgttcatcactttcgcattaaagaaggttgacctggctggggaccatgagatctttagtggacgtgtgctgattctggttgttttacaaatactgtgggttgcgtttgtgttccctggagcttgagacaaacttgat

SEQ ID NO: 1793 - DNA, 3127 bp, Ricinus communis
ggtgttttagtttacttgctagtcaactgatgttttctcatgagctgataatgatgtatagttaattttagtgtgtgtatttatactttttctttttctaatctacaaatgtactttttaattatatggggcagattctataattgctaggtaatccaccaaagtggtaaaatttagcaagttaaaaggggaatggttgggcttcgtctttgtttcgtattactattagacaaatacacatggtgttagggtctcttacagctgcagcagatacctttcctctgccaattgccatgttggatctctcagtgaagattgtgtctttaggaggacagagaagaacatctctcacttctctttcttagcttcttctccttgctactacattgtcccccccctgtagatagtttatttattattattattttgttggttcttgtttttgtgaagaaagaggaaaaacgaaatggctccgagattggatttttcagattggtgggcaaaagatagcaagaagggtactccagtcgtagtcaaaatggagaatccgaactactctgttgtagaaatcaacggcccagatgctgcattccagccggttgagaagagccgaggcaaaaatgccaagcaagtcacatgggttttgctcctcaaggctcacagagcagtaggttgtgttgcttggatagctactttcttctgggcatttcttggagctatcaagaaaaggttgatctacaggcaaggagttacagtggccagtgagaagctgggcaaaggaaaattggtacttagaatcattaaaatgtttctagtgacttctttagcaatcttggcttttgaagtggttgcttattttaaaggctggcattattttgagaatgctaatctacacattccgaggacttcagatttgcaaggcttgctacacatggtttatgttgcttggataacatgtcgggctgattacattgcacctctaattcaacttctttctaaattctgtgttgtcctattccttattcaatctttagatcgcatgatactatctttaggttgcttttggattaaatacaagaagataaaaccaaggattgttggggatccattcaagtcagatgatgctgaggcaccaggctatcagtatcccatggttcttgttcaaatgccaatgtgtaatgagagggaggtatatgagcaatctatctctgcagtctgccaacttgattggccaaaagatcgattacttgttcaagttcttgatgattctgatgatgagagcatccagtgcttgatcaaggcagaagttgctatgtggagccaaaagggcatcaacataatttatcggcatcgtgtggttagaactggttacaaagctggcaatctcaagtctgcaatgaattgtgattacgtgaaggattatgagttcgttgcaatatttgatgcagatttccaacctaatccagactttcttaagttaactgtgcctcatttcaaggataatcctgaactagggctggttcaagcgagatggtcctttgtgaacaaggatgagaatttattgactcgtcttcaaaacattaatttgtgtttccattttgaggttgaacagcaagttaatggtatattcctaaatttctttggttttaatggaactgctggtgtctggagaatcaaggcccttgaggagtccggtggatggcttgaacggaccactgtagaggacatggacatagctgttcgggcacatctcaatggttggaaattcattttcctcaatgacgtaaaggttctttgcgaagttccagaatcctatgaagcttacaggaagcagcaacatcgctggcattctggtccgatgcatctcttccgcttgtgtcttccagcaattctaactgctaagatggcaatatggaagaaagcaaatttgatactactcttcttcctattgagaaaactcatccttccattctattccttcacgttgttctgcataattcttcctttaaccatgtttgtccctgaggctgaacttcctatatgggttatttgctacgtgcctgtgttcatgtcattcctcaatattcttccagccccaaaatccttccctttcattgttccttacctcctctttgagaacaccatgtcagttaccaaattcaatgctatggtatctggattattccagttgggtagttcttatgagtggattgtcaccaagaaagctgggaggtcttcagaatctgacttgcttgctgctgctgagagggactcaaaggcaactaacctatcacagatacatagaggagtttctgagagtgatcttggagaactgaaccgattaaaagaacagaaagaagcagcccctaaacctgtcaagaaggtgaacaagatatacaggaaagagctagctctggcattcctcctgctcacagctgctgtcaggagcctgttgtctgcccaaggagtccatttctacttcctactcttccaaggcgtgactttcctcgttgtgggtcttgatctaattggtgagcaaatgaactaagaagaaatatcagcaagacagagacatgaaacatgcatgaggtgatatttggctaatatgcatcataaccaattcatatcactgttgcaactgaggaagctcagtcctttcctttccttggaaaatatgggtgaagggtatatgctccagttcaataaaatgaatttttcatttattacatttgatttggagattccaataggattttcccttttcaccaatcatcccacacccccaatatagtcacactgtttcttattttcatttttcacagggtaccagtccttttagctcttgttaagcattgaattattcttgattgttataggaaggataatatgtttcattgtttttttacggttgacttaaattcttgcttggttgtgatttagcaattaagattcaagcaatattgtacttgtaaagtcttcaaaaaaaaaaaaagaaatgttttgagtgaggttgaaggatgagcatccttcatgctttctggttttcagcttccatcttccaagtgtgtttcagaaactatatgtatattcgcacttattctatttttattttatctaatgtaacaag

SEQ ID NO: 1794 - DNA, 3014 bp, Gossypium hirsutum
tgaagttaaaaatggaaggggtgagagcttgttttgaattgatggttagacaaagaaaacccacatggtgaggtggtgtttgggttcttaccacactgcactgcagacacctttcccacataaaataaatttgttttcccatgttgcctctgtcttctagcatctaccttttcactctcactctcaccctttcctttcccttctcactactaacttgctccacacttctttttcttctgttctacattttgtctacaatggataccctcaaccttccttctttcaccatttgagtctgggttccttttggtcttcttcattacctgacctttgagatctagttttcaacatttgttgtttgctggttgtagtgtgagcaagacccattgaactgaaaatggctccgagcttagatttctcgaattggtggccaaaggatgctaggaaagggacacccgtggtagtaaaaatggagaaccctaactactcagtggtggaaatcgacggcccagatgctgcattcaggcctgtggaaaaaagcagaggcaaaaatgcaaagcaagtgacttgggttttgcttctcaaggctcatcgtgccgtcggttgtctcgcttggattgcttcattcttctgggcattgcttggaaccataaagaaaaggctgatctttaggcaagatgttgcaatggccagtgaaaaactggggaaaggaaagctgctcttcacagtcattaaagccttcctagtgacttccctcacaattctggccttcgaagttgtggcttatctcaagggatggcattattttcgaaatccaagtttgcacattccgaggagcactgatatccagggcttgcttcacttggtttatgtcacttggttgtcggtccgggccgattacattgcaccaccaattcaagctttgtctaaattttgtgtagctttattccttatccaatctgtagatcgtatgatacttagtttaggctgcttttggattaaatacaagaagattaaacccagaattgagggggatcctttcaagtcagatgatgttgagggatcagcctatgagtatcccatggttcttgttcaaatcccaatgtgtaacgagagagaggtttatgagcagtctatctctgctgtctgccaacttgattggccaaaggaccgattattggttcaggttcttgatgattctaatgacgaaagcatccagtatttgattaaagcagaggttgctaagtggaaccaaaagggtgttaacataatttatcggcaccgcttggtaagaactggttacaaggctgggaatctcaagtctgcaatgagctgcgagtatgtacaggcctatgagtttgtagcaatatttgatgctgattttcaacctaaccctgattttctaaagcaaactgtgccacatttcaaggacaatcctgatttagggttagttcaggctagatggacatttgtcaacaaggatgagaatttgttaactcgtctccagaacattaacttatgtttccactttgaagttgagcagcaagttaatggtgtatttttaaatttctttggttttaatggaactgctggagtctggagaattaaagctcttgaggaatctggaggttggcttgaaaggacaactgtagaggacatggacatagctgttcgtgcacatctcaatggttggaaattcatcttcctcaatgacgtaaaggtcctttgtgaagtccccgagtcatatgaagcatacaggaagcagcaacaccgctggcattcaggacctatgcacctcttccgcttatgccttccagcaatcataacttgcaagatagctatatggaaaaaggcaaatttaatactgctattctttctgttgaggaagcttatccttcctttctattcattcacattgttttgcataattcttcctctaaccatgttcgtaccagaggccgagcttcctgtttgggttatttgttatgtacctgtttttatgtcattcctcaacattcttccatcccccaaatctttccctttcattgtcccttatcttctatttgaaaacaccatgtctgtgaccaaattcaatgcaatggtatctggattattccagttgggtagctcctatgagtgggttgtgaccaaaaaggctggcaggtcatcagaatctgacttactggcttccgctgagagggaatcgaagataatgaaccaactgcaaattcagagaggagcttcggaaagtgaactttctgaattaaaccgattgaaggaacagaaagaggcggctcctgtacctgttaagagggtcaataagatatacaggaaagagctcactctggcattcctcctgcttacagcttcggttaggagcctgttatcggcacagggagtacatttctacttcctcctcttccagggggtgacttttctcctagtcggtctagatttaataggagagcagatgagctaatgctgcatggaagcttgaaagaaagcaaaatgtgctaagactctctccatttccactgacaaaacctggtttctggctgtgcagtcgaagtttttctcctcaggaaattgtttaacggtaccatcctggtgctcaataaccaaagtttcattctctacgtcagcattgaatgccgaattgaaggtttttattcgtcagtaactctactttctgtattcacagtttctatctactttctaatatctttatatatatatttcacattggatagtgctcattgttttcttaggggttgaaccatttattattattgttgttacagacttataggtagattttgtacttcagttttcatgtttcaccctgattcttgattgtgtggtttggcaataaagattcaagccatattgtatttgtaaaagcttggaaagctggcttgatgtcctttgtggctctcagagtccaaatttactatgagataatgtaaaaaacatccaatatttgtacattgtgttctatctaatatataacaaat

SEQ ID NO: 1795 - DNA, 3295 bp, Gossypium hirsutum
atgtttattttctatgcttttagagcttaaacaatttcggcagcatctgaaaccttgtgcttccagatttggttttgattatttaaatatttaatttattctggcaactaatttgtggagtgttttgtttactctttagtcaaaactggagtgtggaagtgaactccgttttacgtaaagtatttttaattagcgtttcttttgctaaacatgcttagcagattcgttccctgctctgctgcataaactaaaaaacatttagagagtaaaaattctgtgtatggggaattaaaacttaaaaacatggaccggctgagcttgtttggattattacaccgaaaaataaaaaccccacatggtatggtgtttgtttgggttcttacttcttacacattacagctgcagatacctttcctcataatgttgtgttcccatcgttgcttgtcttctgtcttttagactgtcctttcctacttgcacacaatctcctacacaactcctttgtcttcgcttcttcttcctttgctacaatgaagaccttttgattttgggtaattgttcattacttgatctttgagatctggggttttgaaccgttgttgtcgggatttggtttcatttgggctacttgttgagaaaaaaaatggctccgggattagatttctcagattggggggcaaaggagacgaggaaagggacaccggtggtagtgaaaatggagaacccaaactactcggtggtagaaatcgaggacccagatgctgcattcaggcctgtggaaaagagcagagggaaaaatgcaaagcaagtgacatgggttttgcttctcaaggctcatcgtgctgtcggctgtgtcgcttggatagctacactgttctgggcattgcttggaaccataaagaaaaggttgatcttcaggcacgatgttgacatggcaagtgaaaagttggggaaagggaactgctcttcactgtcattaaagcctttctggtgacttccttgacaatcctagcttttgagattattgcttatttcaatggttggcattattttcagaaccccagtttgcacattcccagaaccagtgaaatccagggactgttccacttggtttacgtcacttggttgtggtttcgggccgattacattgcaccattaatccaagccttgtctaaattctgtgtagctctattccttatccaatctgcagaccgtatggtactttgcttaggctgcttttggattaaatacaagaagattaagccgagaattgaggggaatccattcaagtcaaatgatgtcgagggatctggttacgactaccccatggttcttgttcaaatcccaatgtgtaacgagagggaggtatatgagcagtctatctctgctgtctgccaacttgattggccaaaggaccgattattgattcaggttctggatgattccgatgatgaaagcatccagtgtttaattaaagcagaggttgctacatcgaaccaaaggggtatcaacataatttatagacatcggttaataagaactggttacaaggctgggaatcttaagtctgcaatgagctgcgagtatgtacaggcctatgagtttgtagcaatattcgatgctgatttccaacctaaccctgattttctaaagcaaacagttccacatttcaaggacaatcccgagttagggttagttcaggctagatggacttttgtgaacaaggatgagaatttgttgactcgtctccagaacattaatttatgtttccactttgaagttgaacagcaagtaaatagtgtatttttaaatttctttggttttaacggaactgctggtgtttggagaattagagctcttgaggaatccggaggctggcttgaaaggactactgtagaggacatggacatagctgttcgtgcgcatcttaatggttggaagttcatcttcctaaatgatgtgaaggtcctttgtgaagtccccgagtcttatgaagcatacaggaagcaacaacatcgatggcattcgggaccaatgcacctattccgcttatgccttccagcaatcataacttccaagatagcaatatggaagaaagcaaatttaatacttctgttctttttattgaggaagcttatccttcccttctactccttcacattgttttgcataattcttcctctcaccatgtttgtaccagaggctgagctccctgtttgggtcatttgttatgtacctgtttttatgtctttcctcaacattcttccagcccccaaatcattccctttcattgtcccttaccttctattcgagaacaccatgtctgtgaccaaattcaatgcaatggtatctgggttattcaagttgggtagctcctatgagtgggttgtcaccaaaaaggctggcaggtcatcagaatctgacttattggctgctgctgagagggaatcaaagacaacaaaccagctgcaaatccagagaggagcttctgaaagtgagctaactgaactaaaccgattgaaggcggcccctgttcctgttaagagggtgaataagatatacaggaaagaactcactctggcgttcctcctactcacagcttcagttaggagcctgttatcggcacaaggagtacatttctacttcctcctcttccaaggggtgacttttctcctagtcggtctggatttaataggagagcagatgagctagtgctgcatgccatccggttcaataaccaaagtttcattttcaatatgcccaatagaaggtttttattcattaataactttacttcctgtagtctcagtttgttatttttatttttcacattggatggtggtccttatgttatcccttaggcgttaaagcattgtttgtctataggtaggatttgtatttcaccctgattcttgcttgagtgtttctggtttggcactaaagattcaagccatattgtatttgtaaagttggaaagcttgggtagggcataagaatgagcttgcatgatgctgctctttggttccatatttacgttgaggatatgtaaaacatcaaatcttgtacattgtgttatgtccaatacatgacaattaaattccttctttttttcttctcctggtgtgatgggtgggactccatcaaaatcaatatttttatcgctgaacagtaaataaatagtaatataaggagttgagtcaatctcacgtagacgaaatatttaaaattgcaattaggttcaattagattgcgcgtcgaggtagttgtcgtgtcctagacgtgtgatggtcggtac

SEQ ID NO: 1796 - DNA, 3196 bp, Gossypium hirsutum
cataaactaaaaaacatttagagagtaaaaattctgggtaatgggaaattaagacttaaaaacatggaccggctgaggttgtttggattattacaccgaaaaataaaaccccacatggtatggtgtttgtttgggttcttacttcttacacattacagctgcagatacctttcctcataatgtggtgttcccatcgttgcttgtcttctgtcttttagactgtcctttcctacttgcacacaatctcctacacaactcctttttcttcgcttcttcttcctttgctacaatgaagaccttttgattttgggtaattgttcattacttgatctttgagatctggggttttgaacgttgttgtcgggatttggtttcatttgggctacttgttgagaaaaaaaatggctccgggattagatttttcagattggggggcaatggagacgaggaaagggacaccggtggtagtgaaaatggacaacccaaactactcggtggtagaaatcgaggacccagatgctgcattcaggcctgtggaaaagagcagagggaaaaatgcaaagcaagtgacatgggttttgcttctcaaggctcatcgtgctgtcggttgtgtcgcttggatggctacactgttctgggcattgcttggaaccataaagaaaaggttgatcttcaggcaagatgttggcatggcaagtgaaaagttagggaaagggaaactgctcttcactgtcattaaagcctttctggtgatttccttgacaatcctggcttttgagattattgcttatttcaatggttggcattatttccagaaccccagtttgcacattcccagaaccagtgatatccagggactgttccacttggtttacgtcacttggttgtggtttcgggccgattacattgcaccattaatccaagccttgtctaaattctgtgtagctctattccttatccaatctgcagaccgtatggtactttgcttaggctgcttttggattaaatacaagaagattaagccgagaattgagggaaatccattcaagtcaaatgatgtcgagggatctggttacgactaccccatggttcttgttcaaatcccaatgtgtaacgagagggaggtatatgagcagtctatctctgctgtctgtcaacttgattggccaaaggaccgattattgattcaggttctggatgattccgatgatgaaagcatccagtgtttaattaaaacagaggttgctacatggaaccaaaggggtatcaacataatttatagacatcggttaataagaactggttacaaggctgggaatcttaagtccgcaatgagctgcgagtatatacaggcctatgagtttgtagcaatatttgatgctgatttccaacctaaccctgattttctaaagcaaacagttccacatttcaaggacaatcccgagttagggttagttcaggctagatggacttttgtgaacaaggatgagaatttgttgactcgtctccagaacattaatttatgtttccactttgaagttgaacagcaagtaaatggtgtatttttaaatttctttggctttaatggaactgctggtgtttggagaattagagctcttgaggaatccggaggctggcttgaaagaactactgtggaggacatggacatagctgttcgtgcgcatcttaatggttggaagttcatcttcctaaatgatgtgaaggtcctttgtgaagtccccgagtcttatgaagcatacaggaagcaacaacatagatggcattcgggaccgatgcacctattccgcttatgccttccagcaatcataacttccaagatagcaatatggaagaaagcaaatctaatacttctgttctttttattgaggaagcttatccttcccttcttactccttcacattgttttgcataattcttcctctcaccatgtttgtaccagaggctgagctccctgtttgggtcatttgttatgtacctgtttttatgtctttcctcaacattcttccagcccccaaatcattccctttcattgtcccttaccttctattcgagaacaccatgtctgtgaccaaattcaatgcaatggtatctgggttattcaagttgggtagctcctatgagtgggttgtcaccaaaaaggccggcaggtcatcagaatctgacttattggctgctgctgagagggaatcaaagacaacaaaccagctgcaaatccagagaggagcttctgaaagtgagctcattgaactaaaccgattgaaggcggcccctgttcctgttaagagggtgaataagatatacaggaaagaactcactctggcgttcctcctactcacagcttcagttaggagcctgttatcggcacaaggagtacatttctacttcctcctcttccaaggggtgacttttctcctagtcggtctggatttaataggagagcagatgagctagtgctgcatgccatccggttcaataaccaaagtttcattttcaatatgcccaatagaaggtttttattcatcaataactttacttcctgtagtctcagtttgttatttttatttttcacattggatggtggtccttgtgttatcccttaagcgttaaagcattgtttgtctataggtaggatttgtatttcaccctgattcttgcttgagtgtttctggtttggcactaaagattcaagccatattgtatttgtaaagttggaaagcttggggagggcataagaatgagcttgcatgatgctgctttttggttccatatttacgttgaggatatgtaaaacatcaaatcttgtacattgtgttatgtccaatacatgacaaataaattcctttgaaaaaaaaaaaaagagagctcggaagtacttgtaaagcggacgcggacccatgaattttccacccgagtgggggaccaggagatgggcccagttggacctatgaggaggagagtagagtggggctgggccggggtttacaaatgaagagactgggaaaacgctgagggagcccggctgggggggctgggggggagagcaggtatagaaaactagaagaaatataggaaagatactagacgaatgcactatcacaactaagaaataactcacaaccaatccggggtttgtttgactgtattataaggtgtggacaagctgaagctgaaaaat

SEQ ID NO: 1797 - DNA, 3007 bp, Gossypium hirsutum
ggtgagagcttgttttgaattgattgttagacttagaaaacccacatggtgaggtggtgtttgggttcttaccactctgcactgcagacacctttcccacataaaataaatttgttttcccatgttgcctctgtcttctagcatctaccttttcactctcactctcaccctttcctttcccttctcactactaacttgctccacacttctttttcttctgttctacattttgtctacaatggataccctcaaccttccttctttcaccatttgagtctgggttccttttggtcttcttcattacctgacctttgagatctgggttttcaacatttgttgtttgctggttgtagtgtgagtaaggcccactgaactgaaaatggctccaagcttagatttctcgaattggtggccaaaggatgctaggaaagggacacccgtggtagtaaagatggagaaccctaactactcagtggtggaaatcgacggcccagatgctgcattcaggcctgtggaaaaaagcagaggcaaaaatgcaaagcaagtgacttgggttttgcttctcaaggctcatcgtgccgtcggttgtctcgcttggattgcttcactcttctgggcattgcttggaaccataaagaaaaggctgatctttaggcaagatgttgcaatggccagtgaaaaactggggaaaggaaagctgctcttcacagtcattaaagccttcctagtgacttccctcacaattctggccttcgaagttgtggcttatctcaatggatggcattattttcgaaatccaagtttgcacattccgaggagcactgatatccagggcttgcttcacttggtttatgtcacttggttgtcagtccgggccgattacattgcaccacccattcaagctttgtctaaattttgtgtagctttattccttatccaatctgtagatcgtatgatacttagtttaggctgcttttggattaaatacaagaagattaaacccagaattgagggggatcctttcaagtcagatgatgttgagggatcagcctatgagtatcccatggttcttgttcaaatcccaatgtgtaacgagagagaggtttatgagcagtctatctctgctgtctgccaacttgattggccaaaggatcgattattggttcaggttcttgatgattctgatgacgaaagcatccagtatttgattaaagccgaggttgctaagtggaaccaaaagggtgttaacataatttatcggcaccgcttggtaagaactggttacaaggctgggaatctcaagtctgcaatgagctgcgagtatgtacaggcctatgagtttgtagcgatatttgatgctgattttcaacctaaccctgattttctaaagcaaactgtgccacatttcaaggacaatcctgatttagggttagttcaggctagatggacatttgtcaacaaggatgagaatttgttaactcgtctccagaacattaacttatgtttccactttgaagttgagcagcaagttaatggtgtatttttaaatttctttggttttaatggaactgctggagtctggagaattaaagctcttgaggaatctggaggttggcttgaaaggacaactgtagaggacatggacatagctgttcgtgcacatctcaatggttggaaattcatcttcctcaatgacgtaaaggtcctttgtgaagtccccgagtcatatgaagcatacaggaagcagcaacaccgctggcattcaggacctatgcacctcttccgcttatgccttccagcaatcataacttgcaagatagctatatggaaaaaggcaaatttaatactgctattctttctgttgaggaagcttatccttcctttctattcattcacattgttttgcataattcttcctctaaccatgttcgtaccagaggccgagcttcctgtttgggttatttgttatgtacctgtttttatgtcattcctcaacattcttccatcccccaaatcgttccctttcattgtcccttatcttctatttgaaaacaccatgtctgtgaccaaattcaatgcaatggtatctggattattccagttgggtagctcctatgagtgggttgtgaccaaaaaggctggcaggtcatcagaatctgacttactggcttctgctgagatggaatcgaagataatgaaccaactgcaaattcagagaggagcttcggaaagtgaactcactgaattaaaccgattgaaggaacagaaagaggcagctcctgtacctgttaagagggtcaataagatatacaggaaagagctcactctggcattcctcctgcttacagcttcggttaggagcctgttatcggcacagggagtacatttctacttcctcctcttccagggggtgacttttctcctagtcggtctagatttaataggagagcagatgagctaatgctgcatggaagcttgaaagaaagcaaaatgtgctaagactctctccatttccactgacaaaacctggtttctggctgtgcagtcgaagtttttctcctcaggaaattgtttaacggtaccatcctggtgctcaataaccaaagtttcattctctacgtcagcattgaatgccgaattgaaggtttttattcgtcagtaactctactttctgtcttcacagtttctatctactttctaatatctttatatatatatttcacattggatagtgctcattgttttcttaggggttgaaccatttattattattgttgttacagacttataggtagattttgtacttcagttttcatgtttcaccctgattcttgattgtgtggtttggcaataaagattcaagccatattgtatttgtaaaagcttggaaagctggcttgatgtcctttgtggctctcagagtccaaatttactatgagataatgtaaaaaacatccaatatttgtacattgtgttctatctaatatataacaaataattccttttc

SEQ ID NO: 1798 - DNA, 3349 bp, Gossypium raimondii
ttttaagtataataatttaaaacaaattaaattctggcagcatctgaaaccttgtgcttccagatttggttttgattatttaagtatttaatttattctggcaactaatttgtggagtgttttgtttactcattagtcaaaactggagtgtggtctctttgaaaagtgaactccgttttacgtaaagtatttttaattagcgtttcttttgctaaacatgcttagcagattctttgcctgctctgctgcataaactaaaaaacatttagagagtaaaaattctgggtatgggaaattaagacttaaaaacatggaccggctgaggttgtttggattattacaccgaaaaataaaaaccccacatggtatggtgtttgtttgggttcttacttcttacacattacagctgcagatacctttcctcataatgttgtgttcccatcgttgcttgtcttctgtcttttagactgtcctttcctacttgcacacaatctcctacacaactcctttttcttcgcttcttcttcctttgctacaatgaagaccttttgattttgggtaattgttcattacttgatctttgagatctggggttttgaaccgttgttgtcgggatttggtttcatttgggctacttgttgagaaaaaaaatggctccgggattagatttttcagattggggggcaatggagacgaggaaagggacaccggtggtagtgaaaatggacaacccaaactactcggtggtagaaatcgaggacccagatgctgcattcaggcctgtggaaaagagcagagggaaaaatgcaaagcaagtgacatgggttttgcttctcaaggctcatcgtgctgtcggttgtgtcgcttggatagctacactgttctgggcattgcttggaaccataaagaaaaggttgatcttcaggcaagatgttggcatggcaagtgaaaagttagggaaagggaaactgctcttcactgtcattaaagcctttctggtgatttccttgacaatcctggcttttgagattattgcttatttcaatggttggcattatttccagaaccccagtttgcacattcccagaaccagtgatatccagggactgttccacttggtttacgtcacttggttgtggtttcgggccgattacattgcaccattaatccaagccttgtctaaattctgtgtagctctattccttatccaatctgcagaccgtatggtactttgcttaggctgcttttggattaaatacaagaagattaagccgagaattgagggaaatccattcaagtcaaatgatgtcgagggatctggttacgactaccccatggttcttgttcaaatcccaatgtgtaacgagagggaggtatatgagcagtctatctctgctgtctgccaacttgattggccaaaggaccgattattgattcaggttctggatgattccgatgatgaaagcatccagtgtttaattaaagcagaggttgctacatggaaccaaaggggtatcaacataatttatagacatcggttaataagaactggttacaaggctgggaatcttaagtctgcaatgagctgcgagtatatacaggcctatgagtttgtagcaatattcgatgctgatttccaacctaaccctgattttctaaagcaaacagttccacatttcaaggacaatcccgagttagggttagttcaggctagatggacttttgtgaacaaggatgagaatttgttgactcgtctccagaacattaatttatgtttccactttgaagttgaacagcaagtaaatggtgtatttttaaatttctttggctttaatggaactgctggtgtttggagaattagagctcttgaggaatccggaggctggcttgaaagaactactgtggaggacatggacatagctgttcgtgcgcatcttaatggttggaagttcatcttcctaaatgatgtgaaggtcctttgtgaagtccccgagtcttatgaagcatacaggaagcaacaacatagatggcattcgggaccgatgcacctattccgcttatgccttccagcaatcataacttccaagatagcaatatggaagaaagcaaatctaatacttctgttctttttattgaggaagcttatccttcccttctactccttcacattgttttgcataattcttcctctcaccatgtttgtaccagaggctgagctccctgtttgggtcatttgttatgtacctgtttttatgtctttcctcaacattcttccagcccccaaatcattccctttcattgtcccttaccttctattcgagaacaccatgtctgtgaccaaattcaatgcaatggtatctgggttattcaagttgggtagctcctatgagtgggttgtcaccaaaaaggccggcaggtcatcagaatctgacttattggctgctgctgagagggaatcaaagacaacaaaccagctgcaaatccagagaggagcttctgaaagtgagctcattgaactaaaccgattgaaggcggcccctgttcctgttaagagggtgaataagatatacaggaaagaactcactctggcgttcctcctactcacagcttcagttaggagcctgttatcggcacaaggagtacatttctacttcctcctcttccaaggggtgacttttctcctagtcggtctggatttaataggagagcagatgagctagtgctgcatgccatccggttcaataaccaaagtttcattttcaatatgcccaatagaaggtttttattcatcaataactttacttcctgtagtctcagtttgttatttttatttttcacattggatggtggtccttatgttatcccttaggcgttaaagcattgtttgtctataggtaggatttgtatttcaccctgattcttgcttgagtgtttctggtttggcactaaagattcaagccatattgtatttgtaaagttggaaagcttggggagggcataagaatgagcttgcatgatgctgctctttggttccatatttacgttgaggatatgtaaaacatcaaatcttgtacattgtgttatgtccaatacatgacaattaaattcctttctttttttcttctcctggtatgatgggtgggactctatcaaaatcaatatttttatcgctgaacagtaaataaatagtaatagaaggagttgagtcaatctcacgtagacgaaatatttaaaattgcaattaggttcaattagattgcgcgtcgaggtagttgtcgtgtcctagacgtgtgatggtcggtacaaaaataaaaaaggtaatttgaatatgataaaaataaaaagagta

SEQ ID NO: 1799 - DNA, 3102 bp, Gossypium hirsutum
atgtttattttctatgcttttagagcttaaacaatttcggcagcatctgaaaccttgtgcttccagatttggttttgattatttaaatatttaatttattctggcaactaatttgtggagtgttttgtttactctttagtcaaaactggagtgtggaagtgaactccgttttacgtaaagtatttttaattagcgtttcttttgctaaacatgcttagcagattcgttccctgctctgctgcataaactaaaaaacatttagagagtaaaaattctgtgtatggggaattaaaacttaaaaacatggaccggctgagcttgtttggattattacaccgaaaaataaaaaccccacatggtatggtgtttgtttgggttcttacttcttacacattacagctgcagatacctttcctcataatgttgtgttcccatcgttgcttgtcttctgtcttttagactgtcctttcctacttgcacacaatctcctacacaactcctttttcttcgcttcttcttcctttgctacaatgaagaccttttgattttgggtaattgttcattacttgatctttgagatctggggttttgaacgttgttgtcgggatttggtttcatttgggctacttgttgagaaaaaaaatggctccgggattagatttttcagattggggggcaatggagacgaggaaagggacaccggtggtagtgaaaatggacaacccaaactactcggtggtagaaatcgaggacccagatgctgcattcaggcctgtggaaaagagcagagggaaaaatgcaaagcaagtgacatgggttttgcttctcaaggctcatcgtgctgtcggttgtgtcgcttggatggctacactgttctgggcattgcttggaaccataaagaaaaggttgatcttcaggcaagatgttggcatggcaagtgaaaagttagggaaagggaaactgctcttcactgtcattaaagcctttctggtgatttccttgacaatcctggcttttgagattattgcttatttcaatggttggcattatttccagaaccccagtttgcacattcccagaaccagtgaaatccagggactgttccacttggtttacgtcacttggttgtggtttcgggccgattacattgcaccattaatccaagccttgtctaaattctgtgtagctctattccttatccaatctgcagaccgtatggtactttgcttaggctgcttttggattaaatacaagaagattaagccgagaattgaggggaatccattcaagtcaaatgatgtcgagggatctggttacgactaccccatggttcttgttcaaatcccaatgtgtaacgagagggaggtatatgagcagtctatctctgctgtctgccaacttgattggccaaaggaccgattattgattcaggttctggatgattccgatgatgaaagcatccagtgtttaattaaaacagaggttgctacatggaaccaaaggggtatcaacataatttatagacatcggttaataagaactggttacaaggctgggaatcttaagtccgcaatgagctgcgagtatatacaggcctatgagtttgtagcaatatttgatgctgatttccaacctaaccctgattttctaaagcaaacagttccacatttcaaggacaatcccgagttagggttagttcaggctagatggacttttgtgaacaaggatgagaatttgttgactcgtctccagaacattaatttatgtttccactttgaagttgaacagcaagtaaatggtgtatttttaaatttctttggctttaatggaactgctggtgtttggagaattagagctcttgaggaatccggaggctggcttgaaaggactactgtggaggacatggacatagctgttcgtgcgcatcttaatggttggaagttcatcttcctaaatgatgtgaaggtcctttgtgaagtccccgagtcttatgaagcatacaggaagcaacaacatagatggcattcgggaccgatgcacctattccgcttatgccttccagcaatcataacttccaagatagcaatatggaagaaagcaaatctaatacttctgttctttttattgaggaagcttatccttcccttctactccttcacattgttttgcataattcttcctctcaccatgtttgtaccagaggctgagctccctgtttgggtcatttgttatgtacctgtttttatgtctttcctcaacattcttccagcccccaaatcattccctttcattgtcccttaccttctattcgagaacaccatgtctgtgaccaaattcaatgcaatggtatctgggttattcaagttgggtagctcctatgagtgggttgtcaccaaaaaggccggcaggtcatcagaatctgacttattggctgctgctgagagggaatcaaagacaacaaaccagctgcaaatccagagaggagcttctgaaagtgagctcattgaactaaaccgattgaaggcggcccctgttcctgttaagagggtgaataagatatacaggaaagaactcactctggcgttcctcctactcacagcttcagttaggagcctgttatcggcacaaggagtacatttctacttcctcctcttccaaggggtgacttttctcctagtcggtctggatttaataggagagcagatgagctagtgctgcatgccatccggttcaataaccaaagtttcattttcaatatgcccaatagaaggtttttattcatcaataactttacttcctgtagtctcagtttgttatttttatttttcacattggatggtggtccttatgttatcccttaggcgttaaagcattgtttgtctataggtaggatttgtatttcaccctgattcttgcttgagtgtttctggtttggcactaaagattcaagccatattgtatttgtaaagttggaaagcttggggagggcataagaatgagcttgcatgatgctgctttttggttccatatttacgttgaggatatgtaaaacatcaaatcttgtacattgtgttatgtccaatacatgacaaataaattcct

SEQ ID NO: 1800 - DNA, 1144 bp, Solanum phureja
gctaatagctatcagaagtattttggggggcttttatcacttcccaaattttcaactatagtacctgctgctaccatggcaactcatagcaatttgaagaatgccttgattgcgtttcttgctccactcccctccttacttttctacctatctttccttcgccattaccatgaagataatccactctacaattggtgttaccaccaccctcttctgtttgctaatgtcttgtttttcttcaatgtcaatatcctcttctatgccattggttatctccaatctagtcactggatgatagatttgtactggactgtgattccagtaatgctagtgcatttctatgcaaatcatccattggcacagtataatgtgtggaggtctaaggtggttatacttttaacttggatttggagtataagactaactcataactacttccgtcgcgagaactggcaatggggacacaggcaagattggagatttacagatatgagccaccagtttggcaagaactggtggtggatctctttctttgttgtttatttctctcagcagattttcctgatcggtatatgcctgcctatgtatgttgtccactctgaagacaagccatggaataactgggatttcattgctgtattcatctgcttgtctgccattataattgcttattatgcagatacagagctctacaattttgtgagcggaaatcagaaactaaaagagcttggcaagccaatggttcccaatcttgatgaaggcctctggaagtattcacgacatccaaactattttggagagcagttatggtggtggggactcttcctatttgcctggaacttgggtcagacttggacttttgttggtgcactcgctaatagcttgtgtcttgcacatgtcactgtgcttgttgagaataggatgcttaagcaagcctacagagctgaagcatacaagctctaccagaggacaacatctgtgtggataccatggttcaagtcatccgcaaaagggaaagataaggaaacttgagtctattttcaatctctttggtgtcttcctttgttaaatgtccacgataagatttagaactattgaataagtaatctactaatgtgcgttttaattatgtgtcttgtacaat

SEQ ID NO: 1801 - DNA, 1070 bp, Solanum melongena
atcagttcccaaattttcaagtatactatcagctactgaccatggctactcatagcaatttgaagaatgcctttattgcatttcttgctccacttccctccatactcttctacctatctttccttaaccattaccatgaacatcatccaatctacaattggtgttaccaacaccctcttctatttgccaatctcttatttttcctcaatgtcaatctcctcttctgggtcattggtcttctccaatctagtcactggatgatagatttgtactggactgtgattccagtaatgctagtgcatttctatgcaaatcatccattggcaaagtataatatgtggaggtccaaggtggttatagttttaacttggatttggagtataagacttactcataactacttccggcgagagaactggcaatggggacacaggcaagattggagatttacagatatgagccaacagtacagtaagtactggtggtggctctctttctttgttgtctatgtctctcagcaggtttttctgataggcatatgcctgcctatgtatgttgttcactctgaagacaagccttggaatatctgggatttcactgccatattcatctgcttgtctgccattataattgcttattatgcagatacacagctctacaattttgtgagcagaaatcagaaactaaaagagcttggcgagccagtggttcccaatcttgacgaaggcctctggaggtattcacggcatccaaactattttggagagcagttatggtggtggggactcgtcctatttgcctggaacttgggtcaggcttggacttttattggtgcactcgttaatagcatgtgtcttgcacatgtcactgtgcttgttgagaataggatgcttaagcaagcctacagagctgaagcatacaaactctaccagaagacaacatctgtgtggataccatggttcaagtcatccgcaataggaaaagataaggaaacttgagtttgttttcaatctattacgtattttccttaattagatgtgtacacgattagaactattgaataagtaatc

SEQ ID NO: 1802 - DNA, 534 bp, Solanum phureja
tcaataatggattttatcatccttctcatcgtcatccttgctctttcttgcaaaccaattatcataatatccggatctgtgacaaacgatagatattcaactacaaactcttccaccaatgttgctctttctgcacgaaaagttgtatttcctcctcccagacagctaggaaaatacacgaggacagataattctaatgacgatgacttgatctgcaaaacttgcaagagattatcagaacatcgtacatgttgtttcaactacttttgtgttgatttgttcaccaacaggttcaactgtggctcctgtggcctcgtctgtatcgttggaacaagatgttgcggtgggatctgtgtggacatcaagaaagacaacggaaattgtggcaagtgttataatgtatgctctcctggtcagaactgttcatttggcctttgtgtctatgcctaattaactgtatttctctatctctagcaataaccaattcccccgtcccccgggtgaaatgttacatcttgttcaagttttctagtt

SEQ ID NO: 1803 - DNA, 573 bp, Solanum tuberosum
atcttatcatccttctcatcgtcatccttgctctttcttgcaaatcaattaccataatatccggatctgtgacaaaccatagatattcaactacaaactctatacaccaacgttgctctttctgcacgaaaagttgtattatttcctcctcccagacagctaggaaaatacacgaggacagataattctaatgacgatgacttgatctgtaaaacttgcaagagactatcagaacatcgtacatgttgtttcaactacttttgtgttgatttgttcaccaacaggttcaactgtggctcctgtggcctcgatctgtatcgttggaacaagatgctgcggtgggatctgtgtggacataaagaaagacaacggaaattgtggcaagtgttttaatgtatgctctcctggtcagaactgttcatttggcctttgtgtctatgcctaattaactgtatttctctatctctagcaataaccaattccccggtcccccgggtgaaatgttacatcttgttcaagttttctagttagataactaattttcaagttttctaggttgaaaaacaacaacac

SEQ ID NO: 1804 - DNA, 1349 bp, Solanum phureja
atactttactatactcatcaccaaactttgacataaacaaaatattttataacgaaaggtgatcgatacattcgaataatggaagatctaccaggcttccgatttcacccaacggaagaagaacttctcgaattttacctaaaaaataaagtccttggcaaaaaatcgcgatgcgatgtaattggtctactcaacatttatcgtcatgatccttgggacctgccagagctggcaacaattggagaaagagaatggtatttttttgtgccaagagatagaaaacatggaagtggagggaggcctaataggactacacaaaagggattttggaaggcaactggttctgataaaaaaattattggtttatcaaatcctaaaaatataattggtcttaagaaaactttggttttctatactggaagagcacctcgaggctctaagacagattgggtcatgaatgaatttcgactaccggataccgtctcttcgcctcaggacatagtgttgtgcaaaatatacagaaaagcgacatctttgaaggtgttagaacagagggctgcaattgaagaagaaatgaacggtacaaagcacgttcacagctctccttgttcgacaaccctgcagccaatggacgccatgtcatttagtaacgaacatcatgaaccaactgatcagagccccaatttctttatgtcaatcaacaaggatgaagtagaagacgatatcttatcaattactgagaacaacccgttcgaagtttcagcagaaaccaaagagaagagtaattgctttaggccaaaattactgaatggacaagataacctggctgaactacaagtacccaaattcagcatggactttagtcaggaccctgtctggatgcaattgcgtagcccttggcttgataattttatcttgacaccttccgcgtttgtgcataacttttaggctataaattcgaatcgttaaaccatccatcccaatttccttggatttttttttcaagaataatagtagtgatatgttcacagctacaacctaacctgctgaccacttggggtgtttgttcatagtatccttaatggatccataagtaatatatagcaactgccttagtgttttccttttagtggtttgatgtcttggctgataaattatgtgcattgactaatgttggacattagtctggatttgtaacagaaacatggagcattaatgtaaattttcaaatggtaaactcttatttaattggcataaattagtaattttgcccaagtgttattgcaaagaaatgggaagaagaaaaagtgtacctattttaatagaggcggagccataatttcaatttt

SEQ ID NO: 1805 - DNA, 2023 bp, Capsicum annuum
aaaaatatttcaacacacaaaaaaaaaaatttgacataaaaaaaaagttaccattccgccgcccaccgttgcatggcaaataaggttttcggtccgaaactattcaagaacctcggattccatgtccgccgtttaaactcggctccgtcaccattttccgccgttcctccgttaaatttcactggcgattttaacgccgttccaaatttggtggaacccacaccacagattaacaacacaaccacccaccacccccatattaacaacaacattattaatttcaacgatgttaaggagctgttctacggcgttcctacaacaaagttgattagatcatcgttaacgttacaaatggcggccattgagccaatggttgatttgggtatgtgggtaatgaattctaaacttatggaaatgcctgttttcagggatgttatgcttggttttgttaagaatacgttttatgaacacttttgtgctggtaaagacttaacggaagtccgacggaccgttatgaatctctctgattctgggttaaaagctatgcttgattacggggtcgaacatgccacggaaaatgaatcttgtgaacagagcacaacagcgtttattcaaacgattgaatcaacgaaatcacttcctcagtcttctgcaagctttgtggttgcgaagataacagcaatttgtacaccaaggctactcaaaagaatgagtgatttgctacgatgggaacaaaaagatccttcattgaatctcccatggaagcgaagaacgcttccacttttcgctgaatcgagccctgtttatcacacttcggaaaaaccagagcctctaacggtagaggaagagcgcgatctcgaattagctcatgaaaggctaaagaaaatttgcgagaagtgtttggaacatgatgttcctttactaattgatgcagaagactcaacgattcaacccgcgatcgattactttgcgtattcagcagcgattaagtaccacaaagacgaccagcctttgatattcggaacaattcaagcttacttgaaggacgcgaaggagcgtatggttatggcgaaaaaggctgctgagaaaatgggagttccaatgggatttaagcttgtaaggggtgcttatatgtgtagtgaaaaggcgttggcttctagtttaggtttcaactctccgattcacgacagcattgagcaaactcatgcttgcttcaattcgtgcgcggagtttatgattgaagagattgctaatggctctggtgcagttgttcttgctactcataacattgagtcaggaaaacttgccgcaacgaaagctatcgatttgggaataaaaattgagaggcaaagtctccagtttgctcagctctatggtatggctgatggactttcattcgggctgcgaaatgcaggatttcaagtgagcaagtatttgccatttggtcctgttgagcagatcatgcactaccttatgaggcgtgccgaagaaaacagaggcatgttgtctacctcggctttcgacaggcaactcatgaggaaggaattgagcagaagacttgaagtggcaacttcttgaaatgcatattgggaatggaagtgtatgttagttagtagaacaataagcgctgaaacatcgccaattattgtaaataattcaatgatgcgcgggcaaacaatgatgatgatgatgttgatcaagcaactgtgatggggaaaatgcacaaggaacgagtcaatcaggatattgttgatttatctccttgtgtaaatgaaaaaataaaaaatgtacataagtatttttaggttcacttattgttatctttctccatgtgctatttttaggtcctattatgttgtagtagcaccttaaaagttggttgtatttggtatcgggtcagaaatagaaatggaagaaaggtacctagagtggtgccctaatgttgaaattacaaagtgtgtatctatttctctctctctcgagacattattgttcaataaaatctaatttagtcctcttcatt

SEQ ID NO: 1806 - DNA, 2108 bp, Capsicum annuum
ggcacgagagagagagagagagagagagagagagagagagagagagagagagagagagagagagagagagagagagagaaaaaaaaaaaatatttcaacacacaaaaaaaaaaatttgacataaaaaaaaagttaccattccgccgcccaccgttgcatggcaaataaggttttcggtccgaaactattcaagaacctcggattccatgtccgccgtttaaactcggctccgtcaccattttccgccgttcctccgttaaatttcactggcgattttaacgccgttccaaatttggtggaacccacaccacagattaacaacacaaccacccaccacccccatattaacaacaacattattaatttcaacgatgttaaggagctgttctacggcgttcctacaacaaagttgattagatcatcgttaacgttacaaatggcggccattgagccaatggttgatttgggtatgtgggtaatgaattctaaacttatggaaatgcctgttttcagggatgttatgcttggttttgttaagaatacgttttatgaacacttttgtgctggtaaagacttaacggaagtccgacggaccgttatgaatctctctgattctgggttaaaagctatgcttgattacggggtcgaacatgccacggaaaatgaatcttgtgaacagagcacaacagcgtttattcaaacgattgaatcaacgaaatcacttcctcaatcttctgcaagctttgtggttgcgaagataacagcaatttgtacaccaaggctactcaaaagaatgagtgatttgctacgatgggaacaaaaagatccttcattgaatctcccatggaagcgaagaacgcttccacttttcgctgaatcgagccctgtttatcacacttcggaaaaaccagagcctctaacggtagaggaagagcgcgatctcgaattagctcatgaaaggctaaagaaaatttgcgagaagtgtttggaacatgatgttcctttactaattgatgcagaagactcaacgattcaacccgcgatcgattactttgcgtattcagcagcgattaagtaccacaaagacgaccagcctttgatattcggaacaattcaagcttacttgaaggacgcgaaggagcgtatggttatggcgaaaaaggctgctgagaaaatgggagttccaatgggatttaagcttgtaaggggtgcttatatgtgtagtgaaaaggcgttggcttctagtttaggtttcaactctccgattcacgacagcattgagcaaactcatgcttgcttcaattcgtgcgcggagtttatgattgaagagattgctaatggctctggtgcagttgttcttgctactcataacattgagtcaggaaaacttgccgcaacgaaagctatcgatttgggaataaaaattgagaggcaaagtctccagtttgctcagctctatggtatggctgatggactttcattcgggctgcgaaatgcaggatttcaagtgagcaagtatttgccatttggtcctgttgagcagatcatgcactaccttatgaggcgtgccgaagaaaacagaggcatgttgtctacctcggctttcgacaggcaactcatgaggaaggaattgagcagaagacttgaagtggcaacttcttgaaatgcatattgggaatggaagtgtatgttagttagtagaacaataagcgctgaaacatcgccaattattgtaaataattcaatgatgcgcgggcaaacaatgatgatgatgatgttgatcaagcaactgtgatggggaaaatgcacaaggaacgagtcaatcaggatattgttgatttatctccttgtgtaaatgaaaaaataaaaaatgtacataagtatttttaggttcacttattgttatctttctccatgtgctatttttaggtcctattatgttgtagtagcaccttaaaagttggttgtatttggtatcgggtcagaaatagaaatggaagaaaggtacctagagtggtgccctaatgttgaaattacaaagtgtgtatctatttctctctctctcgagacattattgttcaataaaatctaatttagtcctcttcatt

SEQ ID NO: 1807 - DNA, 1996 bp, Nicotiana tabacum
cacattcattaaacagagaaagaaataaacacacacaaaatacaaattccgccgtccaccgttgcatggccaacaaggttgtttgtccgaaactactcaagaacctcggatttcatgtccgccgtttaaactcagctccgtctcccctttccgccgtcccgcctttaagtttcaccggcgattttaacgccaccaccgtcacgacaccaaatctggtggataccgtaccacagattaatacagtccctgacaagaataacattatcaattttgacgatgttaaggagctgttctacggcgttcctacctcaaagttgataagatcaacgctgacgctacagatggcagcgattgatccaatggttgatatggggatgtgggtaatgaattctaagctcatggaaatgcctatttttagggaggtaatgctgggatttgttaagaatacattttatgaacatttttgtgctggaaaagacttaacggaagtccgtaggaccgttagcaaactatcggacggcggcttaaaagccatgcttgattatggggtggaacatgccaccaataatgagtcttgtgaacagagtatgaaagcctttattcagacaattgaatcaaccaaatcactaccacaatcttcgactagctttgtggtggtgaagataactgcaatttgtacacctcggctgctcaaaagaatgagtgatttgctgagatgggaacacaaagatccttcattcaatcttccatggaagcaaaagacacttccacttttcgccgaatcaagccctctttatcacacttcgaaaaaaccagagcctctaacggtagaggaagagcgtgatctacaattagctcatgaaagactaacgaaaatttgcgagaaatgtttggaacacgatgttcctttactcattgatgccgaggatacaactattcaacctggaattgattacatggcttattctgcagcaattaagtaccacaaagacgacggcccgttgattttcggaacaattcaagcttacttgaaagatgcgaaagaaagaatggcgatagcgaaaaaagctgcagagaaaatgggagttccaatgggatttaagttggtgagaggtgcttatatgtgtagtgaaagagagttggcttctcgattaggattccaatctcctattcatgatagcattgaacaaacacatgcttgcttcaattcttgtgctgagtttatgatcgaagagattgctaatggctctggagcagttgttcttgctactcataacattgagtcaggaaagcttgctgcaactaaagcaatagatatgggaatcaaggatagtcaaaagctccaatttgctcagctatatggtatggcagagggacttacttttgggctgagaaatgcaggatttcaagtgagcaagtatttgccatttggacctgttgaccagattatgcactaccttatgaggagagctgaagaaaacagaggcatgttatctacatcggcattcgacaggcaactcatgaggaaggagttgagcaggagacttaaagtcgcaacttcttgacttctgattgacaatggaagactatattagtagtaagaataagcgaggaaccatcacccaactactgtaaataattcaatggcgtggcagaaatgatcttgatcaggcaaaccaagtggttaaaatgcacaaggagcatactcggggaatatcttcttgtgttattttatgaaaataagctatgtgcgtagcctcttaagtaatcttagagttggtatcctcactgatcagaaaatggtcctcttgtagtatctttctccatctgttgtagcacctttgttatatttggtttcctattagatatggaagaaaggtacccaaagtggagacgaaatgttgaataattaaaagtgtttatttctttctccctcatgattatatggcatgttatttttagatttattggccatgattaaaataaaaaattcctt

SEQ ID NO: 1808 - DNA, 2113 bp, Solanum phureja
aatccatatgtcttatctccaaacgccataactctgaattcttccaagctttttagggttttcatagaaagaatatgaagtatcagaatttggacctattcgacccgagaacggcggtcatggacccggaatactcccctacccataccggggaacccgatttcgccttcgccttcgacgacgtcaacttctctgatcgtattctacggatcgagatccttggagactcaatcgccggtggttctaattccagcggcggctgcagtagcttagccgattgggctcgtaatcgcaagcgccgacgtgaggatttcaggaaggaaaacgctttggatatcacagcatgccctgaagatcaggtaatttgctgtaatcaaattgatagtgaagatgctgataacgaaaatcaagatgaagcagttgttgcaatgattgaagagccaaactcaggagatgaaggtgctaatagtgatgattcaacttggaattgtgattctccaagggttatgagagttaaaacactaaacattagctcccccattttagcagcaaagagtccattcttctacaagctcttctcaaatgggatgagagagtctgagcaaagacaagtaactctacggatcaatgcttcagaggaagctgcattgatggagctcctgaaatttatgtatagaaatatgttaactacaaatacagcgcctggattgctggacgtgctcatggctgctgacaagtttgaggttgcatcttgcatgaagtattgcagcaggctactgtgtaatttgcctatgactccggagtcagctttgctgtatctggagcttccttctagtgtcctgatggctgatgcagttcggccattgactgatgcagcaaaacaattcctagctgcaagatacaaagatataaccaagttccaagaagaggtcatgaagttgcctcttgctggtattgaggcaattttgtccagtgatgaccttcaggtagcatcagaagatgcagtatatgactttgtcttgaagtggacaagggctcattatcctttgatagaggaacgccgagaaattcttagttcaagacttggtcgttgcatccgctttcctttcatgagctgccgaaagcttcggaaggttcttgcatgtaatgactttgaacatgagtttgcatccaaactagtgcttgaggccctcttttttaaagctgaggccccacaccgccaacgaactcaagctgcagaagaatcagcttcgaccagtcgtcgttttgtagagcgtgcatacaagtatcgacctgttaaggttgttgagtttgaacttccacgccaacaatgtatagtctacttagatcttaagcgggacgaatgtgctaatctttttccatctgggagagtatattctcaagcttttcatttgggtggacaagggtttttcctgtccgcacattgcaacatggatcagcaaagctctttccattgttttggtctctttttgggaatgcaggaaaagggttcagtttcatttacagtcgactatgaatttgctgcgaggacaacactagcagaggagtatgtgagcaaatacaagggaaactatacatttactgggggtaaggcagttggctatcgcaatttattcgccataccctggacttctttcatggctgaggacagtctctattttattaaaggcgtactccatctcagggctgaacttactatcaggcactgatttttctcttctcctacaatgtcaattacttaagttgttttgcttattattattagctgagccgccaaagtcccgtatcttttttcttggctttgatcaagcaaaagaagtgtaaggtttaggtatcagtactaactgccataggtattgaaacattttataatgttatccttttgaccatagtagttttatccttgtgctctccaaagcatgagaaaggatgtaaatggaattcagtaagtgagaaatgtttgattgttctgagttctgaccctgttttaatgcaatacaagcacaattgtgaacactgtgaatagattatttgattttaactttcttatgccctgttatagacaagtatatataatttatatctgactgtg

SEQ ID NO: 1809 - DNA, 2085 bp, Capsicum annuum
aaccccgctccccgtcttcctcctttcacatttttctctacccttgtgtgtctcggagacaattacaaagcaaaacccacagtgatgaaggatcagaatttggatcttttcgatccgagaaccgcagtaatggacccggaatactctccgacccgaacccgtgacccggatttcgggttcgccttcaacgatagtaacttctccgatcgtctcttgcagatcgagattatggctgacccacactccgattcagatagctttcactcacagagtttagctgattgggcccgtaatcgtaaacgacgtagagaagatatcaagaaggacatggcactggatatcactgcttgtcctgaagagcaggttataagttgtaaccaaattgatactgaagatgttgagaacgaaaatcaagatgaatcagttgttgcaatgatcgaagaaccacactcaggagatgaagctaataatgctgatgattcatcttggaacttcgattctccaagagttgttaaagtaaaaaccttacacatcagctcccccattttagcagcaaagagccctttcttttacaagctattctccaatgggatgagggagtctgagcaaagacaagtaactcttagaattaatgcttcagaggaagccgcactgatggagctcctgaattttatgtatagcaatacattgaccactaatactgcacctgctttgctggatgtactcatggcggccgacaagtttgaagttgcttcttgcatgcggtattgtagcaggcaactgcgtaatttacctatgactccagagtccgctttgctgtatttggagcttccttctagcgtcctgatggctgaagcagttcagcctttgactgatgccgcagaacaattcctagctgcaagatacaaagatattaccaagtttcaggaagaggtcatgaagttgcctcttgctggagtagaggctattttgtccagtgatgatctccaggtagcatcagaggatgcagtgtacgactttgtgttgaagtggacaaggactcattatccacagttagaagaacggcgagaaatccttggttcacgacttggtcgttgcatccgttttcctttcatgagctgtagaaagcttcggaaggttctggcatgtaatgactttgatcatgaatttgcatccaagcttgtgcttgaggctctcttttataaagctgaggctcctcatcgtcagcgaacccaggctgcagaagaatcatcctccactagtcgtcgtttcgtggagcgtgcttacaagtatcgacctgtcaaggtggttgattttgaacatccacggcaacaatgtgtagtctacctggatcttaagcgggaggaatgtgctaacctatttccttcaggaagagtgtattctcaagcatttcatttaggaggacagggttttttcctgtctgcacattgcaacatggatcagcaaagctctttccactgttttggtctctttctggggatgcaggaaaagggttcggtgacttttgctgttgattatgaatttgcagcaagaacaaaaccaggggaggaatatgtcagcaagtacaaaggtaactacacttttacagggggcaaggcagttggctaccgcaatctatttgccataccatggacttctttcatcgctgaggacagtccatatttcaccaatggtacactccacctcagggctgaacttactatcaggagttgattcctttgtcaatggatacttttctttttgcttcttggttgagttcaacgcccaatggttctggtttgataaaagcatgtaaggcaaagtttagatgaaggtacccactgccataggctaggtattgaagtattttgtattaaatcactttggccatgctgagatgaaaaaggatgtaaatggaattgatgagtgaaagaatgttttcttttgaacgttggttacctctgaaatgttctaatgtaatgtaatactagtagcgtttgtatcatcaacatgctgacaaacttttgaacgttggttacctctgaaatgttctaatgtaatgtaatactagtagcgtttgtatca

SEQ ID NO: 1810 - DNA, 2095 bp, Capsicum annuum
aaccccgctccccgtcttcctcctttcacatttttctctacccttgtgtgtctcggagacaattacaaagcaaaacccacagtgatgaaggatcagaatttggatcttttcgatccgagaaccgcagtaatggacccggaatactctccgacccgaacccgtgacccggatttcgggttcgccttcaacgatagtaacttctccgatcgtctcttgcagatcgagattatggctgacccacactccgattcagatagctttcactcacagagtttagctgattgggcccgtaatcgtaaacgacgtagagaagatatcaagaaggacatggcactggatatcactgcttgtcctgaagagcaggttataagttgtaaccaaattgatactgaagatgttgagaacgaaaatcaagatgaatcagttgttgcaatgatcgaagaaccacactcaggagatgaagctaataatgctgatgattcatcttggaacttcgattctccaagagttgttaaagtaaaaaccttacacatcagctcccccattttagcagcaaagagccctttcttttacaagctattctccaatgggatgagggagtctgagcaaagacaagtaactcttagaattaatgcttcagaggaagccgcactgatggagctcctgaattttatgtatagcaatacattgaccactaatactgcacctgctttgctggatgtactcatggcggccgacaagtttgaagttgcttcttgcatgcggtattgtagcaggcaactgcgtaatttacctatgactccagagtccgctttgctgtatttggagcttccttctagcgtcctgatggctgaagcagttcagcctttgactgatgccgcagaacaattcctagctgcaagatacaaagatattaccaagtttcaggaagaggtcatgaagttgcctcttgctggagtagaggctattttgtccagtgatgatctccaggtagcatcagaggatgcagtgtacgactttgtgttgaagtggacaaggactcattatccacagttagaagaacggcgagaaatccttggttcacgacttggtcgttgcatccgttttcctttcatgagctgtagaaagcttcggaaggttctggcatgtaatgactttgatcatgaatttgcatccaagcttgtgcttgaggctctcttttataaagctgaggctcctcatcgtcagcgaacccaggctgcagaagaatcatcctccactagtcgtcgtttcgtggagcgtgcttacaagtatcgacctgtcaaggtggttgattttgaacatccacggcaacaatgtgtagtctacctggatcttaagcgggaggaatgtgctaacctatttccttcaggaagagtgtattctcaagcatttcatttaggaggacagggttttttcctgtctgcacattgcaacatggatcagcaaagctctttccactgttttggtctctttctggggatgcaggaaaagggttcggtgacttttgctgttgattatgaatttgcagcaagaacaaaaccaggggaggaatatgtcagcaagtacaaaggtaactacacttttacagggggcaaggcagttggctaccgcaatctatttgccataccatggacttctttcatcgctgaggacagtccatatttcaccaatggtacactccacctcagggctgaacttactatcaggagttgattcctttgtcaatggatacttttctttttgcttcttggttgagttcaacgcccaatggttctggtttgataaaagcatgtaaggcaaagtttagatgaaggtacccactgccataggctaggtattgaagtattttgtattaaatcactttggccatgctgagatgaaaaaggatgtaaatggaattgatgagtgaaagaatgttttcttttgaacgttggttacctctgaaatgttctaatgtaatgtaatactagtagcgtttgtatcatcaacatgctgacaaacttttgaacgttggttacctctgaaatgttctaatgtaatgtaatactagtagcgtttgtatcatccctcgtgc

SEQ ID NO: 1811 - DNA, 2119 bp, Solanum tuberosum
ggttttcctccgtcttccccaaacatttctccgcccacatctcagagacaaaataaagcaaaatcccccggatatttagagagaaagagaatctttatagttgagtttacagccatgaaggatcagaatttggatcttttcgacccgagaacggctgttatggacccggaatactcaccgagcagtacccgggacccggattttggctttgccttcaacgacgtcaacttctccgatcgtctacttcagatcgagattatggctgactcgttcgacccccagtctgattcagatagctttcactctcagagtctagctgattgggcgcgtaatcgcaaacgacgtagagaagatatcaggaaggaaatggctctggatatcactgcttgtcctgaagagcaggttataagttgtaatcaaattgatactgaagatgttgagaacgaaaatcaagatgaatcagttgttgcaatgatcgaagaaccacactcgggagatgaagctactaatgctgatgattcatcttggaactttgattctccaagagttgttaaagttgaaaccttacatatcagctcccccattttagcagcaaagagccctttcttttacaagctcttctccaatgggatgagggagtctgagcaaagacaagtaactctaagaattaatgcttcagaggaagctgcactgatggagctcctgaattttatgtatagcaataaattgaccactaatacagcacctgctttgctggacgtactcatggctgccgacaagtttgaagttgcttcttgcatgcggcattgtagccggcaactgcgtaatttacctatgacttcagagtccgctttgctgtatttggagcttccttctagcatcctgatggctgaagcagttaagcctttgaccgatgccgcagaacaattcctagctgcaagatacaaagatattaccaagtttcaggaagaggtcatgaagttgcctcttgctggagtagaggctattttgttcagtgatgaccttcagatagcatcagaggatgcagtgtacgactttgtgttgaagtggacaaggactcattatccacagatagaggaacggcgagaaatccttggttcacgacttggtcgttgcatccgttttccttttatgagctgtagaaagcttcggaaggttctggcatgtaatgactttgatcatgaatttgcatccaagcttgtgcttgaggctctcttttataaagctgaggctcctcatcgtcagcgaacccaagctgcagaagactcgtcctccactagtcatcgtttcgtggagcgtgcttacaagtatcgacctgtgaaggtggttgattttggacttccacggcaacaatgtgtagtctatctggatcttaagcgggaggaatgtgctaacctctttccttcaggaagagtgtattctcaagcatttcatttagggggacaaggttttttcctgtctgcacattgcaacatggatcagcaaagctctttccactgttttggtctctttctggggatgcaggagaaaggttcggtgactttcgctgttgattatgaatttgcagcaagaacaaaaccaggggaggagtatgtcagcaagtacaaaggtaactacacttttacagggggcaaggcagttggctaccgcaatctatttgccataccatggacttctttcatcgctgaggacagtccatattttacaaatggtatgctccatctcagggctgaacttactatcaagagttgattcctttgtcaatggatactgttgtttttgcttcttgggtactctgtttcttggtttaataaaagcatgtaagacaaggtttagatgaaggcactaactgccataggctaggtattgaaatatttagtatgaaatcacttttgccatgctctgcagagatggaaaaggatgtaaatggaattgatgagcgaaaaattacgttggttattctgaaatgctcaaatgtaatactagtacaggttgtcctgatattgtgtacatgtcatgcagcgttaaacattgtacaacaatgtgtagctgagtttgtgctatcaaactttcttctgataaaaaaaaaaaaaaaaaa

SEQ ID NO: 1812 - DNA, 2103 bp, Solanum phureja
gttttcctccgtcttccccaaacatttctccgcccacatctcagagacaatataaagcaaaatcccccggatatttagagagaaagagaatctttatagttgagtttacagccatgaaggatcagaatttggatcttttcgacccgagaacggcggtcatggacccggaatactcaccgagcagtacccgggacccggattttggctttgccttcaacgacgtcaacttctccgatcgtctacttcagatcgagattatggctgactcgttcgacccccagtctgattcagatagctttcactctcagagtctagctgattgggcgcgtaatcgcaaacgacgtagagaagatatcaggaaggaaatggctctggatatcactgcttgtcctgaagagcaggttataagttgtaatcaaattgatactgaagatgttgagaacgaaaatcaagatgaatcagttgttgcaatgatcgaagaaccacactcgggagatgaagctactaatgctgatgattcatcttggaactttgattctccaagagttgttaaagttgaaaccttacatatcagctcccccattttagcagcaaagagccctttcttttacaagctcttctccaatgggatgagggagtctgagcaaagacaagtaactctaagaattaatgcttcagaggaagctgcactgatggagctcctgaattttatgtatagcaataaattgaccactaatacagcacctgctttgctggacgtactcatggctgccgacaagtttgaagttgcttcttgcatgcggcattgtagccggcaactgcgtaatttacctatgacttcagagtccgctttgctgtatttggagcttccttctagcatcctgatggctgaagcagttaagcctttgaccgatgccgcagaacaattcctagctgcaagatacaaagatattaccaagtttcaggaagaggtcatgaagttgcctcttgctggagtagaggctattttgttcagtgatgaccttcagatagcatcagaggatgcagtgtacgactttgtgttgaagtggacaaggactcattatccacagatagaggaacggcgagaaatccttggttcacgacttggtcgttgcatccgttttccttttatgagctgtagaaagcttcggaaggttctggcatgtaatgactttgatcatgaatttgcatccaagcttgtgcttgaggctctcttttataaagctgaggctcctcatcgtcagcgaacccaagctgcagaagactcgtcctccactagtcatcgtttcgtggagcgtgcttacaagtatcgacctgtgaaggtggttgattttggacttccacggcaacaatgtgtagtctatctggatcttaagcgggaggaatgtgctaacctctttccttcaggaagagtgtattctcaagcatttcatttagggggacaaggttttttcctgtctgcacattgcaacatggatcagcaaagctctttccactgttttggtctctttctggggatgcaggagaaaggttcggtgactttcgctgttgattatgaatttgcagcaagaacaaaaccaggggaggagtatgtcagcaagtacaaaggtaactacacttttacagggggcaaggcagttggctaccgcaatctatttgccataccatggacttctttcatcgctgaggacagtccatattttacaaatggtatgctccatctcagggctgaacttactatcaagagttgattcctttgtcaatggatactgttgtttttgcttcttgggtactctgtttcttggtttaataaaagcatgtaagacaaggtttagatgaaggcactaactgccataggctaggtattgaaatatttagtatgaaatcacttttgccatatgctctgcagagatggaaaaggatgtaaatggaattgatgagcgaaaaattacgttggttattctgaaatgctcaaatgtaatactagtacaggttgtcctgatattgtgtacatgtcatgctgcgttaaacattgtacaacaatgtgtagctgagtttgtgctagcaaactttcttctgata

SEQ ID NO: 1813 - DNA, 2039 bp, Solanum lycopersicum
gttttcctccatcttccccaaacatttctccgcctacttctcagagacattataaagcaaaatccgccggatatttagagagaaagagaatctttatagttgagtttacagccatgaaggatcagaatttggatcttttcgacccgagaacggctgttatggaccctgaatactcaccgagtagtacccgggacccggattttggctttgccttcaacgatgtcaacttctccgatcgtctacttcagatcgagataatggctgactcgtttgaccctcaatctgattcagatagttttcactctcagagtctagctgattgggctcgtaatcgcaaacgacgtagagaagatatcaggaaggaaatggctctggatatcactgcttgtcctgaagagcaggttataagttgtaatcaaattgatactgaagatgttgagaatgaaaatcaagatgaatcagttgttgcaatgatcgaagaaccacactcgggagatgaagctactaatgctgatgattcatcttggaactttgattctccaagaattattaaagttgaaaccttacatatcagctcccccattttagcagcaaagagccctttcttttacaagctcttctccaatgggatgagggagtctgagcaaagacaagtaactctaagaattaatgcttcagaggaagctgcactgatggagctcctgaattttatgtacagcaataaattgaccactaatacagcacctgctttgctggatgtactcatggctgccgacaagtttgaagttgcttcctgcatgcggtattgtagccggcaactgcgtaatttacctatgactccagagtccgctttgctgtatttggagcttccttctagcatcctgatggctgaagcagttaagcctttgacagatgccgcagaacaattcctagctgcaagatacaaagatattaccaagtttcaggaagaggtcatgaagctgcctcttgctggagtagaggctattttgttcagtgatgaccttcagatcgcctcagaggatgcagtgtatgactttgtgttgaagtggacaaggactcattatccacagttagaggaacggcgagaaatccttagttcacgacttggtcgttgcatccgttttccttttatgagctgtagaaagcttcggaaggttctggcatgtaatgactttgatcacgaatttgcatccaagcttgtgcttgaggctctcttttataaagctgaggctcctcatcgtcagcgaagccaagctgcagaagactcgtcctccactagtcatcgtttcgtggaacgtgcttacaagtatcgacctgtgaaggtggttgattttggacttccacggcaacaatgtgtagtctatctggatcttaagcgggaggaatgtgctaacctctttccttcaggaagagtgtattctcaagcatttcatttaggagggcaaggttttttcctgtctgcacattgcaacatggatcagcaaagctctttccactgttttggtctctttctggggatgcaggaaaaaggttcggttacttttgctgttgattatgaatttgcagcaagaacaaaaccaggggaggagtatgtcagcaagtacaaaggtaactacacttttacagggggcaaggcagttggataccgcaatctatttgccataccatggacttctttcatcgctgaggacagtccatattttactaatggtatgctccatctcagggctgaacttactatcaagagttgatacctttgttaatggatgcagttgtttttacttcttgggtgagttcaacgctcttgtttcttggtttaataaaagcctgtaagacgaggtttagatgaaggcactaactgccataagctaggtattgaaatatttagtatgaaatcacttttgccatgctctgcagagatggaaaaggatgtaaatggaattgatgagcgaaagaacgctggttattctgaaatgctcaaatgtaatactagtacaggttgtcctgatattgtgtac

SEQ ID NO: 1814 - DNA, 1634 bp, Solanum phureja
ccaaagattatctctttcattccctatttggagtagaaaaatgtcctttgcagaagaaccgagtggataaacatagaaacttttccctctttttctcttcgacccaaatctcgatctacaattagttttcatttttctttgtgtttaatcaatcaaattaattttcgatgtgttaattgatgtctgattgttaaatttctggatcgagatcgaacgaacctcgatcaatctgttcccttttgtgttcaagtttgtaggtcatttggttggggtaaaacatgtcacatcaacaagaggatgatgctgattacatggcaaacgagtatgacatggaagctatggatgatgatatggatgacgagttccatggccgagatgttggtggctctgattcagatgcagatgactatgactacacgaataacaaaatgcaagatacctctgctgccgaggcaaggagaggtagagacattcaagggattccatgggaaaggcttagcataaccagggagaaatacaggcaaacgagattagagcagtataagaactatgaaaatattccacaatctggggaggcgtcagagaaggactgcctagccacaaagaaagaagtttcattctatgacttcagacgtaattcaagatctgttaaatcaacaattttacacttccagctgaggaatttggtctgggcaacctccaagcatgacgtgtaccttatgtcacatttttccgtcattcattggtcatccttgacctgcagcaaaagtgaagttctgaatgtatcagggcatgtagcaccgtgcgagaagcatcctgggagccttttggaaggatttacacaaactcaagtcagcactcttacagtgaaagacaacttgctagttgctgggggatttcaaggagaactaatttgcaagtacgtagacaggcctggagtttgcttctgttcccggacaacatatgatgataatgctattactaatgctgttgagatttataacacctccagtggtgcacttcattttatagcttcgaataatgattctggagttagagattttgatatggagaaatttcaactgtccaagcatttccgctttccatggccagtgaatcatgcatcactgagccccgatggcaagcttattgcaatagttggggataatcctgaaggtttattggttgattccaggaacgcaaaggttgtttcaccattgagcggacatattgactactcatttgcgtcagcatggcatcctgatggcctaacttttgcaactggcaaccaggataaaacctgcagagtatgggatatacggaacctgtcgaaatcagttgttgctctgaagggtaaccttggagctattcggtcaatccgctacacatctgatggaagattcatggcaatggcagaacctgcagatttcgttcacgttttcgatgtaaaaaacggctacgagcaggagcaagaaatcgatttctttggtgagatatcaggtctgtcttttagtcctgatacagagtccctttttgtcggagtctgggatcgcacatatggtagccttcttgagtttggacggcggcacaactactcataccttgatacaattatctaagcactctcttgcatg

SEQ ID NO: 1815 - DNA, 1916 bp, Capsicum annuum
gtcgtttgcaaaacaagcagtggataaacatagaaattactaacaccttttttttttctcttcttcccaaatctaccgatctacaaaattcacttttatttttaattaatcaaattaattttcgatgtgttaattaattaatcatctgattaattaattaattttctggatcgagaacaatcgaaggtcatttggtttggtaaaacatgtctcatcaacaagaggatgatgctgattacatggaaaacgagtatgacatggaagttatagatgatgacatggatgatgagttccatggccgagataatggtggctctgattcagatggagaggactatgactatatgaataataaaatgcaagatacctctgctgccgaggcaaggagaggtagagacattcaagggattccctgggaaaggcttagcataaccagggagaaatacaggcaaacaagattagagcagtataagaactatgaaaatattccacaatctggggaggcatcagagaaggaatgcatagccacaaagaaagaagtttcatactatgacttcagacgtaattcaagatctgttaaatcaacaattttgcacttccagctgaggaatttggtctgggcaacctccaagcatgacgtgtaccttatgtcacatttttccgtcattcattggtcatccttgacctgcggcaaaaatgaagttctgaatgtatcagggcatgtagcaccgtgtgagaagcatcctgggagccttttggaaggttttacacagactcaagtcagcactcttacagtgaaagacaagttgctggttgctgggggatttcaaggagaactaatttgcaagtatttagacaggcctggagtttgcttctgttcgcggacaacatatgacgataatgcaattactaatgctgttgagatttataacactgccagtggtgcacttcattttatagcttcgaataatgattctggagttagagattttgatatggagaaatttcaactgtccaagcatttccgttttccgtggccagtgaatcatgcatcactgagccctgatggtaagcttatcgcaatagttggggataatcctgaaggtttgttggttgattccaggaatgcaaaggttgtttcacctttgagtggacatatcgactattcatttgcgtcagcgtggcatcctgatggcctaacttttgcaactggcaaccaggataaaacctgcagagtatgggacatacgtaacttgtcgaaatcagtcgttgctctgaagggtaaccttggagctattcgatcaatccgctacacatctgatggaagattcatggctatggcagaaccagcagatttcgttcatgtttttgatgtaaaaagtgggtatgagcaggagcaagaaattgatttctttggtgagatatcaggtctgtcttttagtcccgatacagagtcccttttcattggagtctgggatcgcacatatggtagccttcttgagtttggacggcggcacaactactcataccttgatacaataatctgaacaccactcttgcatgctgctttgggtacgtttacttggcttgaagtggcactggcttaactttgtaaaagcactagcatagtcaggagttagtagtggatttggctgtaaatttgttatgttctgcaatttaagtctgtcacataaattgttgtgttgtgcaccatttctaagtatcagaggatgtagaatggagggatgtatagaaagggaagagactccggtgatgtgaacaagaaaacttaaacaaagtgttgtttccataaggcataggccaaaaacttgatcttgtgttttggggctaggggtcatgtattgagtcctttaattcttactgaaagttgacttactgatttgcatcaaaaaaaa

SEQ ID NO: 1816 - DNA, 2096 bp, Catharanthus roseus
gagacccatcgcgatctaattaagcttttcgattaagggtttatttcttcgtttaatctaatctgggttgaatttctgctttataaattctctgattcattaggtttcgagatcgagatcggaggagctcgatcatcaattttcttttatcgatttatttgaagagtaaaccatgtcccatcaccatggagatgatgctgactacatggccgatgaatatgacatggaggatgtggatgatgatatggatgatgaattccgcggcagagatatgggtggctcagactctgacgtggatgaatatgactacatgagtaacaagatgcaagatacgtctgctgctcaagctaggaaaggcaaagacatccaaggcattccgtgggaaagacttagcataaccagggagaaatatagacagactagattagaacagtacaaaaattatgaaaacattcctcagtctggtgagggatcagagaaggaatgcaagagcactgagaaaggagctttatattacgagttcagacggaattcaagatctgtgaagtcaacaattcttcacttccaattaaggaacttggtttgggctacatcaaagcatgatgtctacttcatgtcacgcttttctgtaattcattggtctaccttatcttgcatgaaatccgaagttctcaatgtgtcaggacatgtggcaccatgtgagaaacatcctggaagcctactagaaggatttacgcagactcaagttagcactttagcagttaaagataatcttttagttgctggaggatttcagggagagctaatttgcaagtttttggaccgacctggagtgagcttttgctcccggacaacatatgatgacaacgcgataactaatgctgttgagatctataacacacccagtggtgcagtccattttacagcttcaaataacgattgcggagtcagggactttgacatggaaaaatttcagctgtctaaacattttcgtttcccttggcctgtgaatcacacttccttgagccctgatggcaaacttctcagcatagttggtgataatccagaaggtatattggtggattccagaagcggaaaggcagttgcaaatttaagtgggcacctggattattcatttgcttcagcatggcatcctgacggcctcacatttgctactgggaatcaggacaaaacttgtcgcatctgggatatgcgaaacctctctaagtctgttgctgctttgaagggtaacctgggcgcaattcgatctattcgctatacttcagatggcagattcatggcaatggcggaacctgccgattttgtccatgttttcgatgtaaaaagcgggtatgaaaaggagcaggaaattgatttctttggcgaaatatcaggcatgtctttcagtcctgatacagagtccctcttcattggagtctgggaccgtacttatggtagccttttggagtttggacgacggcggtattactcgtacctcgataccataatatgagttcattaggggactgcaaataagtgtttgaaacttgatttggttcttcttgacatgtcacagttgtgtaaacggttttagacgtagtctcctatattagtggggtgtagttgtaaatttcgtatgttgtacaagtagacttgtgtggtggtgtgtggtggatgcaccatcattttgagtcttataaaaggttggggattggaggatgtacagaagaagaagaagaaaaaggctagtttgagccctgggtcatgccgacaaagaaatggttagaactagggatctttttacttgagaaaggcagacttgtaatgagatggagaggtgtctacagatggtctgatggatgctattttccttcaatgtcttgcatgatttatccatgtcaactcgcattcttgatgaaactgaaactgatggtacttttttctcttgtgccctctttagtgtgttttgcccctttacactttcctcctcaatcccccgcaagtttatgtttcttaagtccatttgggtgtcttttgtattcgagaattattaactaatttggtgagaagaattctgtattccacaattattgact

SEQ ID NO: 1817 - DNA, 1837 bp, Vinca minor
atcttgttagaaaaaagggtttatttctcccccgatattctaatcgcgtttcaattttttgctgtaataatctctaatcgattaggtttcgagatcgagatcgagatcggaggagctcgataatcaatttcttctcggcgttttacttacttctttacgcggtctagacaatgtcccatcagcaaagagatgatgctgagtacatggccgatgaatatgacatggaagatggggatgatgatatggatgatgagttcggtggcagagatatggtggttcagactctgatgtggatgaatatgactacatgaataataagatgcaagatacctctgctgctcaagctaggagaggcaaagacatccagggcattccgtgggaaagacttagcataaccagggagaaatacagacaaactagattagagcagtacaaaaattatgaaaacattcctcagtctggcgagagatcagagaaggattgcacaagcactgagaaagggtgttcatactatgagtttagacggaattcaagatctgtgaagtcgacaattctgcacttccagttaaggaacttggtttgggctacatcaaagcatgatgtctacttcatgtcacggttttctgtaattcattggtctaccttatcttgcatgaaatccgaagtcctcaatgtctcgggacatgtggcaccatgcgagaaacatcctggaagcttgctagaaggattttcacagacccaagttagcactttagcagtaaaagacaatcttttaattgctggagggtttcagggagagctaatttgcaagtttttagaccgtcctggagtcagcttttgttcgcggacgacgtatgatgacaatgcaataactaatgctgttgagatctacaacacacctagtggggcagtccattttacagcttcaaacaatgatagtggagttagggactttgacatggaaaaatttcagctatctaagcattttcgttttccttggcctgtgaatcacacgtccctgagccctgatggtaaacttctcacaatagttggagataatccggagggtatattggtggattcaaaaactggaaagacagttgcaaatttatgtgggcacctggattattcatttgcctcagcatggcatcctgacggcattacatttgctaccgggaatcaggacaaaacttgtcgcatctgggatatgcgaaacctgtccaaatcagttgctgttttgaagggtaatctgggcgcagttcggtctattcgctatacttcagatggcagattcatggcaatggcagaacccgcagattttgtccacgttttcgatgtaaaaagcgggtacgaaaaggaacaagaaattgatttctttggcgaaatatcaggcatgtctttcagtcctgatacagagtcactcttcatcggggtctgggaccgtacgtacggtagccttcttgagtttggacggaggcggtactactcgtaccttgatacaatattctgagttcactagcaccttgcaaataagtgattaaacttgatatcttgatatttcacaactgtgtaaacgttttagcatagtcttactatattagaagggtgtagttgtaaatttattatgttgtaccagtagacttgtaatggtggtgggggtttactacaccatcattttgagtcttcataaaatggttgtggagggtatgttgtacagaaggctagacagatgagaccctgggtcgtgcggacaagaactgcattagagcttagggattttgcaaggcaaagcttgtgacgtgataaggagtgcagattgttctggtcgtgagtcgta

SEQ ID NO: 1818 - DNA, 1739 bp, Tabernaemontana elegans
aggcggtctattcttggagtagaccatgtctcatcaccaaggagatgatgccgactacatggccgatgaatatgacatggaagatttggatgatgatatggatggtgtgttccgtggcagagatattggtggctcggactctgatgtggatgaatatgactacatgaataataagatgcaagatacctctgctgctcaagctaggagaggcaaagacatccagggcattccttgggaaagacttagcataaccagggagaaatatagacagactagattagagcagtacaaaaattatgaaaacattcctcaatctggtgagggatcagagaaggaatgcaaaagcactgagaaagggggctcatattatgagtttagacggaattcaagatctgtgaagtcaacgattctgcatttccagttaaggaacttggtttgggctacatcaaagcatgacgtctacttcatgtcacgtttctctgtaattcattggtctaccttatcctgcatgaaatccgaagttctcaatgtttcaggacatgtggcaccatgtgagaaacatcctggaagcctacttgaaggatttacacagactcaagttagcactttagcagtgaaagataatcttttagttgctggaggatttcagggagaactaatctgcaagtttttagaccggtctggagttagcttttgttcccgaacgacgtatgatgacaatgcaattaccaatgctgttgagatctacaccaaacctagtggtgcagtccattttacagcttcaaataatgattgtggagttagggactttgacatggaaaaatttcagctgtcaaagcattttcgttttccctggcccgtaaatcacacatccctgagccctgacggcaaacttctcacaatagttggagataatcctgaaggtatattggtggattccagaagtggaaaggcggttgcaaatttatgtgggcacctggattattcatttgcttcagcatggcatcctgatggccttacgtttgctactgggaatcaggacaaaacttgtcgcatctgggatatgcgaaacctgtccaaatcagttactgctttgaagggcaatcttggtgcaattcgatctattcgctatacttctgatggcagattcatggcaatggcagaacctgcagattttgttcatgtttttgatgtcaaaagtggttacgaaaaggaacaggaaattgatttcttcggcgaaatatcaggcatgtctttcagtcccgatacggaatcgctcttcattggagtctgggaccgtacttatggtagccttctcgagtttggacgacggcggaactactcatatcttgataccataatctgagttcattagcacactgcaaataagtgtttcaacttgatttggttcctgatatgtcaaaactgtgtaaacgtttttagcatagtcttaccatattagcaggtctagttgtaaattgattatgttgtacaagtggactttgatggtggtgactttaccatcattttgagtctctcataaaaggttctggaggtggatgtacagaaggctagacgcgtgtcctgttcatgggacgctaaaagcatagggctagggatttggaaggcaggcattgtaacgtgactgaggtttgccaattgtcctgtcgtgagcttgagcttgagcttgtctccggttggtctgatggatcctagtttcctttaattacatgattgat

SEQ ID NO: 1819 - DNA, 1707 bp, Amsonia hubrichtii
gtttcaggatcgagatcagaggagctcgattatcagttttcatttggcgatttatttgaagttctgctttaggcggtctattctttgagtagaccatgtccaatcaccacgaagttgatgctgactacatggccgatgaatatgacatggaagatgtggatgatgatatggatgatgagttccgcggcagagatatggctggctcagactctgatgtggatgaatatgactacatgagtaataagatgcaagatacttctgctgctcaagctaggagaggcaaagacatccaaggcattccttgggaaagacttagcataaccagggagaaatatagacagactagattagagcagtacaaaaattatgaaaacatacctcagtctggcgagggatcagagaaggaatgcaaaagcactgagaaagggggttcatattatgagtttagacggaattcaagatctgtgaaatcaacaattctgcacttccagttaaggaacttggtttgggctacatcaaagcatgacgtctacttcatgtcacgtttttctgtaattcattggtctaccttatcttgcatgaaatccgaagttctcaatgtttcaggacatgtggcaccatgtgagaaacatcctggaagcctactggaaggatttacacagactcaagttagcactttagcagtgaaagaaaatcttttagttgctggaggatttcagggagaactaatttgcaagtttttggaccggcctggagttagcttttgctcgcggacaacatatgaagacaatgcgataaccaatgctgttgagatctataccacacctagtggtgcagtccattttacagcttcgaataatgattgcggagttagggactttgacatggaaaaatttcagctgtctaagcattttcgtttcccttggcctgtgaatcacacatccctgagccctgatggtaaacttctcacaattgttggagataatccagaaggtatattggtggattccagaaacggaaaggcagttgccagtttatgtggccacctggattattcatttgcttcagcctggcatcctgatggccttacattcgctaccgggaaccaggacaagacttgtcgcatctgggatatgcggaacctgtccaaatcagttgctgctttgaagggtaatcttggtgcaattcggtctattcgctatacctctgatggcagatttatggcaatggcagaacctgcagattttgtccatgttttcgatgtcaaaagtggttatgagaaggaacaggaaattgatttctttggcgaaatatcaggcatgtctttcagtcctgatacagaatcgctcttcattggagtctgggaccgtacatatggcagccttctcgagtttggacgaaggcggaactactcgtaccttgatactgtaatttgagttcattagcaggctgcaaataagcgtttcaacttgatttggttctttgatatgtcgcaactgtgtaaacgttttagcatagtcttactatattagggggtctagttgtaaatttgttatgttgtaaaagtagactttgattatggtagtggtgttggtcgtttcaccatcattttgagtctcataaaagtttctggaggggggatgtacagaaggctcatctagccctaatcatgcagacaagaaagcatagagcgagggattctacaaa

SEQ ID NO: 1820 - DNA, 1664 bp, Vinca minor
aatctttgtattattttagtaagatattattattatttctctctctccctctctccgaggagacccatcgcgatcttgttgaaaaaagggtttatttctccccccgatattctaatcgcgtttcaatttttgctgtaataatctctgatcgattaggtttcgagatcgagatcgagatcggaggagctcgataatcaatttcttctcggcgttttactacaatgtcccatcagcaaagagatgatgctgagtacatggccgatgaatatgacatggaagatggggatgatgatatggatgatgagttcggtggcagagatattggtggttcagactctgatgtggatgaatatgactacatgaataataagatgcaagatacctctgctgctcaagctaggagaggcaaagacatccagggcattccgtgggaaagacttagcataaccagggagaaatacagacaaactagattagagcagtacaaaaattatgaaaacattcctcagtctggcgagagatcagagaaggattgcacaagcactgagaaagggtgttcatactatgagtttagacggaattcaagatctgtgaagtcgacaattctgcacttccagttaaggaacttggtttgggctacatcaaagcatgatgtctacttcatgtcacggttttctgtaattcattggtctaccttatcttgcatgaaatccgaagtcctcaatgtctcgggacatgtggcaccatgtgagaaacatcctggaagcttgctagaaggattttcacagacccaagttagcactttagcagtaaaagacaatcttttaattgctggagggtttcagggagagctaatttgcaagtttttagaccgtcctggagtcagcttttgttcgcggacgacgtatgatgacaatgcaataactaatgctgttgagatctacaacacacctagtggggcagtccattttacagcttcaaacaatgatagtggagttagggactttgacatggaaaaatttcagctatctaagcattttcgttttccttggcctgtgaatcacacgtccctgagccctgatggtaaacttctcacaatagttggagataatccggagggtatattggtggattcaaaaactggaaagacagttgcaaatttatgtgggcacctggattattcatttgcctcagcatggcatcctgacggcattacatttgctaccgggaatcaggacaaaacttgtcgcatctgggatatgcgaaacctgtccaaatcagttactgttttgaagggtaatctgggcgcagttcggtccattcgctatacttcagatggcagattcatggcaatggcagaacccgcagattttagtccacctttttcgatgtaaaaagcgggtacgaaaaggtacagaaattgatttctttggcgaaatatcaggcatgtctttcagtcctgatacagagtcactcttcatcgggggtctgggaccgtacgtacggtagccctttcttgaagttttggacggaggcggtactactcgtaccttgatacaatattctgagttcactagcaccttgcaaatagtgattaaacttgatatcttgatatttcacaactgtgttaaacgttttagacatagtcttactatattatacta

SEQ ID NO: 1821 - DNA, 1879 bp, Valeriana officinalis
tctctccccttcctttccttttgtttttctagaatcatctcgatctgtatatcgggacgggaatttgtcatttttcgattttacctcctaattccttcatttaatcttctctactttcaatttttgatttccttaatcaactccaggtctagatcacaggactgcacaatcgtctatttgctccttcatcaacaaagatcatgtcccatcaccatggtgatgatgctgagtacatggccgatgaatatgaaatggaggacggagatgatgacatggacgaagaatttcgtggcagagacaccggtggctcggattctgacgttgatgaatatgatcacttgagtaataaaatggcagatacttcagctgctcaggctaggaaaggaaaagatatacaaggcattccttgggaaaggcttagcatcacgagggagaagtataggcagactagactagaacaataccgaaattacgaaaatatcgctcaatctggagagggttctgaaaaggaatgcaagattacgcgaaaaggggcatcgtattacgaatttagacgcaattcaagatccgtgaaatcaacgattcttcattttcaattgaggaacttggtatgggctacatcaaagcatgatgtatacctgatgtcgcatttttctgtcattcattggtcgtccttaacatgcactagatctgaagttctcaatgtatcaggacacgtggcaccatctgagaaacatcctgggagtttgttggaaggatttacgcaaacccaagtcagcactctagcagtcaaagataatttgctagtagctggtggatttcaaggagagcttatatgcaaatatttggatagacctggagtgtgcttttgttccaggacaacatatgatgataatgctatcactaatgccatagagatttacaacactgccagcggtgcacttcattttacggcttcaaataatgacagtggagtgagagattttgatatggaaaagtttcaactttgtaaacattttcgatttccttggccagtcaatcatacatctcagagtcccgatggtaaacttcttattatagttggtgataatcctgacggcttattagtggattcaaaaactggaaagacagttgcatcgttatgcggacacctagactactcattcgcatcagcatggaaccctgacggtctgacatttgcgactggcaaccaagacaaaacctgccgtatttgggacataaggaacacctcgaaatcaatcgcggcactcaaaggcaacctaggagcaatcagatcgatccgctacacatcagacggccgattcatgtccatggcggaaccggcagatttcgtccacgtatttgacgtgaagagcgggtatgaaaaggaacaagagattgactttttcggagaaatctccggaatggcttttagtccagacacagagtcgctttttgtaggagtgtgggaccgtacgtatggcagtttgctggagtttgggcggtgcaggaattactcgtatcttgatactcttatttgaatgatgatggtgttggtattaaataaaagttgagaattttttaggagtgatgggggttcaaatgtaaattttactactatattttacggagaggagggtgtttgttgtgtaacatatactaatatgatatgatgatgaactagtagaggtacgacgatgaacgggggtgttgtggtgagtgaagaatgtatagagaaaggtaggaagaaagcaaacaagcggatgtcggtcggtccgtgcaaactacagctcatacttggttttagggtccgttttcaccttttcatcatgtgtttgttgtggatctctggttggtaatttctatacctttttggata

SEQ ID NO: 1822 - DNA, 1490 bp, Actinidia deliciosa
ctctctctgggatgcatcacgatctattttgcggaaaattattcctaaaataatacgattaatctctgatacaagtaattccagatcgagacgaaccagttatctcagattttcgatccgctgatttacaaaggtcgaggaccaatttttgtcaagaccatgtctaatcaacaaggggatgatgctgaatacatggccgatgaatatgaaatggaagatgtggatgatgacatggacgaagagttcgttggcagagagatggggggctcagactctgatgtggatgaatatgaccacatgaataatagaatggcagatacttctgctgcgcaagctaggagaggcaaagatatccaaggaattccttgggagagacttagtatcacaagggagaagtacaggcaaactaggttagaacaatacaagaactatgagaacattcctcaatctggagagggttcagaaaaagaatgcaatattataaagaaagggggcatgtattatgagttcagacgcaattcacgatctgtaaaatctacgatacttcatttccagttgaggaatttggtatgggccacatcaaagcatgatgtttaccttatgtcacattttcaagttgttcattggtcttcacttacttgtaacaagtccgaggttctcaatgtttcaggacatgtggcaccatgtgagaaacatccaggaagccttttggaaggattttcgcagacccaagttagcacgcttgctgtaaaggataggttactagttgctggaggatttcagggagaactgatttgcaagtatctagataggccaggagtttccttctgcaccaggacaacatatgatgataatgcaatcactaacgctgttgagatctactctacttcaagtggtgcatctcatttcacagcttcaaataacgattgcggagttagagactttgatatggaaaaatttcaactttctaagcatttccgcttcccttggccagtaaatcatacttctcttagtcctgatggtaagcttcttgttattgtcggcgacaacccagatggtatactaatggatgcttctactggaaagacaatcctgcatttggctggtcacttggatttctcatttgcatcggcatggcaccctgatggcctcacttttgctactgggaaccaggacaaaacctgccgtatttgggacgtccgaaacctatccaagtcagttgctgctttgaagggtaatcttggggccatccggtcaatccgctacacatccgatggccggttcatggcaatggcggagcctgcagattttgtccatgtatatgatgctaaaggtggatatgagaaggagcaggagattgatttctttggtgagatatctggcatgtccttcagccctgatacagaatcactctttatcggagtgtgggaccgtacttacggtagccttctcgagtttggccgacgaaggaactattcataccttgattc

SEQ ID NO: 1823 - DNA, 1367 bp, Solanum tuberosum
ctttgcagaagaaccgagtggataaacatagaaacttttccccctttttctcttcgacccaaatctcgatctacaattagttttcatttttctttgtgtttaatcaatcaaattaattttcgatgtgttaattgatgtctgattgttaaatttctggatcgagatcgaacgaacctcgatcaatctgttcccttttgtgttcaagtttgtaggtcatttggttggggtaaaacatgtcacatcaacaagaggatgatgctgattacatggcaaacgagtatgacatggaagctatagatgatgatatggatgacgagttccatggccgagatgttggtggctctgattcagatgcagatgactatgactacacgaataacaaaatgcaagatacctctgctgctgaggcaaggagaggtagagacattcaagggattccatgggaaaggcttagcataaccagggagaaatacaggcaaacgagattagagcagtataagaactatgaaaatattccacaatctggggaggcgtcagagaaggactgcctagccacaaagaaagaagtttcatactatgacttcagacgtaattcaagatctgttaaatcaacaattttacacttccagctgaggaatttggtctgggcaacctccaagcatgacgtgtaccttatgtcacatttttccgtcattcattggtcatccttgacctgcagcaaaagtgaagttctgaatgtatcagggcatgtagcaccgtgcgagaagcatcctgggagccttttggaaggatttacacaaactcaagtcagcactcttacagtgaaagacaacttgctagttgctgggggatttcaaggagaactaatttgcaagtacgtagacaggcctggagtttgcttctgttcccggacaacatatgatgataatgctattactaatgctgttgagatttataacacctccagtggtgcacttcattttatagcttcgaataatgattctggagttagagattttgatatggagaaatttcaactgtccaagcatttccgctttccatggccagtgaatcatgcatcactgagccccgatggcaagcttattgcaatagttggggataatcctgaaggtttattggttgattctaggaacgcaaaggttgtttcaccattgagcggacatattgactactcatttgcgtcagcatggcatcctgatggcctaacttttgcaactggcaaccaggataaaacctgcagagtatgggatatacggaacctgtcgaaatcagttgttgctctgaagggtaaccttggagctattcggtcaatccgctacacatctgatggaagattcatggcaatg

SEQ ID NO: 1824 - DNA, 1705 bp, Fagus grandifolia
gtatacaacaataaaaataaaagcgtttgttatatatacttaattaattaacttgctgacgatgatgcttataattttctgagactttgggttttcaagatcgaaatagctccgtccaaccttcaatctcaaaaagggtgtgaaattgatagacagaacatgtctcaataccaaggggatgatgccgaatacatggcagatgaatatgaaatggaagatgtagacgatgatatggatgatgagtttcgcggtagagaaatgggcggctcagagtctgatgttgaggaatacgaaccctcgaataataaattagctgatactactgccgctcaagctagaagtggaaaagatatccaggggatcccttgggatagacttagcatcactagggagaaataccggcaaactaggctagaacagtacaagaactatgaaaacatccctcattctggagaggggtctgggaaggattgcaaagttacgaagaaagggggttcatattatgtgttcaggcggaattcaagatctgtaaaatcaaccattcttcattttcagttgaggaacttggtttgggctacctcaaagcatgatgtctaccttatgtctcatttttctgtcgtccattggtcctccttaacttgcggcaggaatgaagttctcaatgtctcagggcatgttgcaccatcggagaaacatcctggaagtctgttggagggatttactcagactcaagtgagtacactttctgtaaaagataagttgcttgttgctggagggttccaaggagaacttatttgtaagcatctggaccggcctggaatttagtttttgttctaggacaacttatgatgacaatgctatcaccaatgctgttgagatttacgccagctcaagtggtgcagttcacttcacagcttcaaataatgattctggagttagagactttgatatggagaaattccaactttctaagcacttccggtttccttggccagtgaatcatacttctctgagtcctgatggtaaacttcttacaatcgtgggagataacccagaaggcatgctggtggattcccaaactggaaagacggtcaagcccttgtgtgggcatttagatttctcgtttgcatcagcgtggcaccctgatggtgtcacttttgctactggaaaccaggacaaaacctgccgggtttgggatgtccgaaatttatccaagtcagttgctgttctgaagggcaaccttggagccattcgatcaatccgctatacttccgatggtcagtatatggcaatggcagagcctgctgacttcgtgcatgtctatgatgtgaaaaatggatacgagaaggaacaggagattgatttctttggcgagatatctggtgtatcattcagtccggacaccgagtctctttttattggagtgtgggatcgtacatatggtagcctccttgagtatggccgatgccggaactactcataccttgattctctaatttgagttgaatgtgaaacctgcaaataagtgtgttggtgttgctgattgctttggcgaaattgagaaacctagtatcatatcatgcagttggaaaggggttagttgtatatttggtatgttgtgcaattgtagcaaatttattttcttttggtgtaactctggattttatcataaaagtttgtcagagggaggggatgtacagaaggc

SEQ ID NO: 1825 - DNA, 2177 bp, Castanea mollissima
attgatttttccaattggggtttcgtcaaaaattaaataatatataaaaaaattaaagcttttgttataatatatatacacaataaattaatcttgctgacgacgatgcttttcattttgtgagagtttgggatttccagatccatatagctttctctaaccctcaatctcaaaaaggtgtgaaattgttagaaagaacatgtcccaataccaaggggatgatgctgaatacatggcggatgaatatgaaatggaagatgtagatgatgagatggatgatgagtttcgtggtagagacgtggctggctcggagtctgatgttgatgaatacgaccatgggaatagcaaagtacatgatactactgctgctcaagctagaagtggaaaagatatccagggaatcccttgggataggcttagcatcactagggagaaataccggcaaactaggcttgaacaatacaagaactatgaaaacatacctcaatctggagaggggtctgggaaggattgcaaagttacaaagaaagggggctcatattatgagttcaggcggaattcaagatcagtgaaatcaaccattcttcattttcagttgaggaacttggtttgggctacctcaaagcatgatgtctaccttatgtctcatttttctgtcgtccattggtcctccttaaattgcagcaggcaagaagttctcaatgtctcggggcatgttgcaccatcagagaaacatcctggaagtctgttggagggatttactcagactcaagtgagtactctttctgtaaaagataagctactagttgctggaggattccaaggagaacttatttgtaagcatctggatcggcctggtgttagtttttgttccaggacaacttatgatgacaatgctatcaccaatgctgttgagatttacgtcagctccagtggtgcagttcactttacagcttcaaataatgattgtggagttagagactttgatatggagaaatttcaacttactaaacacttccggtatccttggccagtgaatcatacttctctgagtcctgatggtaaacttcttacaattgtgggagacaacccagaaggtctgctggtggattcccaaactggaaagatggtcaccaccttgtgtgggcacttggatttctcatttgcatcagcatggcaccctgatggtgtcacttttgcaactgggaaccaggacaaaacctgccgggtttgggatgtccgaaatttatccaagtcagtcgctgttctgaagggcaaccttggagccattcgatcaatacgctatacttctgatggtcagtatatggcaatggcagagcctgctgactttgtacatgtctatgacgcaaaaaatggatatgagaaggaacaggagattgatttctttggcgaaatatctggtgtatcattcagtccagacacagagtctctttttattggagtgtgggatcgtacatatggtagcctccttgagtatggtagatgccgaaactactcataccttgattctctaatttgagttgaatgtgaaacctgcaaataagtgtgttagtgttgctgataacttttcagcaagattgaaaaacctagtatcaaattatgcagttggagaagggggtagttgtatatttgttatgttgtgcaatgtagcaaagttgttctcttttggtgtaagtctggatttttatcataaaatgtgtaaaagggagggaatgtacagaaggctagaaggcaacgattgtggcaacaagggaaaagaaaaccagtgtgtcttagggttgatggctggatactatccttcatgtatgttagaaattactttatgagaaccgagctttgtggtgcttccaatgatgtgggctgttttctttctcatcatcccaaatgttggttctttcatctcccaattctgactttcaatattgctcagagtgtaccccatcttgtggtgcttcccaatgatgtgggctgtttcctttctcatcatcccaaatgttggttcttcatctcccaattctgacttcaaatataatagctcagggtgttccccatcttgaagtaggtacgcttagaccagctgaattccttttgaaggagctcagctttactaacctatttatgtcttggtcgcttgttttgtatggatatatggttta

SEQ ID NO: 1826 - DNA, 1823 bp, Citrus sinensis
tcaactcaccgtcaaagcaaagttttgagggacattttattttcaattcaattattacgcaagcaattatcattacagtcttctaacgtgcgagcgattcagtttccgatttttttttcctcagatcggaggagccaaccgtaaaccctaactcgccaaagagaatatgtcccattaccacgcggatgatgcggagtatatggcagatgaatatgacatggaagatatagatgatgatatggacgaagaatttcgtggcagagatatgggtggctcagactctgatgtcgatgaatatgattactcgaataataaaatagccgatacgtctgctgctcaagctagaagagggaaggatatccagggtataccatgggagaggcttagcataaccagggaaaaataccggcaaactcggctagaacagtacaagaactatgaaaacattcctaattccggagagggctcagggaaggattgcaaagttactaagaaaggggcttcatattatgaattcagaagaaattcaagatctgtgaaatccactattcttcattttcagctgaggaacttggtttgggcaacgtcaaagcacgatgtctaccttatgtcacatttttcagtcatccattggtcttcattaacttccagcaggtctcaagttctcaatgtttcaggccatgtggcaccatccgagaaacatcctggcagtctgttggaaggatttacgcagactcaagttagtacgcttgctgtgaaagacaagttgctagttgctggagggtttcagggagagcttatttgcaagcatttagatcgacctggagtgagcttttgttctcgtactacttatgatgataatgcaatcaccaatgctgttgagatctacggcagtcccagtggtgcagtccactttactgcctcaaacaatgactgcggagtgagagactttgatatggggaagtatcaactctctaagcatttccgtttcccttggcctgtgaatcattcttcacaaagtcctgatggtaaacttctaataatcgttggagacaacccagatggtttattagtggattccatgacgggaaagaccattgcctcattgtgcgggcacttggatttctcatttgcatctgcatggcaccccgatggtgtcactttcgccactggaaaccaggacaaaacatgcagaatttgggatctacgaaacctatctgagtcggtggctgttctgaagggcaatcttggagccattaggtcgatccgctatacatctgatggtcggtacatggcgacagccgagcctgctgactttgtgcatgtctatgacgttaagagtgggtatgagaaggagcaggaaattgacttttttggtgaaatatctggcatttcattcagtcccgacacagagtctctcttcattggagtttgggatcggacatatggcagcctccttgaatatggtcgctgccggaattactcatatctcgactccttaatttgagttggatgtgcaatttgcaaataagtgtgttgatggggcttacttggttcagttgagaaacctagtttcatgccggtaggagagtctaggtgtaaatgtgccgtgacgtgcaatttaggttattgtggttcaatcaattgtgattccacttcctgtggtggaggtcgtcagaagatgtgtgaaaatgcaggaatcgatgtacagaggctggaagaaaccagctatttcatgtgaactacataaaaggaaaatgacaactatgtcttcctgatgaacagtacaatttcatgagtgaatcctgcccttgatttatgtt

SEQ ID NO: 1827 - DNA, 2370 bp, Citrus clementina
atgcgggcggccttatccatgtcatcatcgccactaaagcatcaccagaatccttttcaagaacaagatgaacacgctgctacctcttctttaacttacgccgttcagctcgcatgctttctcaccaccactgtcatcgtgtttaacgcccctcaagcatccatatacaaccatcgtcactcaattttcggccacaccatcgtagtagatgcggcgattcaaagtagtggcagctgacttggtagcaacgcagggtcacaatgtaggagcagatcgtgtcgcgcactgcgcgtgccgccctaacagttatgccaatggttaccgctgttgcctgttgcctactgctgctgtgaagcaatgccacctaaacttttcacaactctctctctctctttctctttgtgattgttactcgtttgtcaaccacaatccaccgtcgcaactctctctttccgtgcccaaaattgactgttgctctgcctctgctattgttgctccatctctgctcagtctcaactactgttgctgctttttgcttcgtctctacttcatctctacttcatctctactcgctggtattattcctcaatttttctatttggatcggaggagccaaccgtaaaccctaactcgccaaagagaatatgtcccatcaccacgcggatgatgcggagtatatggcagatgaatatgacatggaagatatagatgatgatatggacgaagaatttcgtggcagagatatgggtggctcagactctgatgttgatgaatatgattactcgaataataaaatagccgatacgtctgctgctcaagctagaagagggaaggatatccagggtataccatgggagaggcttagcataaccagggaaaaataccggcaaactcggctagaacagtacaagaactatgaaaacattcctaattccggagagggctcagggaaggattgcaaagttactaagaaaggggcttcatattatgaattcagaagaaattcaagatctgtgaaatccactattcttcattttcagctgaggaacttggtttgggcaacgtcaaagcacgatgtctaccttatgtcacatttttcagtcatccattggtcttcattaacttccagcaggtctcaagttctcaatgtttcaggccatgtggcaccatccgagaaacatcctggcagtctgttggaaggatttacgcagactcaagttagtacgcttgctgtgaaagacaagttgctagttgctggagggtttcagggagagcttatttgcaagcatttagatcgacctggagtgagcttttgttctcgtactacttatgatgataatgcaatcaccaatgctgttgagatctacggcagtcccagtggtgcagtccactttactgcctcaaacaatgactgcggagtgagagactttgatatggggaagtatcaactctctaagcatttccgtttcccttggcctgtgaatcattcttcacaaagtcctgatggtaaacttctaataatcgttggagacaacccagatggtttattagtggattccatgacgggaaagaccactgcctcattgtgcgggcacttggatttctcatttgcatctgcatggcaccccgatggtgtcactttcgccactggaaaccaggacaaaacatgcagaatttgggatctacgaaacctatctgagtcggtggctgttctgaagggcaatcttggagccattaggtcgatccgctatacatctgatggtcggtacatggcgacagccgagcctgctgactttgtgcatgtctatgacgttaagagtgggtatgagaaggagcaggaaattgacttttttggtgaaatatctggcatttcattcagtcccgacacagagtctctcttcattggagtttgggatcggacatatggcagcctccttgaatatggtcgctgccggaattactcatatctcgactccttaatttgagttggatgtgcaatttgcaaataagtgtgttgatggggcttacttggttcagttgagaaacctagtttcatgccggtaggagagtctaggtgtaaatgtgccgcgacgtgcaatttaggttattgtggttcaatcaattgtgattccacttcctgtggtggaggtcgtcagaagatgtgtgaaaatgcaggaatcgatgtacagaggctggaagaaaccagctatttcatgtgaactacataaaaggaaaatgacaactatgtcttcctgatgaacagtacaatttcatgagtgaatcctgcccttgatttatgttaatgttcttcgattctcttttccagtctctcgcttacttaccgatttcgcaggcccatggtggagggtc

SEQ ID NO: 1828 - DNA, 2561 bp, Citrus sinensis
aaaagaaaaaaaaaatttcgttttttatttggttcgattctaattaaattttttaaattcagtactaaatcgaaccgaaatttttcatttggtccaaaaccgaaccgatctgttatccatcgaatgattaatcatagtctttatttactattaataaaataaaacttctgacaaataacattggggctattattcttcaaaaagaaataaatagatatacttcttctagaaaggtaattgaatgatggtgaaaatgtgcttttgtcacccacattctgtcggttatgagtttgtaagataaaatttattattatacattaattgataaagtaattacaataattccaacaacaaaaaaattacgataataaatatatcataaatgaaaaatacataatattaaaataaataacctaaaaatttttgtgcgtgcatattttattgcaaaattagaaaggaaaaaataaaacattttcttttgataggagacacgcaagcagttatcgttcaggccagtaaaacaaaaatagtaatataactccatataacagcacctgtctctttcaggcttctcgttttcattcgtggaagctcagaacaaccggataaacgcaaatacgtctcactctcgtttcttctcgcgttttctcccaatttatcgcgatcaattcaactcaccgtcaaagcaaagttttgagggacattttattttcaattcaattattacgcaagcaattatcattacagtcttctaacgtgcgagcgattcagtttctgatttttttttcctcagatcggaggagccaaccgtaaaccctaactcgccaaagagaatatgtcccattaccacgcggatgatgcggagtatatggcagatgaatatgacatggaagatatagatgatgatatggacgaagaatttcgtggcagagatatgggtggctcagactctgatgttgatgaatatgattactcgaataataaaatagccgatacgtctgctgctcaagctagaagagggaaggatatccagggtataccatgggagaggcttagcataaccagggaaaaataccggcaaactcggctagaacagtacaagaactatgaaaacattcctaattccggagagggctcagggaaggattgcaaagttactaagaaaggggcttcatattatgaattcagaagaaattcaagatctgtgaaatccactattcttcattttcagctgaggaacttggtttgggcaacgtcaaagcacgatgtctaccttatgtcacatttttcagtcatccattggtcttcattaacttccagcaggtctcaagttctcaatgtttcaggccatgtggcaccatccgagaaacatcctggcagtctgttggaaggatttacgcagactcaagttagtacgcttgctgtgaaagacaagttgctagttgctggagggtttcagggagagcttatttgcaagcatttagatcgacctggagtgagcttttgttctcgtactacttatgatgataatgcaatcaccaatgctgttgagatctacggcagtcccagtggtgcagtccactttactgcctcaaacaatgactgcggagtgagagactttgatatggggaagtatcaactctctaagcatttccgtttcccttggcctgtgaatcattcttcacaaagtcctgatggtaaacttctaataatcgttggagacaacccagatggtttattagtggattccatgacgggaaagaccattgcctcattgtgcgggcacttggatttctcatttgcatctgcatggcaccccaatggtgtcactttcgccactggaaaccaggacaaaacatgcagaatttgggatctacgaaacctatctgagtcggtggctgttctgaagggcaatcttggagccattaggtcgatccgctatacatctgatggtcggtacatggcgacagccgagcctgctgactttgtgcatgtctatgacgttaagagtgggtatgagaaggagcaggaaattgacttttttggtgaaatatctggcatttcattcagtcccgacacagagtctctcttcattggagtttgggatcggacatatggcagcctccttgaatatggtcgctgccggaattactcatatctcgactccttaatttgagttggatgtgcaatttgcaaataagtgtgttgatggggcttacttggttcagttgagaaacctagtttcatgccggtaggagagtctaggtgtaaatgtgccgtgacgtgcaatttaggttattgtggttcaatcaattgtgattccacttcctgtggtggaggtcgtcagaagatgtgtgaaaatgcaggaatcgatgtacagaggctggaagaaaccagctatttcatgtgaactacataaaaggaaaatgacaactatgtcttcctgatgaacagtacaatttcatgagtgaatcctgcccttgatttatgttaatgttgttcgattctcttttccagtctctcgctttcttaccgatgtcgtaggcccatggtggagggtc

SEQ ID NO: 1829 - DNA, 1652 bp, Citrullus lanatus
taggtgcggggtgagcttttgtacataatatgtcccattatcacggggatgatactgactacatggctgatgagtacgaaatggaagacattgacgatgatatggatgatgagtatcatgatagagaagtggaaggctcagattctgatgctgatgaattcaactcgagtagtagaatagttgataccactgcagctcaagcaagaagaggaatagacattcaagggattccttgggagagacttagcattactagagaaaagtacaggaaaactaggcttgagcagtacaagaactatgaaaatatccctaattcaggagaagggtcagagaaggattgcaaggttactgataaagcatgttcatactatgaattttgccgaaattcaagatctgtgaaatccaccattcttcattttcagttgaggaacttagtatgggcgacatcaaaacacgatgcataccttttatcacatttttctgtaattcattggtcatcattatcgtgcaccaaatctgaagtactcaatgtttcgggacatgtggcacctacagagaagcatcctgggagcttattagagggatttacacagacacaagtcagtacacttgcagtgaaagataagctacttgttgctgggggatttcagggagagcttatttgcaagcatctagaccgcccaggtgttagcttttgttccagaacaacttacgatgataatgctataactaatgctgttgagatatatactagcgctagtggtgcagttcatttcactgcttctaataatgattctggagtcagagattttgatatggagaaatttcagctttctaagcacttctgttttccttggccagttaatcacgctgccttgaacccagatggtaaactacttgtgatcgttggtgacaatcctgaaggtttattggtagactcacaaactggaaagacagttgcatctctatgtgggcacttggatttttcatttgcatcagcatggcattccgatggcgttacctttgccactgggaaccaggacaaaacatgcaggatttgggatgtaagaaatttatcaaagtcagtagctgctctgaaaggcaaccttggagccattcggtccatccgctattcctctgatggtcggtacatggcaatggcagaaccagcagacttcgtgcacgtgtttgacgtgaaaagtgggtatgagaaagaacaagaaattgacttttttggagaaatctctggtgtatcctttagtccggacaccgaatcgcttttcattggagtatgggatcgaacatatggtagccttctcgagtaccacagacgccgaaattatagttacctagattcgttgtactaagtttggaagtataaagaaaacaaacttgggaataagatgggtggtgaaaatgaaaattgtttaattaacatagtaacatgtagtggatatgttcttgtaatttgtaagtgtatatttagtgtgttgtgaaaactatagccttatgtattatgatttgatgacactttggttttgaagacacaatttgattgtatgctgaagggagtgtaaagaaaggcttgtggggggatgatgatgaatatatggccagggtgtcacctctttgcaaatcactgttcacaaatt

SEQ ID NO: 1830 - DNA, 1971 bp, Fagus grandifolia
agaaagtctgggtcgttctctttttcattggtggaattgcttggtacatgtttacattggtggaattgcttgtgtctgtagggaattgcttatttaagagagaaaaacattatttagctaaacaagagcaaaaaacatagttaatatagacacaacctctttgccgtgatcacgaaaggtctaacttgttgcaatttaaggaaagctttgtcatcaaccagtctgcttccagtgatccttcggcttatcccaaggtgtgaaattgatagacagaacatgtctcaacaccaaggggatgatgccgaatacatggcagatgaatatgaaatggaagatgtagacgatgatatggatgatgagtttcgcggtagagaaatgggcggctcagagtctgatgttgaggaatacgaacactcaaatagtaaattagctgatactactgccgctcaagctagaagtggaaaagatatccaggggatcccttgggataggcgtagcatcactagggagaaataccggcaaactaggctagaacaatacaggaaccatgaaaacatccctcattctggagaggggtctgggaaggattgcaaagttacgaagaaagggggttcatattatgtgttcaggcggaattcaagatctgtaaaatcaaccattcttcattttcagttgaggaacttggtttgggctacctcaaagcatgatgtctaccttatgtctcatttttctgtcgtccattggtcctccttaacttgcagcaggaatgaagttctcaatgtctctgggcatgttgcaccatcggagaaacatcctggaagtctgttggagggatttactcagactcaagtgagtacactttctgtaaaagataagttgcttgttgctggagggttccaaggagaacttatttgtaagcatctggaccggcctggaattagtttttgttctaggataacttctgatgacaatgctatcaccaatgctgttgagatttacgccagctccagtggtgcagttcacttcacagcttcaaataatgattctggagttagagactttgatatggagaaattccaactttctaagcacttccggtttccttggccagtgaatcatacttctctgagtcctgatggtaaacttcttacaatcgtgggagataacccagaaggcatgttggtggattcccaaacgggaaagacggtcaagcccttgtgtgggcatttggatttctcatttgcatcagcgtggcaccctgatggtgtcacttttgctactggaaaccaggacaaaacctgccgggtttgggatgtccgaaatttatccaagtcagttgctgttctgaagggcaaccttggagccattcgatcaatccgctatacttccgatggtcagtacatggcaatggcagagtctgctgacttcgtgcatgtctatgatgtgaaaaatggatacgagaaggaacaggagattgatttctttggcgagatatccggtgtatcattcagtccggacaccgagtctctttttattggagtgtgggatcgtacatatggtagcctccttgagtatggccgatcccggaactattcataccttgatgcccgagaccagtcaaaaagggaactagcaaaggactcaacaagctgacttcagtgctatgacaccagtttaaaaaggttgggtttcatgttgtagcacagaaagtaagtgcaagcaatgcaggacagagttattgggtaagttactagatagtagctgaccgtcataatggcagattggtatggacacgacaactggctgagtagagggtttcacctgcatcctgtagaaaaattacaatcggcatcttaatcaagacgaagaagcagtaatagatttgatgatcacaaacttcttactataatcaatagagctatagaagctcaaatatgccatggaaaaaagttcctttctgtacttctttac

SEQ ID NO: 1831 - DNA, 2444 bp, Quercus alba
acccaccttctctctctcttcctttctctctcctcctccccctcgcgatccaatacccaaacaatttatatattaatttccaatttgggttcctcaaattaattaatatatataaaaaaataaagcttttgttataatatatatacctaataaattaatcttgctgacgaggatgcttttcattttgtgagagtttgggatttccagatccatatagctttctctaaccctcaatctcaaaaaggtgggaaattgttagaaagaacatgtcccaataccaagcggatgatgctgaatacatggcggatgaatatgaaatggaagatgtagatgatgagatggatgatgagtttcgtggtagagacatggctggctcagagtctgatgttgatgaatacgaccacgggaatagcaaagcagctgatactactgctgctcaagctagaagtgggaaagatatccagggaatcccttgggataggcttagcatcactagggagaaataccggcaaactaggcttgaacaatacaagaactatgaaaacatccctcagtctggagaggggtctgggaaggattgcaaagttacaaagaaagggggttcatattatgagttcaggcggaattcaagatctgtgaaatcaaccattcttcattttcagttgaggaacttggtttgggctacctcaaagcatgatgtctaccttatgtctcatttttctgtcgtccattggtcctccttaaattgcagcaggcaagaagttctgaatgtctcagggcatgtcgcgccatcagagaaacatcctggaagtttgttggagggatttacccagactcaagtgagtactctctctgtaaaagataagctactagttgctggaggattccaaggagaacttatttgtaagcatctggatcggcctggagttagtttttgttccaggacaacttatgatgataatgctatcaccaatgctgtcgagatttacgtcagcgccagtggtgcagttcactttacagcttcaaataatgattgtggagttagagactttgatatggagaaatttcaacttactaagcacttccggtatccttggccagtgaatcatacttctctgagtcctgatggtaaacttcttacaattgtgggagacaacccagacggtatgctggtggattcccaaactggaaagacggtcaagtccttgtgtgggcacttggatttctcatttgcatcagcatggcaccctaatggtgtcacttttgcaactggaaaccaggacaaaacctgccgggtttgggatgtccgaaatttatccaagtcagtcgctgttctgaagggcaaccttggagccattcgatcaatacgctatacttctgatggtcagtatatggcaatggcagagcctgctgactttgtacatgtctatgatgcaaaaaatggatatgagaaggaacaggagattgatttctttggcgaaatatctggcgtatcattcagtccagacacagaatctctttttatcggagtgtgggatcgtacatatggtagcctccttgagtatggtagatgccggaactactcataccttgattctctaatttgagtttaatgtgaaacctgcaaataagtgtgttggtgttgctgattacctttcagcaaaattgaaaaacctagtatcatatcatgcagttggaaaagggggtagttgtatattttttatgttgtgcaatgtagcaaagttgttctcttttggtgtaagtctggattttcatcataaagtgtgtaaaagggaggaaatgtaaagaaggctagaaggcaacgattgtggcaacaagggaaaagaaaaccagtgtgtcttagggtagatggctgggtactatccttcatgtatgttagaaatttactttatgagaaccgagctttgtggtgcttaccaaagatgtgggctgctttctttctcatcatcccaaatgttggttctttcatctcccaattctgacttcagtatagctcagtgtgtacccaatcttgtggtgcttaccaaagatgtgggctgttttctttctcatcatcccaaatattggtccgtcatctcccaattctgactttcaatataatagctcagtgttccccatcttgaattaggttcgcttagaccagctgaattccttttgaaggagctcagctttactaacctattttatatcttggtctcgtgttttgtatggatatatggtttagaaatatttccttttccctataataaaaatgtaggcattggtttgaatcatccagctgcattatgatgctaaatgaccgttcttcttatgttcttaagtgtacatgtgaacatttttgtaaaaatgtatttgttaaagcaaatggagcgtgaatatcttcgattcaaaaaagttaaaattaatcgcgatctagaactagt

SEQ ID NO: 1832 - DNA, 1794 bp, Lippia dulcis
ccaaaaattttcgcttattgatttatacaatcaattcgatcaatcttgtcgagtttaatatctgattaaacctctcaccaataattgcgtgatcgattttggaggagctttcgtggaactttcttctttttttttcctcttcctttcgacgattttgggaaggtctctttccctgtagatcatgtcccatcagttagctaatgaggctgatgacatggaagatgaatacgaaatggaagatgcagatgatatggatgaagaggcccatggtagagatgctggcggctcagactctgatatggatgaacatgatgacctgaataattcagtgcatgataccacagccgctcaagctagaaatggcagagatattcaagggattccctgggagaggctcagcataacaagagaaaaatataggcagactagactagaacaatataaaaattatgagaacattcctcaatctggagaaggatcagagaaggaatgcaaagccactgagaaaggagccttattctatgacttcagactaaattcaagatctgtgagatcaacgatatttcattttcagttgagaaatttggtatgggctacatcgaagcatgatgtttaccttatgtcgcatttctcggttatgcattggtcaacattaaaacgcaccaagtctgaaattcttaatgtctcaggacatgtagcaccttgtgagaagcatcctggaagcttattggaaggatttacgcagacccaggtcagcacacttgcagtgagagataacttgctagttgcaggaggatttcagggggaacttatctgcaagtatctagataggcctggagtttcttactgcacacggaccacctatgaagataatgccattactaatgcggttgagatatatactgctaacagtggtgcagtgcattttatagcttcaaacaatgacagtggagttagagacttcgatatggaaaaatttcaacaggctaatcattttcgttttccatggccagttaatcatacatctctaagtcctgacagtaagcttctcataattgttggagatgatccagaaagcatattggttgattcgaggagtgggaaggaaattgcatccttgcacggtcacctagattactcatttgcatctgcatggcatcctgacggcttaacctttgctactgggaaccaagacaaaacctgcagagtttgggatattcgaaacctttccaagtcagttactgccttaaaaggaaacctaggcgcaattcgctccatccgctatacatctgatggcagattcatggctatggcagaaccggccgactttgtccatgtttttgacgttaaaaatgggtatgagcaggagcaggaaatagatttctttggtgagatatctggcatgtcatttagtcccgatacagagtcgcttttcattggggtgtgggaccggacatacgggagtctcctcgagttcaatagacgcagagagtactctttcctggactgtattatctaagacagctgcctgttttgcatgttgtggatacaggtcccaggtgtatagtcgtcattttgtgtcttagttttagtggcttgtttgagtgttagttaataagttgtggagaggatgaggggtgtaaagttagagagtagaggagtgagtggtagatgatgcatatcatagtagaatttgtcattgcctgtgtgattcagttgaggttttcagttgagtccgattgaattgactggcaatccaactggatttgttaacaagttgtattttaaactttt

SEQ ID NO: 1833 - DNA, 2098 bp, Gossypium raimondii
atgtaagaaggccctaagtcactccatttatatgagtatagatattttgatctgcagatcgtcggtaatcaccttccagtaagaatctcttacattttaaaaggtcaattctctcgctttttattttttattttcttgttcgcttttgcattcttcgatctcgagtcagttttctttatgtgatcatttctgtttatcgcttcataggtgtagttttgtctggtggaatatgtcctattaccaagaagatgatgctgaatacatggcagaagagtatgacatggaggacatagatgacatggatgaagagttctgcggcagagatatgtctggctcggagtctgatgttgatgaatatgattactcgaataataaaatatctgatacttctgctgctgaagctagaagaggaaaagacatccagggaataccttgggatcagctaagcatcactagggaaaaatacaggcaaactaggctagaacagtacaagaactatgagaatatcccccactctggggaagtgtcagggaaggattgcaagattaccaagaagggtgcatcatactatgacttcaggctaaattcaagatctgtgaaatcaacaatacttcattttcagttgaggaacctggtatgggctacatcaaaacatgatgtttatctcatgtcacaattttctgtcatgcattggtcttcattgacacacaagaagcgtgaaattcttaatgtttctgggcatgtggcaccatctgagaaacatcctggaagtctgatggaaggttttacgcaaactcaagtcagtactcttgcagtaaaggataagctgctagttgctggaggattccagggtgaactaatatgtaagcatttagatcgacctggaataagcttctgctccaggacaacttatgatgacaatgccattacaaatgctgttgagatttatgtcactccaagtggcgcagttcactttacggcctcaaataatgactgtggagtcagagattttgatatggagaaatatcagctttccaagcattttcattttctttggcctgtcaatcatacttctctgagccctgatgggaaacttctaataatagttggagacaaccctgatattatgttggtagactctgatacagggaagactgttatgcccttgcgtggacacttggacttttcatttgcgtcagcatggcatcctgatggtgtcacttttgcaaccgggaaccaagacaaaacatgccgaatttgggatgttcgaaacttgtcaaagtcaattgctgttctaaagggaaaccttggagcaatacggtccattcgctacacatctgatggtaagtacatggccatggctgagcctgctgactttgtgcatgtgtatgatgtcaaaagtgggtacgagaatgagcaagaaatcgatttctttggtgagatatccggcctatcctttagtccggacacagagtctctctttattggcgtatgggatcgtacatatggcagccttcttgagtatagccggcagaggaactacttatatcttgattccctaatgtgagttgattgtgatgcaggcaaaacaagtatgttggtgtagtttatgatatttgaggaacttgtatcatttcaagctgtagaagagggtttactgtagatgtaaatgtaaaatgaaacgaattatgtaactttaggtgattgctgttgaattagaatttagttttctgatggtataagatgttaatgggagagggtagaattagatagtgttcttaatttgaacaagagtgatagacgtgtatggtttcgtttggtggggagctacacactttacaggttttaaatttgaatttatgaacagtggaattgactcaactaagattcctgtactagtatacccaaatatattaaccaaaaaatagtgataaatacccaaatatattaaattaaaatagtgataaataattaaagaagtaattttttagatttgtccatgattgaggctttagctttgctcagcatgtaaccttaagactcaatgctcaacttcgacaactgtttaacagtcgacaatgataaaggaataaccgac

SEQ ID NO: 1834 - DNA, 1923 bp, Malus domestica
gagataaaataatattacgcactctctcacctctttctctctctctctctctcctctcttctccctggatctgaacttcttaattagggtttgagatttcggtttctcaatttgggatttccagatcagaacagctgctccttccgagcttctcaattcccggaataacgaaagctgtggcattgttgggaagaatatgtcccattacgctggttatgtggaggatgaatacgaaatggaagatgtagatgatgatatggatgatgagtttcacggtagagaaatgggcgcctcagattctgatgttgatgaatatgactactcgaatagtaaagtagctgatacaactgctgctcaagcaagaaaaggaaaagacatccaaggtattccttgggatagacttagcattactagagagaaataccgacagactaggttagaacaatacaagaattatgagaatatccctaattccggagaaggatcagggaaggattgcaaagatacaaagaaaggatctgtatattatcagttcagacgaaatgctagatcagtgaaatcaaccattcttcattttcagttgcgtaacttggtctgggctacttccaagcatgatgtctacctgatgtcacatttttctgtcattcattggtcttcattaagttgcacaaagtctgaggttctcaatgtttctggacatgtggcaccatctgagaaacatcctggaagtctcttggagggatttacgcagactcaagttagtactctttctgtaaaagataagttgctagttgctggaggattccagggtgaacttatttgcaagcatcttgatcggcctggagtcagcttttgttcaaggacaacttatgacgataatgccataacaaatgctgttgagatttatgacagtcccagcggggcagttcactttacagcctctaacaatgactctggagtcagagattttgacatggagaaatttcagcttactaagcatttccgttacccttggcctgtgaatcatacttctctgagtcctgatggtaaacttcttgtgattgttggagacaatccggaagggatgttggtaaactctcaaactggaaagacggtgatgtctttaagtgggcacttggatttctcctttgcatcagcatggcatcctgatggtatgacctttgccactgggaaccaggacaaaacctgccggatttgggatgttcgaaacctttccaagtcagttgctgttttgaaggggaaccttggagctattcggtcaatccggtatacttctgatggtcagtatatgatgatggcagagcccgcagactttgtgcatgtctatgatgtgaaaagtgggtacgaaaaagaacaggaaattgatttctttggcgagatatctggcatatcattcagtccggacacggagtctctttttattggagtgtgggatcgtacatacggtagtcttcttgagtatggccgaagccggaactactcttaccttgattctcttatttgaccgacttcaataagaaagctgcgaataagggtgttggcgttgctcattcctcagtgcggttggtaacatatttcgtgcagtgggaagaggctttaggtgtaaatgtagtattatgtgcaattgtagctttgttgttgggtgtcccgtcttttttttttccccataaaaagtgtgtaaaagggagggatgtacagaaggccaaggcaatggtggtcgaaacaaatgggaaagaaggaccggtgtgtcttagggcgaaagacattggctgttttgcgttttagagattttatctcaatgtgggacttgtaatgtgagaaagaacctaccaatcatcttgttcgtttcttggatcccaagtgctgagtttgatatgattaaaagttcctgcctgctctgta

SEQ ID NO: 1835 - DNA, 1939 bp, Gossypium raimondii
tatataatggggaagatgggtaatatctattacgccccaatctattgccattcctctaaattcagtataattattttgaactgagatactctaccgtatatatatatttaaaaatgtaattttgatgctaatattttgatctccagatcgtcggtgaacaccttcccttaagaatctcatatgctttaaaaggtgtagttttgactggtggaatatgtcctattatcaagaagatgatgctgaatacatggcagatgagtatggcatggaggacatagatgacatggatgaagagttccgcgccagagatatgtctggctcggagtctgatgttgatgaatatgatttctcgaataacaaaatatctgatacttctgctgctgaagctagaagaggaaaagacatccagggaataccttgggatcggctaagcatcactagggaaaagtataggcaaactaggctagagcagtacaagaactatgagaatatcccccactctggagaagtctccgggaaggattgcaagattaccaagaagggtgcctcgtactatgacttcaggctaaattcaagatctgtgaaatcaacaatacttcattttcagttgaggaacttgatatgggctacatcaaaacatgatgtttatcttatgtcacgtttttctgtcatgcattggtcttcattgacacacaagaagcgtgaaattcttaatgtttctgggcatgtggcaccatccgagaaacatcctggaagtctgatggaaggttttacgcaaacacaagtcagtactcttgcagtaaaggataagctgctagttgctggaggattccagggtgaactaatatgcaagcatttagatcgacggggaataagcttctgctccaggacaacttatgatgacaatgccattactaatgctgttgagatttatgtcactccaagtggtgcagttcactttacggcctcaaataatgactgtggagtcagagattttgatatggagaaattccagctttctaagcattttcattttctttggcctgtcaatcatacttctctgagccctgatgggaaacttctaataatagttggagacaaccctgatattatgttggtagactctgatactgggaagactgttatgcccttgcatggacacttggacttctcatttgcgtcggcatggcatcctgatggtgtcacttttgcaaccgggaaccaagacaaaacatgccgaatttgggatgttcgaaacttgtcaaggtcaattgctgttctcaaggggaaccttggagcaatacggtccattcgctacacatctgatggtaagtacatggccatggctgagcctgctgactttgtgcatgtgtatgacgtgaaaagtgggtatgagaatgagcaagaaatcgatttctttggtgagatatccggcctatcctttagtccggacacagagtctctctttattggcgtatgggatcgtacatatggcagccttcttgagtatggccggcggaggaactacttatatcttcattccctaatgtgagttgattgtgatgcagtcaaaacaagcatgttggtgtagtttatgatatttgaggaacttgtatcattacaagttgtcgaagagggtttactgtagatgtaaatgtaaaatgaaacgaattatgtaactttaggtgattgctgttgaattagaatttagttttctgatgatataagatgttaatgggagaaagggtagaattagatagggttcttaagttgaacaaaagtgaaagacgtgtatggtttcctttgctggggagctacacactacaggttttaaatttgaatttatgaacggtggatttgactcaactaagattcgtatactagtatacccaaatattataaaaaatagtgatataattagaggatgtatttttagtta

SEQ ID NO: 1836 - DNA, 1817 bp, Gossypium hirsutum
gtctaaattcagtataattattttgaactgagataactctaccgtataaatatatttaaaatgtaattttgatgctaatattttgatctccagatcgtcggtgaacaccttcccttaagaatctcatatgctttaaaaggtgtagttttgactggtggaatatgtcctattatcaagaagatgatgctgaatacatggcagatgagtatggcatggaggacatagatgacatggatgaagagttccgcgccagagatatgtctggctcggagtctgatgttgatgaatatgatttctcgaataataaaatatctgatacttctgctgctgaagctagaagaggaaaagacatccagggaataccttgggatcggctaagcatcactagggaaaagtataggcaaactaggctagagcagtacaagaactatgagaatatcccccactctggagaagtctccgggaaggattgcaagattaccaagaagggtgcctcatactatgacttcaggctaaattcaagatctgtgaaatcaacaatacttcattttcagttgaggaacttgatatgggctacatcaaaacatgatgtttatcttatgtctcgtttttctgtcatgcattggtcttcattgacacacaagaagcgtgaaattcttaatgtttctgggcatgtggcaccatccgagaaacatcctggaagtctgatggaaggttttacgcaaacacaagtcagtactcttgcagtaaaggataatctgctagttgctggaggattccagggtgaactaatatgcaagcatttagatcgacggggaataagcttctgctccaggacaacttatgatgacaatgccattactaatgctgttgagatttatgtcactccaagtggtgcagttcactttacggcctcaaataatgactgtggagtcagagattttgatatggagaaattccagctttctaagcattttcattttctttggcctgtcaatcatacttctctgagccctgatgggaaacttctaataatagttggagacaaccctgatattatgttggtagactctgatactgggaagactgttatgcccttgcatggacacttggacttctcatttgcgtcagcatggcatcctgatggtgtcacttttgcaaccgggaaccaagacaaaacatgccgaatttgggatgttcgaaacttgtcaaggtcaattgctgttctcaaggggaaccttggagcaatacggtccattcgctacacatctgatggtaagtacatggccatggctgagcctgctgactttgtgcatgtgtatgacgtgaaaagtgggtatgagaatgagcaagaaatcgatttctttggtgagatatccggcctatcctttagtccggacacagagtctctctttattggcgtatgggatcgtacatatggcagccttcttgagtatggccggcggaggaactacttatatcttgattccctaatgtgagttgatcgtgatgcaggcaaaacaagcatgttggttaagtttatgatatttgaggaacttgtgtcatttcaagttgtagaagagggtttactgtagatgtaaaatgtaaaatgaaatgaaatctgtaactttaggtgattgctgttgaattagaatttagttttctgatgatataagatgttaatgggagaaagggtagaattagataaggttcttaagttgaacaaaagtggaagacgtgtatggtttccttgggtggggagctacacactacaggttttaaaattgaatttatgaacggtggatttgactcaaaaa

SEQ ID NO: 1837 - DNA, 2011 bp, Prunus persica
aaaaaaaacaagcacgtccttttcgcaaggttcccttcaacctttctttctcattcgcacgacaatccgaaaaccagtggatagagataaaattcgcacacactttttcttccccccccccctcctacctccatctctatctatcttctctcttctcctccgatctgaatttcttggttagggttgggattcaatttctcaatttggggatttccagatccgaacagcagctccttccaaacttctcaattcccgaaaatacgagagttgtggcattgttaggaaaaatatgtcccattacgctgggtacgtggaagatgaatatgaaatggaagatgtagatgatgatatggatgacgagtttcgtggtagagaaatgggcggctcagattctgatgttgatgaatatgactacttgaatagcaaagcagctgatacaactgctgctcaagcaagaaaaggaaaagacatccaaggtattccttgggatagacttagcattactagagaaaaataccggcaaactaggttagaacaatacaagaattatgaaaacattcctaattctggagaagggtcagggaaggatggcaaagatacaaagaaaggatctttatattatgagttcagaagaaatgctagatcagtgaaatcaaccattcttcatttccagttgcgtaacttggtctgggctacttccaagcatgatgtgtaccttatgtcacatttttctgtcattcattggtcttcattacgttgcacaaagtctgaggttctcaatgtttcagggcatgtggcaccatcagagaaacatcctggaagtctcttggagggattttcgcagactcaagttagtactcttgcagtaaaagataagttgctagttgctggaggattccagggggaacttatttgcaagcatctggatcggcctggagttagcttttgttcaaggacaacgtatgatgataatgccatcacaaatgctgttgagatttatgacagtcccagtggggcagttcactttacagcctcaaataatgattgtggagtgagagactttgacatggagaaatttcagctcactaagcatttccgttttccttggccagtgaatcatacttctctgagtcccgatggtaaacttcttgtaatcgttggagacaatccggatggaatgttagtaaactctcaaactggaaagacagtaatgcctttatctgggcacttggatttctcgtttgcgtcagcatggcatcctgatggtatcacctttgctactgggaaccaagacaaaacctgtcggatttgggatgttcgaaacctatccaagtcagttgctgttttgaagggcaaccttggtgctattcggtcaatccgatatacttctgatggccggtatatgatgatggcagagccagcagactttgttcatgtctatgatgtgaaaagtgggtacgagaaggaacaggaaattgatttctttggcgagatatctggcatatcattcagtccagacacagagtcactttttatcggagtatgggatcgtacgtatggtagtcttctagagtatggccgataccggaattactcttacctcgattctcttatttgagttgaatattcaacctgcgaataagtgtgttggtgttgctgattcctcggtgcgattgcagagcttagtgtaaaacatatttcatgcagttgaggagggtgtaggtgtaaatgtagtattttgtgcaattgttgctctgttttggtgttccgtcttttttcccccttaaatgtgtgtaatagggaggaatgtacagaaggctaaggcaatgatggtccaaacaaataggaaagaagaccagggtgtcttaaggtgaaacaagttggctgtttaccttttagaaattttatctcaatgtgggacttattatgtgagaacctatcaatcatctggttgagtttgatattcctgtctaatttggaaattgaaagttactgtctgttctgtagcttc

SEQ ID NO: 1838 - DNA, 1954 bp, Fragaria vesca
acgtccttttcgtatggttcccttccacctttctcattcgcacgaaaacaatccactggttttgattagataaatcaatctcccccaaatcttccatctctatcttttctctctctctctttctggatctcaattaggttttcttcaatttcggatatttccagatccgaacggctgcttgttcaattccgctgaaaagttgttgattgttgggaagaatatgtcccactacgcgggttacgtggaagacgaatatgaaatggaggatgtagatgatgatatggatgacgaatttcgtggaagagacctggctggctctgagtctgatgtcgatgaatttgactacgcgaatagtaaagtagctgatacaactgctgctcaagcaagaagaggaaaagacatccaaggcatcccttgggatagacttagcattactagagagaaataccggcaaactaggttagaacaatacaagaattatgaaaacattcctaattccggagaagggtctgggaaggattgcgacattactaagaagggatctacatattatgagtttagacgtaacgcaagatcagtgaaatcaactattcttcattttcagttgcgtaacttggtctgggctacttcaaagcatgatgtctaccttatgtcacatttttctgtcattcattggtcttcgataagttgcagcaaatctgaggttctaaatgtttcaggacatgtggcaccatcagagaaacatcccgggagtctcttggagggatttacacagactcaagtgagtactcttgcagtaaaagacaaattgctagttgctggaggattccagggagaacttatttgtaagcatcttgatcggcctggagttagcttttgttcaaggacaacatacgatgaaaatgccattacgaatgctgttgacatttatgacagtcccagcggtgcagttcactttacagcatccaataatgattgtggagtcagggacttcgacatggagaaatttcagctttctaagcatttccgttttccttggccagttaatcatacttctttgagtcccaatggcaaacttcttgtgattgttggtgacaatccagatgggatgttggtggattctcagactggaaagactgtgagggctttatctgggcacttggatttctcgtttgcatcagcctggcatcctgatggtgttacctttgctactgggaaccaggacaaaacttgtcgggtttgggatgttcgaaacctatccaagtcagttgctgttctaaagggaaatcttggagctattcggtccattcgttatacttctgatggacggtatatgatgatggcagagccagcagactttgtgcatgtctatgatgtgaaaagtgggtatgagaaggagcaggaaattgacttctttggtgagatatctggtatatcattcagtccagacacggagtcgcttttcattggagtgtgggatcgtacgtatggtagtcttctcgagtatggacgacgccgggattactcttatttagattctcttatttgagttgaatgagcaacctgcgaataagtgttttggtgttgctgattcttcattgtaactgcaaagcctagtagcataattgacgcagttgaagaagaggtgtaggtgtacattagtatcaccgtgtaacttagtgttgtttgttgttccaattatccataaagtgtgtacaagggggaaatgtacagaaggctatggccagaatgttccaaacaaatagggaagaccagggtctttagggtgcaagtgttgttgtctgtttacctttagaaatttatccatatatgagacctgttatgtgagaactgagaacctataagtcatctacatggtttcttggattctaaacgatgtgttttgtgttcgatgtaattttgaaatcgaaatgtcctctgttgcttaacattc

SEQ ID NO: 1839 - DNA, 2066 bp, Lactuca sativa
catgtagtcatccaagaataagattaaacggcgtttagatttggtgggtgaaataacggttattggtaaggggtaaaatgggcgggattggtgagcagatatcaaaggatcagatgatctaaacaaatctctttccgacgttcttcaatttcccctcaatattgattagatgtcgttttgcccaaccactagatacagatagatacccttctccccctccccccctctctctctctcttgattttcttcaaaaacctatcagacaatatccgccggtggtttcatgatttcgtgtttataaatcataatctgataccgaattgttcgattaaacagacttcagttgtcattttgctcctccaaatcggaaaaagagatcatgtcacatcagcaagaagatgatgagtacatgggtgatgaatatgaaatggaagatgtagatgataacatggaggaggagtttcatggtagagatgttgggtcatactctgatgtggacgaatatgattacatgaataataagttggcagatacatgcgctgcccaagcaagaagaggaaaagatattcaaggtattccctgggaaaggctgagcatcactagggacaaatataggcaaactagacttgaacagtataagaactatgaaaatattcctcagtctggggaggcttcagaaaaggcatgcaaagtcaccaacaaaacagtcctgtactacgactttagacggaattcaagatctgtaaaatcgacaatacttcactttcagttgagaaacctagtatgggctacatcaaagcatgatgtgtacctaatgtcacgtttttctgtcatccattggtcctccttaacttgcaacaagtctgaagtccttaatgtatcagggcatgtggcaccatgtgagaaacaccctggaagtctgctggagggatttactcagacccaagttagcacaatggcagtaaaagataatttgctagttgctggaggattccaaggagaacttatatgcaaggcaagatctagacctggagtttgcttctgcttgaggacaacttacgatgataatgctattacaaatgctctagacatttatactaccccaagtggtgcagttcattttacagcctcaaacaatgattgtggagttcgcgaattcgatatggaaaattttcagatgactaagcactggcgttttccttggccggtcaatcatacttccattagccccgatggaaagcttcttataattgttggagacagtcctgaaggaatgttggtggactcgagctccggaaagacggttgcatccttgcacggacacttggatttctcgtttgcatcagcatggaatccggatgggtatgggtttgcaacagggaaccaggacaaaacctgtagagtttgggatatcagaaacatatcaaaatctataacctctttaaaagccaatcttggagccattagatccatccgttactcatcagatggtcgcttcatggcaatggcagaacctgctgactttgttcatgtgtttgatgtcagagacggctgttatgacaaggaacaggaaattgatttttttggtgagatatctggcacttcattcagtcccgataccgactctcttttcataggagtatgggatcgcacgtatagcagtctcctcgagtttggccgcagacacaattactcttacttggattccctaatttgattttcatcctgtatcctatcattttttttctcctcaagcctcaagcctcaaacaaacacaaacatgtcatgtatcatgtgtctgtagattattaatgtatacaaccaactgtacagaagaagaagatgaacaaaaagaggaagcaagtggctgctactaaagataagatacccactcaaaccaaattaattagctactagctagggatttttaacttaacttatcttttatatgttacaaataccaccatattattttattattaatattaatgttatatatataacttgtatacatataacttgtttgcatttgccttcacctttttaatcaacttccattgtaatgg

SEQ ID NO: 1840 - DNA, 1883 bp, Gossypium hirsutum
gtgtagttttgtctggtggaatatgtcctattaccaagaagatgatgctgaatacatagcagaagagtatgacatggaggacatagatgacatggatgaagagttctgcggcagagatatgtctggctcggagtctgatgttgatgaatttgattactcgaataataaaatatctgatacttctgctgctgaagctagaagaggaaaagacatccagggaataccttgggatcagctcagcatcactagggaaaaatacaggcaaactaggctagaacagtacaagaactatgagaatatcccccactctggggaagtgtcagggaaggattgcaagattaccaagaagggtgcctcatactatgacttcaggctaaattcaagatctgtgaaatcaacaatacttcattttcagttgaggaacctggtatgggctacatcaaaacatgatgtttatctcatgtcacaattttctgtcatgcattggtcttcattgacacacaagaagcgtgaaattcttaatgtttctgggcatgtggcaccatctgagaaacatcctggaagtctgatggaaggttttacgcaaacccaagtcagtactcttgcagtaaaggataagctgctagttgctggaggattccagggtgaactaatatgcaagcatttagatcgacctggaataagcttctgctccaggacaacttatgatgacaatgccattacaaatgctgttgagatttatgtcactccaagtggtgcagttcactttacggcctcaaataatgactgtggagtcagagattttgatatggagaaatatcagctttccaagcattttcattttctttggcctgtcaatcatacttctctgagccctgatgggaaacttctaataatagttggagacaaccctgatattatgttggtagactctgatacagggaagactgttatgcccttgcgtggacacttggacttttcatttgcgtcagcatggcatcctgatggtgtcacttttgcaaccgggaaccaagacaaaacatgccgaatttgggatgttcgaaacttgtcaaagtcaattgctgttctaaagggaaaccttggagcaatacggtccattcgctacacatctgatggtaagtacatggccatggctgagcctgctgactttgtgcatgtgtatgatgtcaaaagtgggtacgagaatgagcaagaaatcgatttctttggtgagatatccggcctatcctttagtccggacacagagtctctctttattggcgtatgggatcgtacatatggcagccttcttgagtatagccggcagaggaactacttatatcttgattccctaatgtgagttgattgtgatgcaggcaaaacaagtatgttggtgtagtttatgatatttgaggaacttgtatcatttcaagctgtagaagagggtttactgtagatgtaaatgtaaaatgaaacgaattatgtaactttaggtgattgctgttgaattagaatttagttttctgatggtataagatgttaatgggagagggtagaattagatagtgttcttaatttgaacaagagtgatagacgtgtatggtttcgtttggtggggagctacacactttacaggttttaaatttgaatttatgaacagtggaattgactcaactaagattcctatactagtatacccaaatatattaaccaaaaaatagtgataaatacccaaatgtattaaattaaaatagtgatcaataattaaagaagtaattttttagatttgtccatgattgaggctttagctttgctcagcatgtaaccttaggacacaatgctcaacttcgacaactgttgaacagtcgacaatgaaaaaagaa

SEQ ID NO: 1841 - DNA, 2178 bp, Theobroma cacao
gtctctcgagttctcgcgatcccccgtctaattatcatcatagtatattttattatttttattatttatttattgtaatattaccatattaatcgaaggacaattgggattttgtatatgaaagccccttttttttttttatgtcgactaaaataattacgaaatatttatatatgtatttatttcttaaaaagatgcaattctgatgctgatattttcatctccagatcggaggagaggaccagcttccccacaatctcttgttttttaaaaagagaatatgtcccactaccaagaagattatgctgaatacatggcagatgagtatgacatggaagacatagatgatgacatggatgaagagtttcgtggcagatatatgtctggctcggactctgatcttgatgaatatgactacatgaataataaaatatctgatacttctgctgctcaagctagaagaggaaaagacatccagggaattccttgggatcggcttagcatcactagggaaaaatacaggcaaactaggctagaacagtacaagaactatgagaatatccctcactctggagaagggtcagggaaggattgcaaaattacccagaagggtgcgtcatattatgacttcagacttaattcaagatctgtaaaatcaacaatacttcattttcagttgaggaacttggtatgggctacatcaaaacatgatgtttatcttatgtcacatttttctgtcatgcattggtcttcattggcacaccgcaagcatgaaattcttaatgtttctgggcatgtggcaccatctgagaaacatcctggaagtctgatggaaggttttacacaaactcaagtcagtactcttgcggtaaaagataacctcctagttgctggagggttccagggtgagctaatatgcaagaatttagatcagcctggaataagcttttgttccaggacaacttatgatgacaatgccattacaaatgctgttgagatttatgtcactccaagtggtgcagttcactttacggcctccaataatgactgtggagtcagagattttgatatggagaaatatcagctgtctaagtattttcattttctttggccagttaatcatacttctctgagtcctgatgggaaacttctaataatagttggggacaaccctgatggtatgttagtggactctagcacggggaagactgttatgcccttgcatggacacttggacttctcatttgcatcagcatggcaccctaatggtgtcacttttgccactgggaaccaagacaaaacttgccgaatttgggatgttcggaacttgacaaggtcagttgctgttcttaagggaaaccttggagcaatacggtccattcgctacacgtctgatggtaagtacatggcaatggctgagcctgctgactttgtgcatgtgtatgatgtgaaaagtgggtatgagaatgagcaagaaatcgatttctttggggagatatctggcctatcctttagtcccgacacagagtctctgtttatcggtgtatgggatcgtacatatggtagccttcttgagtatggtcgtcggaggaactactcataccttgattccctaatttgagttgattatgctgtctgcaaaataagcatggtgttgtggctgttgttgatggtattggacgaacctaataacattctaagctgtagaagttgtagatgtaaatgtaagatgtattctgtaattgtaggttattgctgttcaattagatttttattttctgcaaaacttgtgggggtcaatcagcataagatgctaatgggagggggatgtacagatggctggaaaagcccgttcatgtgaagaggagaatgaaagagtagtatggtttccttgggagctagacaattttatgagtggtttgctgtgtgtcttttctccccgcacttctttcctcttactctctttttaaatatgattaaggattcaaatgaggatgattgcggttatcaatcgatttctttgagtttgcattatgtttgacttaatcccattacctagatacaaataatgtagttttttttttttgtatttaggagaagggttttgaattttactctttaggcaaaggattatgtataaccaatgagcttgagcttgaatgaaatttcaaaacttga

SEQ ID NO: 1842 - DNA, 1363 bp, Cucumis sativus
gatacgtgtgtgaacttttgtacctaatatgtcccattatcacgaggatgatactgattacatggctgatgagtacgaaatggaagacattgacgatgatatggatgatgagtgtcatgatagagaagacgaaggctcagattctgatgctgatgaattcaactcgagtagtagaatagtcgataccactgcagctcaagcaagaagaggaatagacattcaagggattccttgggagagacttagcattactagagaaaagtacaggaaaactaggcttgagcagtacaagaactatgaaaatatccctaattcaggagaagggtcagagaaggattgcaaggttactgataaagcatgctcatactatgaattttgccgaaattcaagatctgtgaaatccaccattcttcactttcagttgaggaacttagtatggtcgacatcaaaacatgatgcataccttttatcaaatttttctgtaattcattggtcatcattatcgtacacgaagtctgacgtactcaatgttgcgggacatgtggcacctacagagaagcacccaggtagcttattagagggatttacacagacacaagtcagtacacttgcagtgaaagataagctacttgttgctgggggatttcagggagagcttatttgcaagcatctagaccgcccaggcgttagtttttgtttcagaacaacttatgatgataatgctataactaatgctgttgagatatacactagcgctagtggtgcaattcatttcactgcttcgaataatgattctggagtccgagattttgatatggagaaatttcagctttctaagcacttttgttttccttggccggttaatcatgccgctttgaatccagatggtaaacttcttgtgattgttggtgacaatcctgaaggcttattggtggactcacaaactggaaagacagttgcatctctaagtggacacttggatttttcatttgcatcagcatggcattccgatggcattacctttgccactgggaaccaggacaaaacttgtaggatttgggatgtaagaaatttatcaaagtcagttgctgctctgaaaggcaaccttggagccattcggtccatccgctattcctctgatggtcggtacatggcaatggcagaacctgcagactttgtgcatgtgtttgacgttaaaagtgggtatgagaaagagcaagaaattgactttttcggagaaatctccggtgtatcatttagtccagacacagaatcacttttcattggagtatgggatcgaacatatggtagccttcttgagtaccacagacgcagaaattacagttacctagattcgttgtat

SEQ ID NO: 1843 - DNA, 1796 bp, Populus trichocarpa
tatttagctctgatattttatatttcctctctagatcgacaaaaggagctccctttctccaatcctcaaagttgcaactctcacccgcagggtaggtggaattgttagaaaaatatgtcccattaccaaggggatgatgctgaatacatggaagatgaatatgaaatggaagatgttgatgatgacatggatgaagagtttcgtgctagggagatgggctcagactctgacattgatgaatatgactacctgaataataaagtagctgatacatctgctgctgatgctagaaatggaaaagacattcagggaattccttgggagagacttagcatcactagagataaataccggcaaaccaggctagaacaatacaagaactatgagaatatacctcactctggggaagattcaaaaaaggattgcaaaattactgaaaaggggggcatgtattatgagttcagacgaaattccagatctgtcaaatctaccattcttcattttcagttgaggaacttggtttgggctacaacaaagcatgatgtctaccttatgtcgcatttctctgtcattcattggtcttccttaacttgcagcaaggctgatgttcttgatgtttctggacatgtggcaccaactgagaaacatcctggaagtctgttggaaggattcacgcagactcaagttagtactctagcagtgaaagataatttgctagttgctggagggttccagggagagcttatttgcaagcatctagatcggcctggagtaagcttttgttccagaacaacttatgatgataatgctatcaccaacgctgttgagatctatgatagtccaagtggtgcagtgcactttactgcttcaaacaatgaccatggagttagagattttgatatggagaaataccagctctcaaagcattttcgttttccttggccagtgaaccatacttcccttagtcctgatggaaagcttctaacaattgttggcgacagcccagatggtatgttggtggactccagttctgggaagacagtgacatccttgtctgggcatctggatttctcatttgcatcagcatggcatcccgatggggtcacttttgctactgggaaccaggacaaaacatgccgcatttgggatgttcggaacctgtccaagtcacttgctgttttgaagggcaatcttggtgcaattcggtcaattcgatacacatctgatggccaatatatggcaatggctgagcctgcagattttgtgcatgtttatgatgtgaaaaatgggtatgaaaaggagcaggagattgatttctttggcgagatatctggtgtgtcattcagtcctgacacagaggctctttacattggagtgtgggatcgcacatacggtagtctccttgagtatggccgttgccggaactattcataccttgattcctttgtttgagttgcttgaagaaatgtgtgttggtatggttttttccccttgatgcaattgaggaacctaataaaaccatataatgtagaaggaggtttaggtgtatattgtattactattgtggaattttaggttctcgtggttctattagtcttggtgccaccgttgttgttgggttattataagatgtgtagaaaggagggaatgtacagaaggctagaatgtataattcaatgtgaacaatagcatggaattgaacttctgcttcttcaggtagatgattttttctatctgctgtccaatgtaatcttatttctcgtgatatccagtctttctgatctgtttcctttcca

SEQ ID NO: 1844 - DNA, 1785 bp, Gossypium hirsutum
cgccccaatctattgccattcctctaaattcagtataattattttgaactgagatactctaccgtataaatatattaaaaatgtaattttgatgctaatattttgatctccagatcgtcggtgaaaaccttcccgtaagaatctcatatgctttaaaaggtgtagttttgactggtggaatatgtcctattaccaagacgatgatgctgaatacatggcagatgagtatggcatggaggacatagatgacatggatgaagagttccgtgccagagatatgtctggctcggagtctgatgttgatgaatatgatttctcgaataacaaaatatctgatacttctgctgctgaagctagaagaggaaaagacatccagggaataccttgggatcggctaagcatcactagggaaaagtataggcaaactaggctagagcagtacaagaactatgagaatatcccccactctggagaagtctccgggaaggattgcaagattaccaagaagggtgcctcatactatgacttcaggctaaattcaagatctgtggaatcaacaatacttcattttcagttgaggaacttgatatgggctacatcaaaacatgatgtttatcttatgtcacgttttctgtcatgcattggtcttcattgacacacaagaagcgtgaaattcttaatgtttctgggcatgtggcaccatccgagaaacatcctggaagtctgatggaaggttttacgcaaacacaagtcagtactcttgcagtaaaggataagctgctagttgctggaggattccagggtgaactaatatgcaagcatttagatcgacggggaataagcttctgctccaggacaacttatgatgacaatgccattactaatgctgttgagatttatgtcactccaagtggtgcagtacactttacggcctcaaataatgactgtggagtcagagattttgatatggagaaattccagctttctaagcattttcattttctttggcctgtcaatcatacttctctgagccctgatgggaaacttctaataatagttggagacaaccctgatattatgttggtagactctgatactgggaagactgttatgcccttgcatggacacttggacttctcatttgcgtcagcatggcatcctgatggtgtcacttttgcaaccgggaaccaagacaaaacatgccgaatttgggatgttcgaaacttgtcaaggtcaattgctgttctcaaggggaaccttggagcaatacggtccattcgctacacatctgatggtaagtacatggccatggctgagcctgctgactttgtgcatgtgtatgacgtgaaaagtgggtatgagaatgagcaagaaatcgatttctttggtgagatatccggcctatcctttagtccggacacagagtctctctttattggcgtatgggatcgtacatatggcagccttcttgagtatggccggcggaggaactacttatatcttaattccctaatgtgagttgattgtgatgcaggcaaaacaagcatgctggtgtagtttatgatatttgaggaacttgtatcatttcaagttgtagaagagggtttactgtagatgtaaaatgtaaaatgaaatgaaatctgtaactttaggtgattgctgttgaattagaatttagttttctgatgatataagatgttaatgggagaaagggtagaattagatagggttcttaagttgaacaaaagtgaaagacgtgtatggttcccttgggtggggagctac

SEQ ID NO: 1845 - DNA, 1679 bp, Gossypium hirsutum
aggtgtagttttgtctggtggaatatgtcctattaccaagaagatgatgctgaatacatagcagaagagtatgacatggaggacatagatgacatggatgaagagttctgcggcagagatatgtctggctcggagtctgatgttgatgaatatgattactcgaataataaaatatctgatacttctgctgctgaagctagaagaggaaaagacatccagggaataccttgggatcagctaagcatcactagggaaaaatacaggcaaactaggctagaacagtacaagaactatgagaatatcccccactctggggaagtgtcagggaaggattgcaagattaccaagaagggtgcatcatactatgacttcaggctaaattcgagatctgtgaaaccaccaatacttcattttcagttgaggaacctggtatgggctacatcaaaacatgatgtttatctcatgtcacaattttctgtcatgcattggtcttcattgacacacaagaagcgtgaaattcttaatgtttctgggcatgtggcaccatctgagaaacatcctggaagtctgatggaaggttttacgcaaactcaagtcagtactcttgcagtaaaggataagctgctagttgctggaggattccagggtgaactaatatgtaagcatttagatcgacctggaataagcttctgctccaggacaacttatgatgacaatgccattacaaatgctgttgagatttatgtcactccaagtggcgcagttcactttacggcctcaaataatgactgtggagtcagagattttgatatggagaaatatcagctttccaagcattttcattttctttggcctgtcaatcatacttctctgagccctgatgggaaacttctaataatagttggagacaaccctgatattatgttggtagactctgatacagggaagactgttatgcccttgcgtggacacttggacttttcatttgcgtcagcatggcatcctgatggtgtcacttttgcaaccgggaaccaagacaaaacatgccgaatttgggatgttcgaaacttgtcaaagtcaattgctgttctaaagggaaaccttggagcaatacggtccattcgctacacatctgatggtaagtacatggccatggctgagcctgctgactttgtgcatgtgtatgatgtcaaaagtgggtacgagaatgagcaagaaatcgatttctttggtgagatatccggcctatcctttagtccggacacagagtctctctttattggcgtatgggatcgtacatatggcagccttcttgagtatagccggcagaggaactacttatatcttgattccctaatgtgagttgattgtgatgcaggcaaaacaagtatgttggtgtagtttatgatatttgaggaacttgtatcatttcaagctgtagaagagggtttactgtagatgtaaatgtaaaatgaaacgaattatgtaactttaggtgattgctgttgaattagaatttagttttctgatggtataagatgttaatgggagagggtagaattagatagtgttcttaatttgaacaagagtgatagacgtgtatggtttcgtttggtggggagctacacactttacaggttttaaatttgaatttatgaacagtggaattgactcaaaaa

SEQ ID NO: 1846 - DNA, 2010 bp, Euonymus alatus
gccgggggttttcatcgttttctttcactcgctctcgctgtatattatccttctcttcctcttgatttctcgcgatcaaaaattattattatcctgttcctgataatttttgatccgcagatcgaagttgtggaattgtgggagaatatgtcccattaccatgcggaagatgctgaatatatggcggatgaatatgacatggaagatgtggaagatgatatggatgaagaattccgcggtagagatattggcggctcagactctgatgttgatgaatttgactactcgaataataaaatagctgatacttctgctgctgaagctagagagggaaaagacattcagggaattccctgggatagacttagcatcactagggagaaatacagacagactaggctagaacagtataagaactatgaaaatattcctcattctggagaagggtcaggcaaggactgtaaagttacgaagaaaggtggctcatactatgagttcagacgaaattcaagatctgtgaaatcaaccattcttcattttcagttaaggaacttggtttgggctacgtcgaagcatgatgtctaccttatgtctcattttactgttgttcattggtcttcattaacttgcacaaggtctgaagttctcaatgtgtcagggcatgttgcaccatccgagaaacatccgggaagcttattggaaggattctcgcaaacccaagttagtactcttgcagtaaaagaaaatttgctggttgctggaggatttcaaggagaacttatctgcaagcacctagatcggcctggagtcagcttttgttcccgaacgacttatgatgataatgccatcactaatgccgttgatatctatagaaaccccagtggtgcacttcacttcactgcttcaaataatgactgtggagttagagactttgacatggagaaatatcagctcactaagcatttccgttttccttggccagtgaatcatacctctctgagtccggatggtaaactccttatcattatgggagacaacccagatggcatgttggtggattctagtacaggaaagacagtaatgcccttacgcgggcacttagatttctcatttgcctcagcttggcgcccggatggtgtcacctttgctacagggaaccaggacaaaacctgccgaatttgggatgttcggaacctatcaaagtcgcttgccattttgaagggcaaccttggagctgttcggtccatccgatacacgtccgatggtcggtatatggcaatggctgagcctgcagattttgtgcatgtctatgatgccaaaagtggctatgaaaaagagcaggaaattgatttctttggggagatatctggcatatctttcagtccaggcacagagtctctttttattggagtgtgggatcgtacgtatggaagcctgcttgagtatggtcgctgtcggaactactcatacctggattctctaatttgagtctgaatgggtttaatctgcaaataagtttgtgtggttggttgttttacattatgcggttgaattgagaaaccccaaataatataccatgcattagaagctggtttaaggtgtacatgatgtgctattttttaggtcctttggtcttggtgccataaatccgttgttgttgggttctcttaagtggtgtaaaaggggaggagttgtacagaaggctggaagtactttcatcatgcataggagggaattgtattggaaactatttcctcacaaggaagaagacaatttcatggctgcatgtaatctttgtactttgttgtccgttttatttagaacatttctcaaagttggttttcttgagttcaaagtatatcttgatattggccctttttttctgtaaaacttttgctcttaacatttgggtttcactgttagttattgttgataaagctggtcggtaggtccgttaggttgtaaagaagcccagttttgtgcatcatatccttctcgaatttgatcgcc

SEQ ID NO: 1847 - DNA, 1854 bp, Cucumis melo
ttcgttcttctttccttctcaatttctcaaacagatcgtcaatcaatttgcaacgccacttctgagatacgtgtgtgaacttttgaacctaatatgtcccattatcatgaggatgatactgattacatggctgatgagtacgaaatggaagacattgacgacgatatggatgatgagtgtcatgatagagaagaggaaggctcagattctgatgctgatgaattcaattcgagtagtaggatagttgataccactgcagctcaagcaagaaggggaatagacattcaagggattccttgggagagacttagcattactagagaaaagtacaggaaaactaggcttgagcagtacaagaactatgaaaatatccctaattcaggagaagggtcagagaaggattgcaaggtgactgataaagcatgctcatactatgagttttgccgaaattcaagatctgtgaaatccaccattcttcattttcagttgaggaacttagtatgggccacatcaaagcatgatgcataccttttatcaaatttttctgtaattcattggtcatcgttatcgtacacgaagtctgacgtactcaatgttgcgggacatgtggcacctacagagaagcaccctggaagcttattagagggatttacacagacacaagtcagtacacttgcagtgaaagataagctacttgttgctgggggatttcagggagagcttatttgcaagcatctagaccgcccaggcgttagcttttgtttcagaacaacttatgatgataatgctataactaatgctgttgagatatatactagcgctagtggtgcagttcatttcactgcttctaataatgattctggagtccgagattttgatatggagaaatttcagctttctaagcacttctgttttccttggccagttaatcatgctgctttgaatccagatggtaaacttcttgtgattgttggtgacaatcctgaaggcttattggtggactcacaaactggaaagacagttgcatctctatgtggacacttggatttttcatttgcatcagcatggcattccgatggcattacttttgccactgggaaccaggacaaaacttgtaggatttgggatgtaagaaatttatcaaagtcagttgctgctctgaaaggcaacctcggagccattcggtctatccgctattcctctgatggtcggtacatggcaatggcagaacctgcagactttgtgcacgtgtttgacgttaaaagtgggtatgagaaagagcaagaaattgactttttcggagaagtctccggtgtatcatttagtccggacacagaatcgcttttcattggagtatgggatcgaacatatggtagccttctcgagtaccacagacgcagaaattacagttacctagattcgttgtactaagcaagtataaaaaagaaacaaacttgggaataagatgggtggtgaaaatgaacattgttttaattattaacatagtaacatgtagtggatatgttgttgtaatttgtaagtgtatatttagtgtgttgtggaaacaatagtcttatgtattattatatgatttgatgacactttggttttgaagagacagtttgagtaaatgctgaagggagtgtaaagaaaggctttgtgggagatgatgatgaatatatggccagggtgtcacctctttgcaaatcactttgttcacaatttttctcttcttcatcttcttttggtacaatgaccgcatgaacctcggttcgaaccaaatgacaagtcaattattgtcgagagtgcttcaaggatgaacgaagtctcccacattggtgtccatctttttca

SEQ ID NO: 1848 - DNA, 2037 bp, Aristolochia fimbriata
tccctttcctacttatttcttcagtggggggggggacaagccatttgctataaccagactcaccgtatttgctttcgtctttcgatttatcgcgatcgaggaccctctggctttagcgtatccggggtttttctatctagggcttctgcacatgcagatcgtcatctgagatcccgctgtcagcttcgattcatctggggagaagcacatattttgtggtaagatgtcccaataccaagcagaggatgtagaatatatggctgatgactatgagatggcggatgtggacgatgatatggatgaagaatttcgtggtagagggatgggtgactctgactcagaagatgaagattatgatcatttgaataacaaaataacagatacatcatccgcacaagctaggaaaggaaaggatattcaaggtatcccatgggacagactaagcatcactagagaaaaatacagacaaaccaggctggagcagtacaaaaattatgagaacattcctcaatctggagaggggtcagagaaggaatgcaaatcaaccacaaaaggtggctctttttatgagttccggcgcaatacgagatctgtgaaatctacaattcttcattttcagttgcgaaaccttgtttgggcaacatcaaaacatgatgtctatctcatgtcacacttttctgtcattcattggtctgcaataacgtgcaataaatcagaagttcttaatgtttctggacatgtggcgccatgtgagaaacatccgggaagcttactggaaggatttacccagacccaagttagtacactggctgtgaaggataagttgcttgtagctggcgggtttcagggtgagcttatctgtaagtatctggaccggcctggagtgagcttctgttgccggacaacttatgatgataatgctatcacaaatgctgttgatatatatgatagtcctagcggtgctgttcgtttcatggcttcaaacaacgattgtggggttcgagacttcgacatggagagatttcagctttgcaagcacttccgctttccttggcctgtaaatcacacctccttaagtccagatggtaagcttctcgtcattgttggagacaatcctgatgggatattggtagactcacgcactggcaagacaataagcccactttgtggtcatttggatttctcatttgcatctgcgtggcacccagatggccggacttttgcaaccggaaatcaggataagacttgccgcatttgggatgtgaggaacctctccgaatcagtggctgctcttaagggcaatttgggtgcaataagatccatccgcttcacatctgatggacagttcatggctatggcagagcctgctgacttcgttcatgtttttgatgtgcgaagtgggtacgaaaaggaacaggagattgacttctttggggagatatctggtgtatctttcagcccggacacggagtcattgttcataggagtctgggatcggacatatggtagtcttcttcaatatggccgaaaacggacttactcgtatctagatacacttctttgaggttatacggcgagtctcacagcacggttttaaaggggtcaggtgaggctcttggaacacatcccatccttgagacaggccattcctgcatgtagtaacatatctcgtgttaagagcgttctgagcgttctgaagcttaaggtgtataaagaggtggtgtacagatctcgataggttttactttcgccccatgtatcagaagacttctgtctgtgtgtaattcttttgttctaataagtttaggtgtaagtttgagttctttggtcactttcttcccctcatatttagagttaaacagggacaaacctcttaatatgtagaacagacttctttaagggaattgtgacattaccggatgcctatctcaatccccttctcttgtatggtttcttcttacttctcttcttgtttctcatgttgagttgctcgtgttatcttaaatgagcggctggtacatgattaagtgtttgcaa

SEQ ID NO: 1849 - DNA, 1754 bp, Euonymus alatus
aagttgtggaattgttgggagaatatgtcccattaccaggcagaagatgctgaatatgtggcggaggaatacgacatggaagatgtagaggacgatatggatgaggagtttcgcggtagagatatgggtggctcagactctgatgttgatgaatttgactactcgaataataaactagctgatacttctgctgctgaagcaagaaatggaaaagatattcagggaattccctgggatagacttagcatcactagggagaaatacagacagactaggctagaacaatataagaactacgaaaatattcctcattccggagaagggtcaggaaaggactgtaaagtgactaagaaaggtggctcatactatgagttcagaaaaaattcaagatctgtgaaatcaaccattcttcattttcagttaaggaacttggtttgggctacgtcgaagcatgatgtctaccttatgtctcattttactgttgttcattggtcttcattaacttgcacaaggtctgaagttctcaatgtgtcagggcatgttgcaccatccgagaaacatccgggaagcttattggaaggattctcgcaaacccaagttagtactcttgcagtaaaagaaaatttgctggttgctggaggatttcaaggagaacttatctgcaagcacctagatcggcctggagtcagcttttgttcccgaacgacttatgatgataatgccatcactaatgccgttgatatctatagaaaccccagtggtgcacttcacttcactgcttcaaataatgactgtggagttagagactttgacatggagaaatatcagctcactaagcatttctgttttccttggccagtgaatcatacctctctgagtccggatggtaaactccttatcattatgggagacaacccagatggcatgttggtggattctagtacaggaaagacagtaatgcccttacacgggcacttagatttctcatttgcctcagcttggcgcccggatggtgtcacctttgctacagggaaccaggacaaaacctgccgaatttgggatgttcggaacctatcaaagtcgcttgccattttgaagggcaaccttggagctgttcggtccatccgatacacgtccgatggtcggtatatggcaatggctgagcctgcagattttgtgcatgtctatgatgccaaaagtggttatgaaaaagagcaggaaattgatttctttggggagatatctggcatatctttcagtccagacacagagtctctttttattggagtgtgggatcgtacgtatggaagcctgcttgagtatggtcgctgtcggaactactcatacctggattctctaatttgagtctgaatgggtttaatctgcaaataagtttgtgtggttggttgttttacattatgcggttgaattgagaaaccccaaataatataccatgcattagaagctggtttaaggtgtacatgatgtgctattttttaggtcctttagtcatggtgccataaatccgttgttgttgggttctcttaagtggtgtaaaaggggaggagttgtacagaaggctggaagtactttcatcatgcataggagggaattgtattggaaactatttcctcacagggaagaagacaatttcgtggctgcatgtaatctttgtactttattgtccgttttatttagaacattactcaaagttggttttcttgagttcaaagtatatcttgatattggtcctc

SEQ ID NO: 1850 - DNA, 1840 bp, Tripterygium wilfordii
gtaagtacgtacgaaagttaagtctagtaaataagttaattggtaagtacttggaaagttagcgtgaatcaatactaagtcatgactattttattgatcaatttctatatttctttgttgtaaaatgaaaaataatgtagtaatttgttgtttgagaatcaattaaagtatgcacatttctgcagttaagattctttagcatagtttgtccattggggattctcatttctggccttgctgcctggttcttactttcgactatcaggtttttactctttccacttggcaaaatattatcacatgatatgtgatatttgtttatcgcccacattgccctcttatggtaattagattgttatcttatataatgatgaatctttttatgtattgtccatactgattcgtgagcaacttgttttaacttatatgttgcagttgtggaattgttgggagaatatgtcccattaccaggtggaagatgctgaacatatggcggaggaatatgacatggaagatgtagaggatgatatggatgaagagtttcgtggtagagatatgggtggctcagactctgatgttgatgaatttgactacttgaatagtaaagtagctgatacttctgctgctgaagctagagagggaaaagatattcagggaattccctgggatagacttagcatcactagggagaaatacagacagactagactagaacagtataagaactatgaaaatattcctcattccggagaagggtcaggaaaggactgtaaagttactaagaaaggtggctcatactatgagttcagacgaaattcaagttctgtgaaatcaaccattcttcattttcagttgaggaacttggtttgggctacatcgaagcatgatgtctaccttatgtctcattttactgttgttcattggtcttcattaacttgcacaaggtctgaagttctcaatgtttcggggcatgtggcaccaacagagaaacatccgggaagcttgttggaaggattctctcaaacccaagttagtactattgcagtaaaagaaaatttactggttgctggaggatttcaaggagaacttatatgcaagcacctagatcggcctggagttagcttttgttcccgaacgacttatgatgataatgccatcactaatgccgttgatatctatagaaaccccagtggtgcacttcatttcactgcttcaaataatgactgtggagtcagagactttgacatggagaaatatcagctcactaagcatttctgttttccttggccggtgaatcatacctctctgagtccggacggtaaactccgtataatcgtgggagacaatccagatggtatattggtggattctagtactggaaagacggtcatgcccttgcgtgggcacatagatttctcatttgcctcggcatggcacccagatggtgtcacctttgctacaggtaaccaggacaaaacctgccgaatttgggatgttcggaatctatcaaagtcacaagctgtcttgaagggcaaccttggagctgttcggtctatccgatacacgtccgatggtcggtatatggcaatggctgagcctgttgattttgtgcatgtctatgatgcgaaaagtggttatgaaaaagagcaggaaattgatttctttggagagatatctggcatatcgttcagtccggacacagagtctctttttattggggtgtgggatcgtacatatggtagcctgcttgagtatggtcgctgtcggaattactcatacctggattctctaatttgagtccgaatggtgtaatatgcaaataagtttgtgtggttggttg

SEQ ID NO: 1851 - DNA, 1784 bp, Populus trichocarpa
taaattattattattattatttagtctctgatattcttcctctctctagatcgacaaaaaggagcttcctttctccaatccccaaatttgcaactctcacacgcaggtgtggaatcattagtaaaatatgtcccattaccaaggggatgatgctgaatacatggcagatgaatatgaaatggaagatgttgatgatgacatggacgaagaatttcgtgctagggagatgggctcagactctgatgttgatgaatatgactacccgaataacaaagtagctgacatgtctgctgccgacgctagaaatggaaaagacatccagggaattccttgggaaaggcttagtgttactagagagaaatacaggcaaacaaggctagaacaatacaagaactatgagaacataccccattctggggaagtttcaagaaaggattgcaaaattactaaaaaggggggcttgtattatgagtttagacgaaattctagatctgtcaaatcaaccattcttcattttcagttgaggaacttggtttgggccacaacaaagcatgatgtctacctcatgtcaaatttctctgtcactcattggtcctccttaacttgcagcaagtctgatgttcttgatgtttctggacatgtggcaccaactgagaaacatcctggaagtctgttggaaggattcacacagactcaagttagtactctagcagtaaaaggtaatttgctagttgctggagggttccagggagaacttatttgcaagcatctagatcggcctggagtaagcttttgttccagaacaacttatgatgataatgccatcaccaacgctgttgagatttatgacagtccaagtggtgcagttcacttcactgcttcaaacaatgactgtggagtgagagactttgatatggagaaatatcagctctcaaagcatttctgttttccttggcccgtgaatcatacttcccttagtcctgatggaaagcttctaacaattgtcggggacaacccagctggtatgttggtggactccagcactggaaagacagtggcatccttgtctgggcattgggatttctcttttgcatcagcgtggcatcctgatggggtcacctttgctactgggaaccaggacaaaacatgccgcatttgggatgctcgaaacctgtccgagtcagttgctgttttgaagggaaatcttggtgcaattcgatcaattcgtttcacatctgatggccaatatatggcaatggctgagcctgcagattttgtgcatgtttatgatgcaaaaaatgggtatgaaaaggagcaggagattgatttctttggtgagatatctggtgtgtcattcagtcctgacacagaggctctttacattggagtgtgggatcgcacatatggtagcctccttgagtatggccgttgccggaactattcataccttgactcctttgtttgagttgactgcagatatgtgtgttggtatggttttttttttccttgatgcaattgaggaacacaataaaatcatacaatgtagaataaggtttaggtgtatatgtattgctgttgtggaattttaggttctcgtggttctattagtcttggtgccactgttgttgggttattataagatgtgtagaaaggagggtatgtacaggaggctagaaagtaacattcaatgcgaacaacaaaatgaaatcaaacttctgcttcttcaggtagaggacattttgtaacttttttccactttccattgtcttagtgatcttatttct

SEQ ID NO: 1852 - DNA, 2035 bp, Malus domestica
aagaaggaaagcacgtccttttcgtaaggttcccctcaacctttgtctttcgctcgacaatccgaaaacaccagtcggtagagagaaaataatattacgcactctctctcacctctctctctctcccctctcttctccctggatctgaacttcttcttgactagggtttgagatttcagtttctcaattcgggatttccagatccgaacagctgctccttccgagcttctcgattcccagaacaaacgaaagttgtggcattgttgggaagaatatgtcccattacgctggttatgtggaggatgaatacgaaatggaagatgtagatgatgatatggatgacgagtttcacagtagagaaatgggcggctcagattccgatgttgatgaatatgactacttgaatagtaaagtagctgatacaactgctgctcaagcaagaaaaggaaaagacatccaaggtattccttgggatagacttagcattactagagagaaataccgacagactaggttagaacaatacaagaattatgagaatgtccctaattctggggaaggatcagggaaggattgcaaagatacaaagaaaggatctgtatattatgagttcagacgaaatgctagatcagtgaaatcaaccattcttcattttcagttgcgtaacttggtctgggctacttccaagcatgacatctatctgatgtcacatttttctgtcgttcattggtcttccttaagttgcacaaagtctgaggttctcaacgtttctggacatgtgacaccatcggagaaacatcctggaagtctcttggaggggtttacacagactcaagttagtactcttgctgtaaaagataagttgctggttgctggaggattccagggtgaacttatttgcaagcatcttgatcgtccaggagttagcttttgctcgaggacaacttatgacgataatgccataacaaatgctgttgagatttatgacagtcccagtggggcagttcactttacagcctctaataatgactgtggagtcagagactttgacatggagaaatttcagcttactaagcatttccggtatccttggcctgtgaatcatacttctttgagtcccgatggtaaacttcttgtgattgttggagacaatccagaagggattttggtaaactctcaaactggaaagacggtgatgtctttaaatgggcacttggatttctcctttgcatcagcatggcatcccgatggtatgacctttgctactgggaaccaggacaaaacctgccggatttgggatgttcgaaacctttccaagtcagttgctgttttgaaggggaaccttggagctattcggtcaatccggtatacttctgatggtcagtatatgatgatggcagagccagcagactttgtgcatgtctatgatgtgaaaagtgggtacgagaaggaacaggaaattgatttctttggcgagatatctggcatatcattcagtccggacacagagtcactttttattggagtgtgggatcgtacatacggtagtcttcttgagtatggccggagccggaactactcttaccttgactctcttatttgaccgacttcaataagcaaactgcgaatgagtgtgttggcgttgctcattcctcagtgcgattgcagagcctagtaacgtatttcgcgcagtgggaagaggttgtagatgtaaatgaagtattatgtgcaatagtaactttgttgttggtgttccgtccttttctccccatagaaaatgtgtaaaagggaggaatgtacagaaggctaaggcaatggtggtcgaaacaaatggggaagaagaaccggtgtgtcttggggcgaaagacattggctgttttgcgtttttgaaattttatctcaatgtggcacgtgtcatgtgggaaagaagctaccaatcatcttgttggtttcttggatcccaagtgatgagtttgatatagagtaaaacttcctgtaataattctactaaacaaatttacttttgttcccctgc

SEQ ID NO: 1853 - DNA, 2450 bp, Solanum phureja
tctagtccacgattcctgccctagttgtgtgtcctggtcccacagatctttctttcccccaataaatttgcactttgccttgtttttcgctgttcatcagattctcctctcctctttgcttggtgaaatttggaaaccgcaattattgcattaaaatagtcaaccttaccggattttaaattcaaattcgatttgttgattgttgtttttgcataattatcctccattgttgtgcagaatttgtctgcgaagagctgatcattttgaatcatgtaattagggttttcaggaaaattttcagtttctcagaagcttctccaatcacgatctccttatagataagttgaatttttttcccttgatcaaagtgtttgtttttgctcagaaagtgcatacctagaagctgaaatttcgtaaattaatgattctgggttcagattttgttgtatgtatcttttgtatgtagttttgtaatctaatagcaaaattgtgtatcttgtgagcgaggtgtgtgcaagctggctcggacaccaaggtcattaaaaaaaaagaaaattgtgtgtcttgtggttagtcttgtaagattttttgtatatgattgattagttaataactagaaatatgaagcatcagaagaagaagaagagatccaaaacttgtaaacaagttggggttggtaacggttcgttgccatctgggaatagtaatgatggaagggagagtgttgtgacggctttaacggaggcatttagctctgtatctgtggaggaagcaacatgtgcttataaagaggcaaatggggatttgaataaagcaatggagattctgggtgatatggtggagcgtaaggaagaggataagatcactagttgttctagctcgagtggaaacgttagttcaagtttggattcgagtaactcggatgtgtttgttgggggtcattcctggaagaactcagttcagcgcaaggctaagatgaagaaattggtagctgctactggaacagtatcggcgatgatagggaaagattatgtgaggacaactccaaagaagagttgttcaaagctcaagggattaaatgacgaaacatcaagcaatgaagatgttgagcagtttttgtattccatgcttggggaggactctgatttgagcttagctgtcgtcagagatgtgttatgtcaatgcggatatgaagttgagaaggctctgagtgtgttgcttgaattatcagctccctctaatgagcaacctaagcttagcgactgtagtgcaaactggaaagaagaggctgtgtttcttcattcaagtgatggtcttactgacaggacatctgattctacttctcattcatctgaaggcgaagttctagaaaatgtgtggttttgggggcctcctggcaggaatcagttaaaagttcctgctggaaactctgaacattcttcatcatctacagcaggaaattctggaccagtacttcctcaagatatcctggaatctctgtttaatatgccaacccccaagagtgctgaacatgaaccaactactatgaactggaagaatgtagtgaagaaaatgacatctttgggacaaaggtttggatcttgtcctaatgatattccaccactacagcatactcatgctgagggagctgagtatcagctgttcagggaaactgcaaagcaacattgggagtcaatgagatcccattatcagaaggctgcaacagctttttcaaatggacaaaagggacatgctgcttatcttgcggatcagggtaggctacacaacagaaaggctcaagaggctgatgcgaaggctagccagaatatatttgcagctagaaacaagaacatagaaaatatgataactatcgacttgcatgggcaacatgtcaaaccagcaatgaggcttttgaaactgcaccttctatttggagcatttgtacgctctgttaggttgttcagagttatcacgggatgtggggcacatggcgttgggaagtcgaagctgaaaaactcggtagttgaacttttgaagaaagaacgtattgaatggactgaggagaatagaggaacattgctcatcaagctcgatggacgaatgaattttagctttctagatactgatgatgatgatgatgataactgatcatcccttaggcatggttgctagcagttgggcgccgtggattttagcattaacggtggcgctaaatgtaattaacatcactatattatctgggtgctaggtggtgtaacctagattatgatattttacgacatttacattttcttttgttagtgtgagaattgtaaaggtgtatcctagctctgagtattatgcagcatgatagctaagctcatgtatcagtgtagaatgcacattattgtagtaactgtaatactcttttattctggaaatcatgaaaatttgcagttgaatatctttta

SEQ ID NO: 1854 - DNA, 2307 bp, Solanum tuberosum
ctttgcttggtgaaatttggaaaccgcaattattgcattaaaatagtcaaccttaccggattttaaattcaaattcgatttgttgattgttgtttttgcataattatcctccattgttgtgcagaatttgtctgcgaagagctgatcattttgaatcatgtaattagggttttcagtaaaattttcagtttctcagaagcttctccaatcacgatctccttatagataagttgaatttttttcccttgatcaaagtgtttgattttgctcagaaagtgcatacccagaagctgaaatctcgtaaattaatgattctgggttcagattttgttgtatgtattttttgtatgtagttttgtaatctagtaacaaaattgtgtatcttgtgagcgaggtgtgtgcaagctggctcggacaccaaggttattaaaaaaaagaaaattgtgtgtcttgtggttagtcttgtaagattttttgtatatgattgattagttaataactagaaatatgaagcatcagaagaagaagaagagatccaaagcttgtaaacaagttggggttggtaacggttcgttgccatctgggaatagtaatgatggaaaggagagtgttgtgacggctttaacggaggcatttagctctgtatctgtggaggaagcaacatgtgcttataaagaggcaaatggggattgaataaagcaatggaaaatctgggtgatatggtggagcgtaaggaagaggataagatcactagttgttctagctcgagcggaaacgttagttcaagtttggattcgagtaactcggatgtgtttgttgggggtcattcctggaagaactcagttcagcgcaaggctaagatgaagaaattggtagctgctactggaacagtatcggcgatgatagggaaagattatgtgaggacaactccaaagaagagttgttcaaagctcaagggattaaatgacgaaacatcaagcaatgaagatgttgagcagtttttgtattccatgcttggggaggactctgatttgagcttagctgtcgtcagagatgtgttatgtcaatgcggatatgaagttgagaaggctctgagtgtgtcgcttgaattatcagctccctctaatgagcaacctaagcttagcgactgtagtgcaaactggaaagaagaggctgtgtttcttcattcaagtgatggtcttactgacaggacatctgattctacttctcattcatctgaaggcgaagttctagaaaatgtgtggttttgggggcctcctggcaggaatcagttaaaagttcctgctggaaactctgaacattcttcatcatctacagcaggaaattctggaccagtacttcctcaagatatcctggaatctctgtttaatatgccaacccccaagagtgctgaacatgaaccaactactatgaactggaagaatgtagtgaagaaaatgacatttttgggacaaagaaattgggttcctctctttaccactttgaatatctctctactgcagctgagggagctgagtatcagctgttcagggaaactgcaaagcaacattgggagtcaatgagatcccattatcagaaggctgcaacagctttttcaaatggacaaaagggacatgctgcttatcttgcggatcagggtaggctacacaacagaaaggctcaagaggctgatgcgaaggctagccaggatatatttgcagctagaaacaagaacatagaaaatatgataactatcgacttgcatgggcaacatgtcaaacctgcaatgaggcttttgaaactgcaccttctgtttggagcatttgtacgctctgttaggttgttcagagttatcacgggatgtggggcacatggcgttgggaagtcgaagctgaaaaactcggtagttgaacttttgaagaaagaacgtattgaatggactgaggagaatagaggaacattgcttatcaagctcgatggacgaatgaattttagctttctagatactgatgatgatgatgatgataactgatcatcccttaggcatggttgctagcagttgggcgccgtggattttagcattaacagtggcgctaaatgtaattaacatcactatattatctgggtgctaggtggtgtaacctagattatgatattttacgacatttacattttcttttgttagtgtgagaattgtaaaggtgtatcctagctctgagtattatgcagcatgatagctaagctcatgtatcagtgtagaatgcacattattgtagtaactgtaatactcatttattctggaaatca

SEQ ID NO: 1855 - DNA, 2210 bp, Solanum phureja
cataaactccctttcctacattctctctctctgctaggattacagttttctcgcctttgctttctctctcttcacatcgaaaatcatcaaattttcaagaattgggtttctttgaatctcaataatccactcaaacaacaaaaaagcaattgaatttgggtttgggattgctggaagaaatctatgaaagagtgattttctcctgcaaaatgttgggcccttttactgatttcgctcctttctttatacccttttcaaaacctatgtctcatcgttctctcatcggtggtaatcatacctctgctcgtttctgttcccggtaatccattcttttcagaaaacccctcttctctcctctcaaattttgggtacccattcttttttcttctatatacttgcaaaatattcgttgtagatattcatttttgaaaagtaaaaggagcgattttgatggatcatagtacgggaaaaccgggattttttaggaatgttttggtacgtttatgccttttttgtgttgtgattgtctgttgtcggtttgcttatgtggtgactctcaaaggggaaacttgtgacctcggcgatttttgtttcttctctataccggaaaatctcaatgttatttccggcgtcggacagctcgctgggtctgtatcagcggtcatgaccaccgagaatgccggaaaatctgctccgacgaagcccaaacttcccgatctatgggcgaacaaagatttccaaaagtcggcccaattttattcttcggtgtttgaggatcttgttgcggatggttttttgaacccaaattcgaaaaccctttgcgttgaaacgccgatgggtgctgatgtttttgcgttgagggaaattggggttgccgattccgttgggctttacaagaaaggttcaaagcctttggtgattacaggtaaagctgttaagcaaccctttgaagatgatacattcgatttcatattttccggtgccggaatgatagataagtcacttaagccgggagattttgcggcggagatttgccggactctaaaacccgaagggtttttggttgtccatacaggttctaatgatacatacagtttcaattcattccttcatttgtttaattgttgtacattgattaagtctaggaatattgatggtttcgattcgactattcgtgagattgttatgaaaaaggatgtatttgttgaagaaaaagtgagtgattccaagaacaattgtcgtcatgttcccgattataaaatgaaactgattaaaaaagctgagcctttgattaaagaggaacctaagaaaccatggattacacttaagaagaatgcacagagcattaagtacttgtcgtccatggcggatattagttttaagcagagatatgtctatgttgatgttggttcgaggagttatggttcaagcattgtgagttggttcaagaaacagtatcctaagcaaaacaagacctttgagatatatgctgttgaggctgacaagactttccatgggcagtataaggagaagaaaggggttactttgttgccatatgcagcttgggttaagaatgagacgttgtcgtttgagattaatcaagatccgggtcataaagatgtggcaaaaggaagagggatgggaagaattcaacctgttgaatcttctagtgaatctgcaagtgaggtggatgtaatccaaggttttgactttgctgaatggttgatgagcgcggtatcagagaaggattatgtggtgatgaagatggatgttgaagggactgaattcgatttgatcccgagattgattgaaacaggagcaatttgcttgattgatgaagtgtttcttgaatgccattacaataggtggcagaaatgctgccctggggagaggtcttcaaagtatccgaatacgtatagccagtgtttggatctcttcacttctctaagagaaagtggagttcttgttcatcaatggtggtaatcatcaataatacagtctagtttccctagctctttagttcttatatttgtagttcttacacaacaggccaaaaattctctcctttacttcaaattttcgtatgtatgtactgtttgccccatagaaagaattacgttcaatgcgtttgcttctacaacaacaatatttgtgattaaatactgtggcttgaagttaagctcatcgaaggatattcctttctctttcaa

SEQ ID NO: 1856 - DNA, 2152 bp, Capsicum annuum
gcacgaggctctttctctctctatatttgcattacagttttcttccaattgagcttctctctctacaccccaaatcattcaacaactgggtctccttggtctctttgaatctcaaatatcccagtgactttttttctttctttctgattttcggggttaggtctgcatgtaagaaatatatatagagtgaatttcgcctggaaaatattaaaaaaaaaatgttggccccttttagcgatattgctccttctcttgtacccttttcgaaccccatatctcaccgttctctcatcggcggtaatcatacctctgctcgtttctgttctcggtaaccccacttttctcctttcgaatcctttcttttctatttccctttttctttatactcacaaaaatacagaaagaagaatagattgtaaaacagagggattttgatggatcatagtaccgcaaaaccgggactttttaggaatgttttggtacgtttatgccttttttgtgttgtgattgttggttgtcggtttgcttatgtggtgactctcaaaggggaaacctgtgacctcagcgatttttgttttttctccttgccggaaaatctgaatgttatttccgccggcgtcggccagctgactaagtccgtgtcagcggtcatggttaacgaggatgccggaaaatctgctccggcgaagcctagaattcctgatctatgggccagtaaagatttccaaaaatcggcccggttttattcttcggtttttcaggatcttgttgcagagggaaccttgagttcgaattcgaaaaccctttgcgtcgaaacgccgatgggtgctgatgttttttctttgaaggaaattggggtcgaggattctgttggaatttacaggaaaggttcaaagcctttggtgattacaggtaaagctgttaaacagccgtttaaagatgatacattcgatttcatattttccggtggcggaatgatcgataagtcacctaagcccgcagattttgcagcggagatttgtcggactttgaaacccgaagggtttttggttgtccatacaggttctaaagatacatatagtttcaattcattccttcatttgtttaattgttgtacattgataaagtctaggaatattgatggttttgattcaagtatgagtgctattcttgagattgttatgaagaaggatagatatgttgaagaacaagtgagtgatttgatgcacaaatgtaacattccggattataaaatgaagctgataaaaaaagcagagcctttgattaaagaggaacctaagaaaccatggattacactgaagaagaatgcacagaacataaagtacttgtcatcgatggcggatatcagttttaagcagagatatgtatatgttgatgtcggttcaaggagttatggttcaagcattgtgagttggttcaagaagcagtatcctaagcaaaacaagacctttgagatatatgcagttgaggctgacaagactttccatggacaatataaggagaagaaaggggttactttgttaccatatgcagcttgggtgaggaacgagacgttgtcgtttgagattaatcaagacccgggtcataaagatgtagcgaaagggagagggatgggaagaattcaacctgttgaatcttctggtcaatctgcaagtgaggtggatgtgattcagggttttgattttgctgaatggttgaagagtgcggtaacggagaaggattatgtggtgatgaagatggatgttgaaggcactgaatttgatttgatcccaagattgattgaaactggggctatttgcctgattgatgaagtatttcttgaatgccactacaataggtggcagaaatgctgccctggggagaggtcttcaaagtatcagaatacctatgggcagtgcttggatcttttcacttctttaagagaaagtggagttcttgttcatcagtggtggtgatcatcaataataataatccagtctagtttacatagcctttagtcttttccttccttggttgttcttctctttgtagtgttctcatacaacaggcaacaaattctctcttgttacttcaaattttcatctgtatgtactgtttgtcccatatatagaattatattccagttggttta

SEQ ID NO: 1857 - DNA, 2167 bp, Capsicum annuum
gcacgaggctctttctctctctatatttgcattacagttttcttccaattgagcttctctctctacaccccaaatcattcaacaactgggtctccttggtctctttgaatctcaaatatcccagtgactttttttctttctttctgattttcggggttaggtctgcatgtaagaaatatatatagagtgaatttcgcctggaaaatattaaaaaaaaaatgttggccccttttagcgatattgctccttctcttgtacccttttcgaaccccatatctcaccgttctctcatcggcggtaatcatacctctgctcgtttctgttctcggtaaccccacttttctcctttcgaatcctttcttttctatttccctttttctttatactcacaaaaatacagaaagaagaatagattgtaaaacagagggattttgatggatcatagtaccgcaaaaccgggactttttaggaatgttttggtacgtttatgccttttttgtgttgtgattgttggttgtcggtttgcttatgtggtgactctcaaaggggaaacctgtgacctcagcgatttttgttttttctccttgccggaaaatctgaatgttatttccgccggcgtcggccagctgactaagtccgtgtcagcggtcatggttaacgaggatgccggaaaatctgctccggcgaagcctagaattcctgatctatgggccagtaaagatttccaaaaatcggcccggttttattcttcggtttttcaggatcttgttgcagagggaaccttgagttcgaattcgaaaaccctttgcgtcgaaacgccgatgggtgctgatgttttttctttgaaggaaattggggtcgaggattctgttggaatttacaggaaaggttcaaagcctttggtgattacaggtaaagctgttaaacagccgtttaaagatgatacattcgatttcatattttccggtggcggaatgatcgataagtcacctaagcccgcagattttgcagcggagatttgtcggactttgaaacccgaagggtttttggttgtccatacaggttctaaagatacatatagtttcaattcattccttcatttgtttaattgttgtacattgataaagtctaggaatattgatggttttgattcaagtatgagtgctattcttgagattgttatgaagaaggatagatatgttgaagaacaagtgagtgatttgatgcacaaatgtaacattccggattataaaatgaagctgataaaaaaagcagagcctttgattaaagaggaacctaagaaaccatggattacactgaagaagaatgcacagaacataaagtacttgtcatcgatggcggatatcagttttaagcagagatatgtatatgttgatgtcggttcaaggagttatggttcaagcattgtgagttggttcaagaagcagtatcctaagcaaaacaagacctttgagatatatgcagttgaggctgacaagactttccatggacaatataaggagaagaaaggggttactttgttaccatatgcagcttgggtgaggaacgagacgttgtcgtttgagattaatcaagacccgggtcataaagatgtagcgaaagggagagggatgggaagaattcaacctgttgaatcttctggtcaatctgcaagtgaggtggatgtgattcagggttttgattttgctgaatggttgaagagtgcggtaacggagaaggattatgtggtgatgaagatggatgttgaaggcactgaatttgatttgatcccaagattgattgaaactggggctatttgcctgattgatgaagtatttcttgaatgccactacaataggtggcagaaatgctgccctggggagaggtcttcaaagtatcagaatacctatgggcagtgcttggatcttttcacttctttaagagaaagtggagttcttgttcatcagtggtggtgatcatcaataataataatccagtctagtttacatagcctttagtcttttccttccttggttgttcttctctttgtagtgttctcatacaacaggcaacaaattctctcttgttacttcaaattttcatctgtatgtactgtttgtcccatatatagaattatattccagttggtttattcatttccttcttc

SEQ ID NO: 1858 - DNA, 1917 bp, Nicotiana tabacum
  misc_feature (159)..(159): n is a, c, g, or t
  misc_feature (190)..(190): n is a, c, g, or t
  misc_feature (264)..(264): n is a, c, g, or t
  misc_feature (384)..(385): n is a, c, g, or t
  misc_feature (395)..(396): n is a, c, g, or t
  misc_feature (435)..(436): n is a, c, g, or t
  misc_feature (814)..(814): n is a, c, g, or t
  misc_feature (1744)..(1744): n is a, c, g, or t
tacaaaaaatacacaagaatacgttgtcttgatggatcatagtacgggaaagcctggtttcttaaggaatgtgttccgttcgtgtatgtttctatattcgtgttgtgatctctctggttgtcgcgtttcgcttatgtggtgactctcaaaggcgaaacntgtgacctcggcgatttttgtttcttctccntgcccgaaaatctgaatgttattacctccggcgttgggcagctgactgagtctgtatcagcggtcatgacaacnagcgaaaaatctgctccggcgaagcccaaacttcccgatctatggaccagcccagatttccaaaatcggccgtttctattcttctgtattcaggatcttgtgtagatgggttttgagccnnaattcgaagnncctttgcgtcgaatccagtagtgctgatgttttcgcttnnaaggaattgggatcgcgattcattgggatatacaagaaaggctcaaagcctttggttattacaggtaaagctgttaaacagccttttgaagataatacatttgatttcatattttccggtgccggaatgatagataagtcgacgaagccgggcgatttcgcggcggagatttgtcggactctgaaacccgaagggtttttcgtggtccatacaacaggttctaaagatacgtacagtttcaattcattccttcatttgtttaactgttgtacattgattaagtctaggaatattgatggttttgattcaaatactattcgtgagattgtcgtgaaaaaggttgtttttggggatgtaaatgttgaggaaaaagtgagnagtgattcgaagaacaaatgtaatgttccggattataaactgaagctgattaaaaaagctgagcctttgattaaagaggaacctaagaaaccatggattacactaaagaagaatgcacagaacataaagtacttgtcgtccatggcggatataagttttaagcagaggtatgtgtatgttgacgttggggcgaggagttacggttcgagcattgtgagttggtttaagaagcagtatcctaaacagaataagacatttgagatatatgcaattgaggctgacaaaactttccacgggcagtatgagggtaaaaaaggggtgactttgttgccctatgctgcttgggtgaggaatgagacgttgtcgtttgagattaatcaagacccgggtcataaagacgtggcaaaagggcgagggatgggaagaatcaacctgttgaatcttctagtaactctgcgagtgaggtggatgtgatccaaggttttgactttgctgaatggttgaagagcagtgtatcggagagggattatgtcgtgatgaagatggacgttgaaggcactgaatttgatttgattcccagattgtttgaaaccggggcgatttgcctgattgatgaagtttttcttgaatgccattacaataggtggcagaaatgctgtcctggggagaggtcttctaagtatgagcatacatatggccaatgcttggatctctttacttctctaagagaaagtggagttcttgttcatcagtggtggtgatcatcaataattcagcatagtttcagtagctttagttttttccttatttctctttgtaattctcacacaagcagaaaaaatgtcatcgtttttatacatctcgtagtaggcaagtatatcatgtgtatcacattcatgttgtttcattcatttgcttgtacaataacanttgtgagtacgtagatatctgtgtgttagctagcacgtagatatatctacgtgctatctgtgtgttagctagcacgtagatatagagttgaaaattgatcagggctgaaataaaacagacctggtaaagttggaagataatgttgggctacttaaagtaaaaaagttcagctg

SEQ ID NO: 1859 - DNA, 954 bp, Solanum tuberosum
accccaattcaaaccgcctcacttgctcccatcaacttgtagcagcatagccatggcagaaacagagcctgaagccgccgtcgcgcccgccgttgaagccgtagtagaggccgagaaagaggacacttcggctcaggacatggatgtcgaagctctagccgctgatgatacggaagataacggggggtcgaagcgtccaagggaggaggaaaacgagccggagaatgaagacgccacgaagaagctgaagatcgataagtctgtggaagaagaacgatttgagaatttagatggaagcaaaacggtggatgaagaaaagaaagacgggtcgggtccggttagcgtgggtcctaagaactttggatcgtctgtggagatgttcgattacttttataagcttcttcattcttggtctcccaacctcaacctcaacaagtatgaacacattgttttgcttgacttgctaaagaagggtcatttagagccagatagaaagattggtacaggagtccgcgcattccaaatccggtttcatcctcaatttaaaagtcgctgcttctttgtcattagggaggatgactctgtggatgattttagcttcaggaaatgtgttgatcacattagtcccctcccagagaacatgcaagtaaaacacgaggcaaacagagacttggctcgcggtggtaaaggaggtgggcgtggccgtggaagaggagggaagccaagatattgaaggcagctgcgtgttctgccaattattctgtactccgttgcatgctgctgtttagtccacattttgttcaatacccctttcaatcctgcagtttatgacataatggtttgttgctagtgaagttacatgaatacaaggatggcatcaactagttataatcttaccataatatgcgttaaatttatgtaatgtatgaatacatcagatgaaattatcatatg

SEQ ID NO: 1860 - DNA, 1101 bp, Solanum phureja
gggtcacaacctttgccagttgccactgtcagtgagggtttaaacttgcatcaaaaccctagcgttccttttacctcaattctaaccgcttcacttgctcccttcaacttacaacagcatagccatggcagaaacagagcctgaagccgccgccgcgcccgccgttgaacccttagtagaggccgagaaagaggacacttcggctcaggacatggatgtggaagctcaagccgccgatgatacggaagagaacggagggtcgaagcgtccaagggaggaggaaaacgaggtggagaatgaagacgttacaaagaagctgaaggtcgataagtctgtggaagaagaacgattcgagaatttagatggaagcaaaacggtggaggaagagaagaaatacgagtctggtcctgttagcgtgggtcctaagaactttggatcgtctgtggagatgttcgattacttttataagcttcttcattcttggtctcccaacctcaacctcaacaagtatgagcacattgttttgcttgacttgctaaagaagggtcatttagagccagatagaaagattggtacaggagtccgcgcattccaaatccggtttcatcctcaatttaaaagtcgctgcttctttgtcattagggaggatgactctgtggatgattttagcttcaggaaatgtgttgatcacattagtcccctcccagagaacatgcaagtaaaacacgaggcaaacagagacttggctcgtggtggaaaaggaggtgggcgtggccgtggaagaggagggaagccaagatattgaaggcagctgcgtgttctgccaattattctgtacgccgtcgcatgctgctgtttagtccacattttgttcaatacccctttcaatcctgcagtttatgacataatgtgaagttacatgactacaaggatggcatcaactagttataatcttaccataatatgcgttaaatttatgtaatgtatgaatacatcagatgaaattatcatatgaagaacgtattagtcaattttttcgcatatactgtaggaggtgttaactaaacatattgctctggtaaattgtgagctccctcccaa

SEQ ID NO: 1861 - DNA, 1037 bp, Solanum melongena
agttgatcagtttaatcgggtcaggattgccagtttacactctcacttgagggtttaagcagataccaaaaccctagagttcagtttaccccatttctaaccgcctcccttgctcgccattgccatggcagaaacagaacctgaagcgcccgccgttgaagccgtagtagaggccgagaaagtggacacttccgctcaggacatggatgtcgaagctcaagccaccgatgataggtcagagaatggaggatcgaagcgtccaagggaggaggataacgaaccggagaatgaagacgccacgaagaagctgaaggtcgacaagtctgtggaagaagaacgacttgagaatttagatggaagcaaaacggtggatgacgaaaagaaagacgggtcgggtcctgttaccgttggtcctaagaactttgggtcgtctgtggagatgtttgattacttttataagcttctacattcttggtctcccaacctcaaccttaacaagtatgagcacattgttttgcttgacttgctcaagaagggtcatttagagccagatagaaagattggtactggagttcgtgcattccaaatccggttccatcctcagtttaaaagtcgctgcttctttgtcattagggaggatggttctgtggatgattttagcttcaggaaatgtgttgatcacattcagcccctcccagagaacatgcaagtaaagcacgaggctaataaaaatctggctcgcggtggaaaaggaggtggacatgggcgtggccgtggaagaggtgggaagccaagatattgaaggcagatgccaattgttctgtacgccatatgctgctgtttagtccacattttgttcaataccactttcaatcctgcagtttatgacataatggtttgttgctactgaagttacatgactacaaggatggcatcaactagtataatcttacgtgttaaatttatggaatgtatgaatactttgaagatgattccttgccccaatagaaatagagctcagtaagcacttttcggtc

SEQ ID NO: 1862 - DNA, 1317 bp, Nicotiana benthamiana
cctcagtcccctgaacttactcagcttaaccatggcagaaacagaacctgaagtggcagccgcccccgccgccgaagccgtagcacaggcggagaaagaggaaatcccggttcaggatatggatgtcgaagctcaagctgccgatgatgaggcggagaacggtggctcgaagcgtccaagggaggaggaacaaaacgagccggagaacgaagacgccacgaagaagctgaaggtggaccagtctgtggaagaacaaaggctcgagaatttagacggaagcgaaacggctgtagatgaagaaaagaaaaacgggtcgggtccggctagcgtgggtccgaagaacttcggatcgtcggtagagatgtttgattacttttacaagcttcttcactcttggtctcccaatctcaacctcaacaagtatgagcacttggttttgctcgacttgctcaagaagggccatttagagccagacagaaagatcggtacaggaattcgggcgttccaaatccggtttcatccacagtttaaaagtcgctgcttctttgtcattagggaggatgattctgttgatgactttagcttcaggaagtgtgttgatcacattctgcccctcccagagaacatgcaagtaaaacatgaagctaacaaagctttggctcacagtgggaaaggtcgtggaaggaaaggaggcggatatgggcgtgacagtgggaatggagggaagtcaagatattgaaaaacagcttcatatttaccagaatcgactgcctgttttgcacgctgctgtcaatccatattttggtcaatacagctatttgcttgcagtttttacataatgatttatggctagtgaagttacattactataaggggtgcataattcaagtattttttatttgtttggtatcacctatagcctttttccaagatctgcgttaaattgatggaaggtgtgaattcacccgattatgaagactgtttttgtcaattcttgtcttgattgttcatttatactccctacccctaccccctccaaagcccctaagatgaatcaaaccaaagagggataaagtgtgtaaataggtattaaatacatggggaaaagccggtaaaatggaaagggcttccttttatcccaataggaaaaatttagagaaactttcgaaaactattatgttttattagtagttattagctaattgtagttatcatttattgtattatttcctataacttatgttgttaggttttttagagtgtatttggtgtatttaagctattgtattcatgaatatagttgtatttttaggcgtg

SEQ ID NO: 1863 - DNA, 1866 bp, Solanum phureja
aaaactttctacaatctacacgccttacgcgttacactctctctcgaagcaacctcaaacttcttctctcttaaataaaaattcattccctttttcttcatcttcatcttcaaatctccttcaatggagcctccaaatccccaacaatttcagcaatttctcagcagtgttctctctcagcgtggcccatctgcacttccttatgctgaagatgtcaaatggctgatccgtcaacatctcctttctttaatcgatatttacccttcacttcagccgaaaactgcttcatttactcataatgatggaaggactgtgaatctattgcaagctgtaggtactgttccgatggtttatctagatcgtccgtataatattccggtgattatttggttgatggaatcttacccacgtcatccgcctttggtttttgtgaatccgactagggatatggttattaaaaaacctcatccgtttgtgaatccatctggggttgtgtcgattccatatttgcagaattggatataccctagttcgaatcttgttgaattggttcgtaatttgagtcatttttttggaagggatcctccgctttatgcgaaagtacaagcacatccatcaaaccctaaccctagtcctactcctacctctcatcctccgccaagtacgagttttcctaatcacagttcgccagttgggtcatctgggattcggccggcgatacctcctaggccagttcaacaaccaccttatggtgcagtgaaacaggatgattgggaggatgtttttaggcggaacgcgacagataagctgcttgttgacttgcataatgatatagttgggttgaggaatgcacaggagaaggatatggatgggttgtttaatgctcagggagtgttgaagcagcgggaggagcagttgaaacaagggttaaaggaaatgcaggatgagaaagaggggttggagcagcaattacagatggttttgatgaatagtgatgtattagagggatggctgagggagaatgaggggaaagtgaccaatttagggaatgtggatgtggatacggcctttgagccatgtgatagtctttccaagcagatgctcgattgcacggcgtcagatttggcattagaggatgtgatttattcgttggacaaagctatacagggtggggcaataccatttgaccagtacttgaggaacataaggttgttatcgcgtgagcaattctttcatcgtgctacagcatcaaaagttagggctgctcagatgcaggctcaagttgctaatatggctgctagaacatcacaatatgcattgtgatagacatctaatcacttgcaggtgtgtttgcaacagactgaaggtcaatatatttctagattggttacttgtgaataatctgtcaatgtgctatagctttatcaatagattttggcactacattttggcgtgggtgtttaattggtatttattggttgtatcattttgttaccaaaagtagaatcacataaaagggattttccctacaatgatatccacgattttcatttctgtcaagttatcccatttctatgagattgtgattttggaccaagattagtgttctgtcactctcccaaaaaagagtagtaagaggttccaactctcttgtcttctgctttagtctcagcagttagcctgttttttggatggatgtctataccgattaccgaggaataatttcaaatcactgttatggtgataaacattctgttcaaatacatatgcatatctttgtgtacttgtctatctagcaatgtagcatgttctatataggtgtttctcaagcactttgtgttgtatgtgaaatcataaagtttctcc

SEQ ID NO: 1864 - DNA, 1424 bp, Solanum tuberosum
aaattcttctccaattccctttttttctctgaaaccctaacaacactttttcttctctcccgatcaaaaatcatctcatcaatggagattatcgcttaaaacctgaaaatatcttcataattgctcattctcctctcttcctctcctgtatttctcaacatatccagcgaaaagttgcagatttgtccgttcctggcgtgtttctgcatatattgattgtctttagctgaagttttcccagtctgctttacctcatcatggcttcactggatatgaccctggatgatatgataaaaagtaggagaagtaccgagaggggtggcaggggtcaaggcagggcccggcgtggaagaggggcagggggatcatttagaggtggatcatttagaggtggaaggacaacgggagctcctcgtagaggaccacttggcgttaatgctcgaccatcagcctacaccattgccaagactttccgtagaaccaagaatttgccatggcagaatggtttgtttgaagatagccttagagctgcaggactgtcatcagtattggagagtggcacaaagttatatgtttctaatttagacattggagtgacaaatgaagatataagggaactcttttcggagatgggagaactagtacgatttgcaatccactatgacaaaaatggacgtccaagtggcgctgctgaggtggtctttgccagaagaagtgatgcattccaagctcttaagagatataacaatgtgcagttggatgggaagcctatgaagattgaaatagttggttccaacccagaaattcctttgtcagctcgtgtaaatgtagttggaggaaccaaccggaggaggactgttgttatggcgccgggtggtccagctcgtggaagaggaggtgctactagtcgtggttctagtcaaaggggccgtggtggttttagaaatgcacctggacgtggtcgaggtggcggtggcggtcgtggttggggtagaggtcgtggccgcggtggtaggggaagtaacagggctgctgataagtcagctgaggatcttgacaaggagctggacagctaccatgccaatgctgacgccatgcaaacttagatgtgtcactgctataacttgcgacttaactagaggaaccgaagaaccgatcaagtctactatctctgtgtatcccgtcaccaaactcatgctttccagttgtagtttcttaccgtttatgattgtacgataaagggattgtttgatgaatgctttctaatcccctaatgaacgaatcgtaaatagagtggtttaattgtctttcaatcttccttcacaatggatgatctgcttgaattatgcgcaaggtaagttatattattacaattgtactctatccatttgaggaggtaaagtgaattgaatgagcgttgagtc

SEQ ID NO: 1865 - DNA, 1327 bp, Solanum phureja
aaattgccctagctagaaattcttctccaattccctttttttctctgaaaccctaacaacactttttctctctcccgatcaaaaatcatctcatcaatggagattatcgcttaaaacctgaaaatatcttcataattgatcattctcctctctccctctcctgtatttctcaacatatccagcgaaaagttgcagatttgtccgttcctggcgtgtttctgcatatattgattggctttagctgaagttttcccagtctgcattacctcatcatggcttcactggatatgaccctggatgatatgataaaaagtaggagaaataccgagaggggtggcaggggtcaaggcagggcccggcgtggaagaggggcagggggatcatttagaggtggaccatttagaggtggaaggacaacgggagctcctcgtagagggccacttggcgttaatgctcggccatcagcttacaccattgccaagactttccgcagaaccaagaatttgccatggcagaatggtttgtttgaagatagccttagagctgcaggactgtcatcagtattggagagtggcacaaagttatatgtttctaatttagacattggagtgacaaatgaagatataagggaactcttttcggagatgggagaactagtacgatttgcaatccactatgacaaaaatggacgtccaagtggcgctgctgaggtggtctttgccagaagaagtgatgcattccaagctcttaagagatataacaatgtgcagttggatggcaagcctatgaagattgaaatagttggttccaacccagaaattcctttgtcagctcgtgtaaatgtagttggaggaaccaaccggaggaggactgttgttatggcgccgggtggtccagctcgtggaagaggaggtgctactaatcgtggttctagtcaaaggggccgtggtggttttagaaatgcacctggacgtggtcgaggtggcggtggcggtcgtggttggggtagaagtcgtggccgtggtggtaggggaagtaacagggccgctgataagtcagctgaggatcttgacaaggagctggacagctaccacgccaatgctgacgccatgcaaacttagatgtgtcactgctataacttgtgacttaactagaggaaccgaagaaccgatcaagtctactatctctgtgtatcccgtcaccaaactcatgctttccagttgtagtttcttaccgtttatgattgtacgataaagggattgtttgatgaatgctttctaatcccctaatgaacgaatcgtaaatagagtggtttatttgtcttccc

SEQ ID NO: 1866 - DNA, 2175 bp, Tabernaemontana elegans
aaaatctctctcagacatcccatagaagagtcaaagggaaaaggttaaggcactgagtccattgctagagtgagtagaagggtttaagtccataatttatctgcatttcttcggcgttgatttgaagaaaatgacgaaaatggtgagcccagatgccatttcgataattttagcgaacccgtcaccggaatcttcttctggtctcccggaactggtagttcaagttctggatctcaagcccacaggcaacagatatatgttcaccgctagcgatgggaaaatgaagctcaaggcaattcttccgtccagtttatcatctgaagttatatcagggaatattcaaaatttgggccttatttgtgttcttgattacactctcaatgatatcccaaccaagaatgaaaagtacttgattgtgacgaagtgcgaggcagtatctccagcactggaagccgaatacaagacagtagtgaaaactgaagaaactggcattttattgaagcccaaggaggaagcaaacatcaagatggaagtaaaatgtgatgagcctggcatccttttggagccaaagcaagaaattgttactaaatcagctcaccagattgtacatgaacaaggtggaaatatggcacctgctgcacgaatggctatgacccgaagagttcatccactaggttccttaaatccttatcaaggaaattggacaattaaggttcgtgtaacttccaaggggaacatgcgcacatacaaaaatataagaggagaaggctgtgtattcaatgtagagttgactgacgaagatggtacacaaatacaagcaacaatgttcaatgatgccgcaaggaagttctatgataagtttgaattggggaaggtttattacatttccaaaggaaccctgaaagttgctaacaggcagttcaataccgtgaaaaatgattatgagatgaacataaatgagaactctgaagtggaggaggtaagcaatgaagcagcttttattcctgaaacaaaatacaatttgtccaatagatgaattgggtccctatgtcaatggaagggagcttgtggatgtaattggcgtggttcaaagtgtatcacctactgttagtattcggaggaaaattaacaatgaaacatttcccaagcgtgacataaccattgcagatgagacgaagaagactgttgtggtatctctctggaatgaattggctaccaatgttgggcaagaattgctagatatggctgataagtctccagtagttgcaatcaaatccctcaaagttggagattttcaaggtgtgtctttgtcagcactgagcaaaagtattgtggcaataaatccagaaatacctgaagcaaagaagttgaggaagtggtatgattctgaaggcaaagaaacttcattagcctctgttggtgctggtttgagtcccactgccaaaactggagctcgatctatgtactcggacagagtctttttgtctcacatagttagcaacccaacctggggtcaagagaagcctgtctttttcaatgtaaaggcatatgtaagttatattaaggctgatcaggcaatgtggtatcgggcatgcaagacatgcaacaggaaagtgactgaagctattggatctggatattggtgtgaatcatgccagaagaatgatgatgaatgccacttgaggtatataatgggactaaaagtttctgatccaagtggtgaagcctggctatctgctttcaatgatgaagcggaaaaaattcttggatgctcagcagatgagcttgataagctgaaatctcaggaaggggaaagtgcttatcaaatgaaattgaaggaagctacatgggctcctcacctttttcgtgttagtgttacaccacaggagtataacaatgaaagaaagcaaaggatagtagtaagagctgttgctccggttgactatgctgctgaatccaaatatttgctggaagaaatatcaaaattgaaactgtcggtagcctagtcttttgcctgaaaaggcagtgtccgtccattcagctaatgtgcttcatttatcttgaggcttctggcatgattttgcaggaaatcggcttggtgttgaccgtacggatcatattatgttacggggtgtactatacgttttcttttgattgggctaggaattttttttc

SEQ ID NO: 1867 - DNA, 1867 bp, Solanum phureja
ggaaagagattaggcaccatcgactagtacgccaacctctcgttggttgttttggccactaccctttcacttcctcgacgagtccgtcactctcctattacctaaaaaccccaccaaacatttctcctttttcactatatattcatcttcttcactccattgtcaagaatctcttcctttttctcctaaaattcactttttcttcattcaccatggaaggcgcagcaacagctcaagctttatctcgtattgggttagctggtcttgctgttatgggtcagaatttagccttaaacatagctgaaaaaggatttcctatatctgtttacaatagaaccacttcgaaagtagatgaaaccctagatcgtgctcagaatgaaggacaacttccgttgattggacagtacaatcctcgtgattttgtgctgtcaattcaacgacccagatctgttatcattcttgttaaagctgggtcacctgttgatcaaacgattgctgcgctttctgagtatatggagcctggggatacgattattgatggagggaacgagtggtatgagaatactgaaaggaggattgatgaggcgtcgtcgaaggggcttttgtatttgggtatgggtgtttctggtggagaagaaggggcgaggaatgggccttcgcttatgcctggtgggtcttatggggcttatacgaatattagagatattcttgagaaggttgcagctcaagttgaggatgggccttgtgttacttatattggtgaaggtgggtcggggaattttgtgaaaatggtgcataatggaattgaatatggtgatatgcagttgatttcagaagcttatgatgtgttgaagaatgcaggtgggttgagtaattctgaattggctgatatttttgctgaatggaaccgtggggaattggagagttttttggttgaaattacagcggatatattcaatgtgaaggatgaattaactggaaatggggagttagtggataagattttggataaaacaggaatgaagggaacggggaaatggactgtgcagcaggcggcagagctgtctattgcagctccgacgattgctgcttcgttagacagtaggtacatgagtggattgaaggatgagagggaagaagcctcagagattttcaggaaggaagggttaaaggaggaaataagttctgatattaatggtagcagtcttgataagaagagattgattgatgatgtgaggcaggcattgtatgcgtcgaaaatctgtagttatgctcaggggatgaatttgctaagggcaaagagctctgagaaagggtggaatttgaatttgggagagatggcaaggatttggaaaggtggttgtattatcagggcagtgtttttggatcgtattaagaaggcgtatcagaggaatcctaatttggctaacttgatggttgacccggagtttgcaagggagatggtgcagaggcaagcagcttggaggagagtggtgggacttgctgtccagaagggaattagtgttcctggaatgtctgctagtcttcagtatttcgacacctacaggcgttctaggcttcctgcgaaccttgtgcaggctcagagggactatttcggggcacatacttatgagagagttgacaagtcaggagcataccataccgagtgggcaaaacttgctaggaaagcccgagtgtaatgctgctgcagctattgcggattatgatcaaaatctctggtattagttgcgctttgtcaacttttttcgtttagttttgcagttaataatgttgtatgcctttgaacattatagggccttggctattaaaaatgatttcttcattgaagtaaaagaagttgcttttc

SEQ ID NO: 1868 - DNA, 1898 bp, Solanum tuberosum
ccccaccaaacatttctcctttttcactatatattcatcttcttcactccattgtcaagaatctcttcctttttctcctaaaattcactttttcttcattcaccatggaaggcgcagcaactgctcaagctttatctcgtattgggttagctggtcttgctgttatgggtcagaatttagccttaaacatagctgaaaaagggtttcctatatctgtttacaatagaaccacttcgaaagtagatgaaaccctagatcgtgctcagaatgaaggacaacttccgttgattggacagtacaatcctcgtgattttgtgctgtcaattcaacgacccagatctgttatcattctagttaaagctgggtcacctgttgatcaaacgattgctgcgctttctgagtatatggagcctggggatacgattattgatgggggtaatgagtggtatgagaatactgaaaggaggattgatgaggcgtcgtcgaaggggcttttgtatttgggtatgggtgtttctggtggtgaagaaggggcgaggaatgggccttcgcttatgcctggtgggtcttatggggcttatacgaatattagagatattcttgagaaggttgcagctcaagttgaggatgggccttgtgttacttatattggtgaaggtgggtcggggaattttgtgaaaatggtgcataatggaattgaatatggtgatatgcagttgatttcggaagcttatgatgtgttgaagaatgcaggtgggttgagtaattctgaattggctgatatttttgctgaatggaaccgtggggaattggagagttttttggttgaaattacagcggatatattcaatgtgaaggatgaattaactggaaatggggagttagtggataagattttggataagacaggaatgaagggaacggggaaatggactgtgcagcaggcggcggagctgtctattgcagctccgacgattgctgcttcgttagacagtaggtacatgagtggattgaaggatgagagggaagaagcctcagaaattttcaggaaggaagggttaaaggaggaaataagttctgatattaatggtagcagtcttgataagaagagattgattgatgatgtgaggcaggcattgtatgcgtcgaaaatctgtagttatgctcaggggatgaatttgctaagggcaaagagctctgagaaagggtggaatttgaatttgggagagttggcaaggatttggaaaggtggttgtattatcagggcagtgtttttggatcgtattaagaaggcgtatcagaggaatcctaatttggctaacttgatggttgacccggagtttgcaagggagatggtgcagaggcaagcagcttggaggagagtggtgggacttgctgttcagaagggaattagtgttcctggaatgtctgctagtcttcagtatttcgacacctacaggcgttctaggcttcccgcgaaccttgtgcaggctcagagggactatttcggggcacatacttatgagagagttgacaagtcaggagcataccataccgagtgggcaaaacttgctaggaaagcccgagtgtaatgctgctgcagctattgcggattatgatcaaaatctctggtattagttgcgctttgtcaactgtttgattttaaaattgtgcaattcaggcatttaaaattccaatgtatcttgttgagagtttttatttgctaggcataagaaagattggtaagcttttttcgtttagttttgcagttaataatgttgtatgcctttgaacattatagggccttggctattaaaaatgacttctttcattgaagtaaaagaagttgcttttctacattacattttgatgcatacaaattacctgcacttttattt

SEQ ID NO: 1869 - DNA, 1629 bp, Amsonia hubrichtii
ggcaccccagccactctataaaatcgaccctttgactccattccagaagctcccaaatcctccttggcattctctgtgattcttgattttctggcatggagtccgcagcaatcacagccgatgttgtctcgcgtataggcctagcagggctggccgtgatgggccaaaatttggcattgaacatagctgagaaaggcttccctatctctgtctacaatcgtactacttccaaggtcgatgagactatcgatcgggctcaccgagagggccagcttccgttgattggccagtacaatccaagagacttcatcctctcaattcagcggcccagatctgtcataattttagtcaaagctggtgctccggttgaccagaccattgccgccttgtccgaacacatggagcccggcgacaccatcatcgacggtggcaacgagtggtatgagaacactgaacgccgaattactgaagcctctgctaaagggcttctttacctcggtatgggtgtctccggaggcgaggatggtgctcgctacggtccttctcttatgcctggtgggtctcaccaagcttattcgaacataagggacatcctcgaaaaggtcgccgctcaggtagaggatggcccctgtgtcacctatataggtgagggtggctctggtaattttgttaagatggttcataatgggattgagtatggtgacatgcagctaatatcggaagcctacgatgttttgaagaatgctggtgggttgagcaattctgaattggctgatatttttgctgagtggaaccgtggcgagcttgaaagctttttgattgagattactgctgatatattccaggtgaaagattcagagactggacagggagagttggtggataaaattttggacaagacagggatgaaagggaccggaaaatggacagtccagcaggcagctgagctctctattgctgctccaactattgctgcttcgcttgatagcaggtatttgagtgggttgaaggatgaaagagaggcggcttctttgatatttaaagaggaaggtttgaaggaggagattaataacgtgggggttgtggataagaagaggttgattgatgatgtgaggcaggctttgtatgcatccaagatatgcagttatgcacaagggatgaacttgttgaaggcaaagagtgcagagaaaggatggaatttgaatttgggcgagttggccaggatttggaaaggagggtgtattataagggctgtgttcttagataggatcaagaaggcataccaaaggaatccacggttgtcaaatttgttggttgaccctgagtttgcgagggagatggtgcagaggcaggcagcatggaggagagtggtgggattggccatccagaaaggaattagtgttcctggcatgtctgccagtttgcagtattttgatacttataggcgtgggagacttccagccaaccttgttcaggctcagagggattattttggggcacatacttatgagaggatcgatcttcctgggtcttatcataccgagtggtctaagcttgctcagaaggcaagagtgtaatgctaggcataatttgattcttgggcttcaatttggtacccttagcttattg

SEQ ID NO: 1870 - DNA, 2077 bp, Catharanthus roseus
actagttgtttcagtcagtaccctttcactcctcgacgagtccgtcccctttcacgcgacccacgatccccaattctctataatattctactactactaccccacccccaccaccatatccacctacccgccctcctactaccctatataccccaaccttcaacttcatttcagaagctctcaaatcaccagtctaattctttaggattcttgattttccggtaattcttgattttccgggatggaaactgcagcaattacagctgatgccgtctcgaggatagggctagcagggctagccgtgatgggccaaaatttggcattgaatatcgcggagaaaggattccctatctccgtttacaatcgaactacttcaaaggtcgatgagactgtggatcgggctcaccgggaggggcagcttccattgactggtcagtacaatccgagggacttcattctctcaattcaacggcccagatctgtgattattttagtcaaagctggtgcccctgttgaccagaccattgccgccttgtctgaacatatggagcccggcgataccatcatcgacggtggaaatgagtggtatgagaatacagagcgccgcatttctgaagcctctgctagagggcttctttaccttggtatgggtgtttccggcggcgaagatggtgctcgaaatggtccttctcttatgcctggtgggtctcatccagcttatttgaacattagggatatcctcgaaaaggtcgctgctcaggtggaggatggcccctgtgttacctacataggtgagggtggctctgggaattttgttaagatggttcataatggaattgagtatggtgatatgcagctgatatctgaagcttatgatgtcttgaagaatgctggtggattgagcaattctgaattggctgacatttttgctgagtggaacaggggtgagcttgaaagctttttgattgagattactgctgatatattccaggttaaagattcagaaactggacatggagaattggtggataaaattttggataagacagggatgaaggggactggaaaatggacagtccagcaggctgcagagctctcaattgctgctccaactattgctgcttcacttgatagcaggtacttgagtggattgaaggatgaaagagaggcagcttctcagatatttaaggaggaaggcttgaaggaggagattaataatgtgggggttgtggataagaagaggttgattgatgatgttaggcaggctctgtatgcatccaagatatgcagttatgcacaagggatgaacttgttgagggccaagagtgcagagaaaggatggaatttgaatttgggcgagttggctaggatttggaaaggaggatgtatcataagggctgtattcttggataggattaagaaggcataccaaaggaatccagggttggcgaatttgctggttgaccctgagtttgctagggagttggtgcagaggcaggctgcatggagaagagtagtgggagtggccattcagaaaggtgttagtgttcctggcatgtcggccagtttgcagtattttgatacttacaggcgtgggagacttccagcgaaccttgttcaggctcagagggattattttggggcgcatacctatgaaaggattgatcttccggggtcttatcataccgagtgggcaaagcttgctcagaaggcaagagtgtaatgctagacataatatgattcttgggcttcaatttggtactcatagcttattgccattgtcatacattggatgtttcttaaggccttcatttcaatttttagttgtatctctcgaagaggatctatttcttaggcatatcgctaatgttgctgaaatttgagacattttgcagttaataacagacccagtccttatagatgtttagatcttttgaagtttcaaatgtctgcaagcaaaaagttcattgctttgttttgtactttcctgaatgctgataaaacttggcttctgatagccattctccctatgttatcatccattatttagtgtacttatatgctataatcacctagt

SEQ ID NO: 1871 - DNA, 1685 bp, Tabernaemontana elegans
ctctcacgcgacccacgatcccattagtctataatatactatactgccaccatagttctctacagcttccccagatcgacctacctacctaccacacgtccaagcaccctatatcatcgactgtgtcacttcatttcggaagctttcatctcctccgtcgctttctctgtgattcttgattttccggcatggaatctgcagcaatcacagccgatgcagtctcgcggataggcctagcggggctagctgtgatgggccaaaatttggccttgaacatagctgagaaaggcttccctatctccgtctacaatcgtacgacttccaaggtggatgagactgtggatcgggctcaccgggagggcaagtttccgttgattggccagcacaatccgagggacttcattctctcaatccaacggcccagatctatcatcattttagtaaaagctggtgctcctgttgaccagaccatcgccgccttgtccgaacacatggagcctggcgacaccatcatcgatggtggcaacgagtggtatgagaacactgagcgccgcatttctgaagcctctgctaaagggcttctttaccttggtatgggtgtctccggaggcgaggatggtgctcgtaatggtccttctcttatgcctggtgggtctcaccaagcttatttgaacataagagacatcctcgaaaaagtcgccgctcaggtggaggatggcccctgtgtcacctacataggtgaaggtggctcagggaattttgttaagatggttcataatggaattgagtatggtgacatgcagctgatatcggaagcctacgatgtattgaagaatgctggtgggttgagcaattctgaattggctgatatttttgcagaatggaaccgtggcgagcttgaaagctttttaattgagattactgccgacatattccgagtgaaagattcagagactggacatggagagttggtggataaaattttggataagacggggatgaaggggaccggaaaatggacagtccagcaggcagcggagctctctattgctgctccaacaattgctgcttcgcttgatagcaggtatttgagtggcttgaaggatgaaagagaagcggcttcacagatatttaaggaggaagggctgaaggaggagattaataacgtgggggttgtggataagaagaggttgattgatgatgtgaggcaggctttatatgcatccaagatatgcagttatgcacaagggatgaacttgttgagggccaagagtgcagagaaaggatggaatttgaatttgggcgagttggccaggatttggaaaggtgggtgcattataagggctgtgttcttggataggattaagaaagcatacaaaaggaatcaaggtttggcaaatctgttggttgaccccgagtttgcaagggagatggtgcagaggcaggcagcatggaggagagtcgtgggattggcgattcagaaggggattagtgttcccggcatgtccgccagtttgcagtattttgatacttacaggcgtgggagacttccagcaaaccttgttcaggctcagagggattattttggggcacatacctacgaaaggatcgatcttccgggctctcatcatactgagtggtcaaaacttgctcagaaggcaagagtgtagtgctagaatattttg

SEQ ID NO: 1872 - DNA, 1766 bp, Vinca minor
atttacagagctcccatttcattcttgtattttccggcgatggaatccgtagcaatgggagcatcaagaattggccttgctgggctagctgtaatgggtcaaaatctagccttaaatatagctgagaaaggctttccaatttcagtctacaatcgtactatttccaaggtcgatgaaaccgttgaccgtgctcaccgggaaggagaactcccgttgaccggccagtacgatcctaaagacttcattctctcaatccaaaagcccagatccgttatcattttagtcaaagccggagctccagttgaccagacaatcgccaccttatcggaatacatggatcccggcgacaccatcatcgacggcggaaatgagtggtacgagaataccgaacgccgtattactgaagcttcttctaaagggcttctttatttaggtatgggtgtttccggtggggaagacggtgctcggaatggtccttctcttatgcctggtgggtcccacaaggcgtacttgaacatcagggatatactcgaaaaagttgctgctcaggtggagaatgatggtccctgtgttacctatataggtgagggtggttctggtaattttgttaagatggttcataatgggattgagtatggtgatatgcaattgatttctgaagcttatgatgttttgaagaatgctggggggttaagtaattccgaattggcggatattttttatgagtggaatagaggggagcttgagagtttcttgattgagattactgctgatatattcaaggttaaagattatgagtctggagaaggggaattggtggataagattttggataaaactgggatgaaagggaccgggaaatggacggtccagcaggcggctgagctgtcgattgctgctccaactattgctgcttcacttgatagtaggtatttgagtggattgaaggacgaaagagaggcggcttcgaatattttcaaggaagaagggttgaaagaggaggttaacaatgtgggggatgtggataagaagaggttgattgatgatgttaggcaggctttatatgcatccaagatttgtagttatgcacaagggatgaacttgttgaggtccaagagttctgaaaagggatggaatttgaatttaggcgaaatggctaggatttggaaaggagggtgtattataagggctgttttcttggataggatcaagaaagcatacaaaaggaatcaagggttggcaaatttgttggttgatcctgaatttgctagggaaatggtgcagaggcaggcggcgtggaggcgagtagtcggattggcggttcagaagggtattagtgttcctggaatgtcagccagtttgcagtatttcgatacttaccgccgtgggagacttccggctaaccttgttcaagctcaaagggattattttggagcacatacctatgaaaggatcgatcttccgggggcttatcataccgaatggtccaagcttggtcagaaggaaagagtgtaatgctaggcattgtttgattcttgggcttcaaacttgatactcttagctttattgccattattatacattggatgtttcttgaggcctttgtttcaatttttagttgtatcctttgctgaggatatatatttcttgggcattatataaaatgttgctgaaaatttgagtttttccccctctatttttgcagttaataattagagatcccagcccttagatgtttttgtgctttgaaacttttgaatgatctc

SEQ ID NO: 1873 - DNA, 1690 bp, Lippia dulcis
gctatggaggcagcgacgctctcgcaaattggtctagcaggccttgctgtaatgggccaaaacctagccctcaacatcgccgagaaaggctttccaatctccgtctacaaccgcaccacctccaaggtcgacgaaaccctagatcgtgcccaccgcgaaggtcaacttcctctcaccgggcactacaatcccaaagatttcgtcctctcgctcaaaaaccccgctcagttatcatttagtcaaagccggcgcccccgtcgaccagactatcgcggctctctccgcctacatggagcccggcgacaccatcatcgacggcggaaacgagtggtacgaaaacaccgagcgccgcatggtcgacgcgtcagcaacggtttgctgtatttaggaatgggggtttcggggggcgaagaaggggccagaaatgggccgtctctgatgcccggtggatctcacagggcttacttgaatatacacaatatacttgagaaggtcgccgctcaggttgacgatggaccttgcgtcacttatattggcgaagggggttctggtaattttgtcaaaatggtgcataacggaattgaatacggagatatgcagctgatatcagaggcgtatgatgtgttgaagaatgctggaggtctgaccaacgaggaactggctgagattttcggcgagtggaatcgaggtgagttggagagtttcttaattgaaattacatctgatatttttaaggtgaaggatgaggaaacgggtaaagggcatttagtggataagattctggataagactgggatgaaaggtacagggaaatggactgtgcagcaagcggctgagctctccatagctgctcccaccattgcggcttcattagacagcaggtacatgagtggcttgaaggaagagagagaagcagcagctgagattttcaagaaagagggtttgacggaggagatcaacaacatatcttcggtagacaagaagaggttgatcgatgatgttagacaggccctttatgcatccaaaatttgcagttatgcacagggcatgaatttgttgagatccaagagtatggagaagggttggggtttgaatttgggggagttagctagaatatggaaaggtggatgcattattagggctgttttcttagacagaattaagcaagcatatgtgagaaatccagggttggcaaacttgttggtggaccctgaatttgcgagggagatggtgcagagacaggcagcatggaggagagttgtgggcttggcaattcagaagggtattagtgttcctgggatgtctgctagtttgcagtattttgatacttataggcgtgggaggcttccagctaatcttgtgcaggctcaaagggactactttggggcacatacttatgagaggattgatcgttctggagcataccatactgaatggtccaagcttgctaggaaagctagagtgtaatgggaaaggtgagacttgaggttcctttgctgtattttggctgatgatattgttctatcttgcatttcttgaggcatttgcttgaatttgaattgtaccaattgatgaggattgtgttgctctgaaaaatacttttgtagccatctgcattgttgtgtatgcagtttaataagagtctttttccttattattctggaaatgattaattacctattctgctgtt

SEQ ID NO: 1874 - DNA, 1791 bp, Orobanche aegyptiaca
cattcttcctttctctatcactccgccattgccaaatccaagatcgcaacttgagctttgacagccaaagaaatggagtcagctgtgctatcccgaatcggcttagccggactagccgtaatgggccaaaacctagctctcaacatcgccgagaaaggtttcccaatctccgtctacaatcgcaccatctccaaagtcgacgaaactctagatcgcgcccaccgcgagggccagcttccactctccggccactacacccccagagatttcgtcctctccatcaagaagccccgctcgatcatcatcctagtcaaagccggcgcccccgttgaccagaccatcgccgccctctccgctcacatggagcccggcgacaccatcatcgacggcggaaacgagtggtacgagaacaccgagcgccgcatggtggacgcctcggccgacggcttgctctatctcgggatgggggtctcgggtggggaagacggggcccggaacgggccctccctgatgcccggagggtcccataaggcctacctcaacatccacaacatactcgagaaggtcgcggctcaggtcgacgatgggccgtgcgtcacctacatcggcgaaggcgggtcgggtaatttcgtcaaaatggttcataacgggatcgagtatggtgatatgcagctgatttctgaggcgtatgacgtgttgaagaacgtcggagggttaggcaatgaagaattagcggaaattttcggagaatggaatagtggagagctcgagagcttcttgattgagataacctgtgatatttttaaagtggaggatgaagtaactggtaatgggcatttagtggataagattttggataagaccgggatgaagggtaccgggaaatggaccgtgcagcaggcggctgagctgtcaatcgctgcccctacaattgctgcttcattagacagtaggtatatgagtggtttaaaagaagagagagaggctgcagccgagattttcaagaacgaagggttaaaagaggaaattaacaatgttggctcagttgataagaagagactgatcgacgatgtaagaaaggcactttatgcgtccaagatttgtagttacgcgcaggggatgaatttgttgagggccaagagtacggagaagggttggggtttgaatttaggcgagctagctaggatttggaaaggcgggtgtattatacgggccgttttcttggacaggatcaagcaagcttatcaaaggaatccggggctcgcgaatttgttggtcgatcctgaattcgctagggagatggtgcagagacaggcggcctggaggagagttgtgggtttggcgattcaaaagggtataagtgtcccgggaatgtcggctagtttgcagtattttgatacatataggcgtggaaggcttcccgccaacctcgtgcaggcacaaagggactactttggtgcacatacttatgaaagggttgattgtggaggatcataccataccgagtggtcaaagctcgctcggaaggcaagggtgtaggggagaaggtatgatttggtttggttacaatttggtttaattgatattggttttagtccgggatttctttaaggcattgagttgaatttgagttgtatcctttgatgaggatttgttgttgctatgctcgcaaacaaaaaaaatgtttatgcagttaataagagaggagcatatgttttgatggtactttcgaaatggtcgtctttgttgctactgagatgtttggatatatgctcatgatgtctttggcgt

SEQ ID NO: 1875 - DNA, 1864 bp, Mimulus guttatus
aacccttacactctgcaaaattcaagatcggatttttaaggtagcacagcgcagcaggaaaaatcaacaatggagtccgccgcgctatctcaaatcggcctcgccgggctcgccgtgatgggccaaaacctcgccctcaacatcgccgagaaagggttcccaatctccgtctacaaccgcacaatctccaaagtcgacgaaaccctagatcgggcccaccgcgaagggcagctcccactcaccggccactacaaccccaaagacttcgtcctctcgatcaagaagccccgctcaatcatcatcctcgtcaaggccggcgcccccgtcgaccagaccatcgccgccctctccgcccacatggagcccggcgacaccatcatcgacggcggcaacgagtggtacgagaacaccgagcgccgcatcgtcgacgcctccgccaacggcctcctctacctcgggatgggcgtctccggcggcgaggacggcgcccgtaacggaccctccctcatgcccggcggctcccaccgcgcctacctcaacatccacggcatcctcgacaaggtcgccgcccaggtggacgacggcccctgcgtcacctacatcggcgaaggagggtccggcaatttcgtcaaaatggtgcacaacggaatcgagtacggcgatatgcagctgatttcggaagcctacgatgtgttgaaaaacgttgggggcttgagcaacgatgagctggcagagattttcgaggagtggaaccgcggcgaactcgagagtttcttgatcgagatcacgaccgatattttcaaggtgaaagatctcgaaacgggcaacgggcatttagtggacaaaatcctggacaaaaccgggatgaagggtaccggaaaatggaccgtgcagcaagcggccgagctctcaatcgccgcccccacgatcgccgcctcactggacagtcggtacatgagcggcttgaaggaggagagagaagctgcatcagagattttcaagaacgaagggttgaaagaggagatcgaaaatgtgggcgacgtggacaagaaaagattgatcgacgatgttaggcaagcgctctacgcgtcgaaaatttgcagctacgcacaagggatgaacttgttgagggcaaagagtatggagaagggttggggtttgaatttgggggagttggctaggatttggaaaggaggttgtattatccgggcggttttcttggataggattaagcaggcttatcagaggaatccgggattggctaacttgttggtcgaccccgaattcgctcgggaaatggtgcagaggcaatcggcatggaggagagttgtcggggtggctatacagaagggggttagcgtacccggaatgtctgcgagtttgcagtatttcgatacgtacaggcgcgggagactccctgcgaatcttgtgcaggcgcagagggactatttcggtgcgcatacctacgagagaattgatctgccgggggcgtaccatacagagtggtccaagcttgctagaaatgccaaactgtaggtggggagtgctatttatgtatcgagatggtatgatttggttatttcttattgttttgagtttcggttattttcttgaagggtttttaatttgaaatttgagttgatgaggatttcgttgttcgaaaaaagaaattacttttgtaggggttctgcattgtttgtgtatgcagttaaataagatgggaatgccttttcgaacgatattattctatacgggctgtcctttgtgatctgtttggcattctatgatgtttatgttttagccttttattgtcatgttgattgatgctcatgtctatactggtttcgaattacggtttcgaatt

SEQ ID NO: 1876 - DNA, 1688 bp, Arnica chamissonis
ttttctccccaaaacccctcaaaaacctatcaatggaggctgctactctctcccgcatcggcctcgccggacttgcagtcatgggccaaaacctagccctcaacatcgccgagaaaggcttcccaatctccgtctacaatcgcaccacttccaaagtcgacgaaaccctagatcgagctcacaacgaaggccagctcccgttaaccggccactatacccctcgcgatttcgtactttcaatccagaagccccgatccgtcatcatcctcgtgaaagccggtgctccggttgaccaaacgattgccgcgttgaccgaacacatggagcctggagacaccataatcgacggcggaaacgagtggtacgagaacaccgaacggcgaattgttgaagcgaacagcaaaggattgctttatctcggaatgggagtctccggcggcgaagaaggtgcgcgaaacggtccgtcgttgatgccaggtggttcgtatgatgcttataataatattaaagatattgttgaaaaagtggctgcacaggttgaagatggaccttgtgttacatacatcgggtcgggcgggtcgggtaattttgttaaaatggttcataatggaattgaatatggtgatatgcaattgatttctgaagcttatgatgttttgaaaaatgttggtgggttaagcaattcagagttagctgaaatttttgatgagtggaataaaggggaattagagagttttttgattgaaatcacagcagatatttttaaagttaaagatgagcatggtgaaggggagttggtagataagattttggataaaaccgggatgaaggggacgggtaagtggacggtccaacaggcggctgagctgtctgttgctgctcccactatagctgcaagtctggactgtcggtatttgagtggtttgaaggatgagagggaggctgccgccaaggtgttggcggaagcagggttgaaagaggaggtgggaacagttagaagtgggattgataagaagaggttgattgatgatgtgaggcaagctttatatgcttccaagatttgtagttatgcacaagggatgaacttgttgagggctaagagtcttgagaaaaattgggacttgaattttggtgaattagctaggatttggaaaggagggtgtattatccgggcggttttcttggataggatcaagaaagcctaccagcgaaaccctgatcttgcgagtctggtggtggatcctgattttgcgaaggaaatggtgcagcgtcaggctgcgtggaggagggtggtggggttggccatctctgctgggattagtactccgggaatgtgtgctagtcttgcgtattttgacacctatagacgggctcggttgcctgcaaatcttgttcaagctcaaagggacttgtttggtgctcatacttatgagcgggttgatcgccctggtgcttttcataccgaatggacgaagcttgctaggaagaacgcttgaaacgggaataaaaagtataccggtaagtgtttcacattggtgatgaacttatttgaagatttttactgtttttgcttgattatgggttgaatttgttgatgaggatggcatagcaattgttgtagaattttcttgacattgataataagttatgcatgccattgaagcttaatgcatgttttatgtcatttt

SEQ ID NO: 1877 - DNA, 1931 bp, Helianthus annuus
gacgacccacctttcgtgggttatacagccaaccaacgtttcacttcatcgacgagtccgtcaccactcaccaaccccatcaatcccattttataaacaccatccccaacattcatttcaatctccacactccaaaaacccacaaaaactctcaccaaaaccctcaacaacatggaggctgcaactctctctcgcatcggcctcgctggcctcgcagtcatgggccaaaacctcgccctcaacatcgccgaaaaagggttccctatctctgtctacaaccggaccacttctaaagtagacgagactctagatcgggctcataatgaaggccagcttccgttgactggtcactacacgcccagagactttgttctttcgattcagaagccccgatctgtaattatccttgtgaaagcgggtgcccctgtggatcagactattgctgctctggcggcccatatggagcctggggatactattattgatggtgggaatgagtggtatgagaacactgagagacgtattgttgaggccgctgataaaggattgctttatctcggaatgggagtctctggcggtgaagagggtgcacgaaacgggccgtcgttgatgccaggtgggtcttttgaagcttataataatatcaaagacatcgttgcaaaagttgctgcgcaggttgaagacggaccatgtgtcacgtacattggtgaaggtgggtctggtaatttcgtcaaaatggttcataacgggatagagtatggtgacatgcaattgatttctgaagcttacgacgttttgaaaaatgttggtgggttgagtaacgatgagttagccgagattttcgatgagtggaaccgaggggagttagagagtttcttgattgaaatcactgctgatatctttaaagtgaaagatgagcacggtgaagggtggttggtggataagattctcgataagacggggatgaaggggacgggtaaatggactgtccagcaggcggctgagctgtccgttgcggccccaactattgccgccagtctggactgtcggtatttgagtggtttaaaggatgaaagagaggctgccgcgaaggttttgtcggatgcggggttgaaagaagaggtgggaagtgtgagaagcgggatcgataagaagagattgattgatgacgtgaggcaagcgttatacgcttcaaagatatgtagttatgcacaagggatgaatttgttgagggcgaagagcgttgagaaaaattggaacttgaatttcggagaattagctaggatttggaaaggagggtgtatcatcagggcggttttcttggaccggatcaagaaagcgtaccagcggaaccctaatctcgcgagtctggtggtggacccagatttcgctaaggagatggtgcagcgtcaggcggcgtggaggagagtcgtcgggctagcgatctcggctgggattagtacaccgggaatgtgtgctagtcttgcttattttgacacttacagacgggctcggttgcctgctaaccttgttcaagctcaaagggacttgttcggggctcatacttatgagagggtggatcgcgagggtgcttttcataccgaatggacgaaactcgctaggaagagcggttgaagtaaaaaagaaaatcggtaaggcttcaccttgttggtgaacttgtttggtggtttttactgtttttgcttggattattggttgtatttcttgatgaggattatatcgaattcggcgttgcattgttgtagaattttcttaacattattaataagttatgcatgccattgaagcttcattgagttctgatgtcatatgattaatttgcaaagattcccttgttgaatgagtacccattataactaaatggacaagtgacgagtaagttcattgaattgtagtgggagacttagtag

SEQ ID NO: 1878 - DNA, 1846 bp, Arabidopsis lyrata
tgtctcttggctccatcgacgagtccgtcactttcaccgtataaatatctccgccactctctctcccatcaccaccaacctccgtcaaaacgctaacctctctctctctctctctctctctctatctctcaaaaatggagtccgccgctctatctcgcatcggtctcgccggtcttgcagtcatgggacaaaacctcgctttaaacatcgccgagaaaggattcccaatctccgtctacaatcgaaccacttccaaagtcgacgaaaccctagatcgtgcctccgacgaaggaaatctcccagtcgctggtcaatactctcctcgcgatttcgttctctccatccaacggcctagatccgttatcatccttgtcaaagccggtgctcccgttgaccaaacaatctcagcactctccgaatacatggagcctggtgattgtatcatcgacggtggaaatgagtggtatcagaacacagaacgacgaatcgttgaagctgagaagaaaggattgctttatttaggtatgggagtctccggtggtgaagaaggtgctcgtaatggtccttcgcttatgcctggtggatctttcactgcgtataataatgttaaagatattcttgagaaagttgctgctcaagttgaagatggtccttgtgttacttacattggagaaggtggatctgggaattttgtgaaaatggttcataatgggattgaatatggtgatatgcagctgatttccgaggcgtatgatgtgttgaagaatgttggtggattgagtaatgatgaattggctgagatcttcacggagtggaatcgaggtgagcttgagagtttcctggttgagattacttcggatatttttagggttaaggatgattatggtgatggagagttagtggataagattttggataagactggtatgaaaggtactgggaaatggacggttcagcaggcggctgagctttctgttgcggcgcctactattgctgcgtcgttggattgtagatacttgagtggattgaaggatgagagggagaatgctgctagagtgttggaagatgctggattgaaggaggatattggttctgcgtctcgtggtgttgataagaagaggttgattgatgatgtgaggcaagctttgtatgcttctaagatctgtagttatgctcaaggtatgaatttgcttagggctaagagtttagagaaagggtgggatttgaatttgggtgaaatggctaggatttggaaaggcgggtgtattatcagggcggtattcttggacaggatcaagaaagcttatcagagaaacccgaatttggcaagcttagtggttgatcctgattttgctaaagagatggttcagaggcaagctgcgtggaggagagtggtgggacttgctatctctgctgggataagtacaccaggaatgtgcgcaagtttagcgtatttcgacacttacaggcgtgcgagattacctgcgaatctggttcaggcgcagagagatctctttggagctcatacatatgagagaaccgatcgtcctggtgcgtaccacactgaatggactaagcttgcaaggaagagtcagtaaagcgtagactcagtcccttgattgaggctttaggcggcatagaacacgaaaacaaattgtttcagcgtatttttgttgagttataataagaaatgcaatgcccttgacgctctgtatctgtctgttgttgatatctggagagtttcctttaattctctgttctgctttggttcatattttgaatttgaatttgatatctttgttgatattttgaaagctcaaagtcttgataattcttcggcagtctt

SEQ ID NO: 1879 - DNA, 1896 bp, Helianthus annuus
ggggagtccgtcaccactcaccaaccccatcaatcccattttataaacaccatccccaaccttcatttcaatctccacactccaaaaacccacaaaaactctcaccaaaaccctcaacaacatggaggctgcaactctctctcgcatcggcctcgctggcctcgcagtcatgggccaaaacctcgccctcaacatcgccgaaaaagggttccctatctctgtctacaaccggaccacttctaaagtagacgagactctagatcgggctcataatgaaggccagcttccgttgactggtcactacacgcccagagactttgttctttcgattcagaagcctcgatctgtaattatccttgtgaaagcgggtgcccctgtggatcagactattgctgctctggcggcccatatggagcctggggatactattattgatggtgggaatgagtggtatgagaacactgagagacgtattgttgaggccgctgataaaggattgctttatctcggaatgggagtctctggcggtgaagagggtgcacgaaacgggccgtcgttgatgccaggtgggtcttttgaagcttataataatatcaaagacattgttgcaaaagttgctgcgcaggttgaagacggaccatgtgtcacgtacattggtgaaggtgggtctggtaatttcgtcaaaatggttcacaatgggatagagtacggtgacatgcaattgatttctgaagcttacgacgttttgaaaaatgttggtgggttgagtaacgatgagttagccgagattttcgatgagtggaaccgaggggagttagagagtttcttgattgaaatcaccgctgatatctttaaagtgaaagatgagcacggtgaagggtggttggtggataagattctcgataagacggggatgaaggggacgggtaaatggacggtccagcaggcggctgagctgtccgttgcggccccaactattgccgccagtctggactgtcggtatttgagtggtttgaaggatgaaagagaggctgccgcgaaggttttgtcggatgcggggttgaaagaagaggtgggaagtgtgagaagcggaatcgataagaagagattgattgatgacgtgaggcaagcgttatacgcttcaaagatctgtagttatgcacaagggatgaatttgttgagggcgaagagtgttgagaaaaattggaacttgaatttcggagaattagctaggatttggaaaggagggtgtatcatcagggcggttttcttggaccggatcaagaaagcgtaccagcggaaccctaatctcgcgagtctggtggtggacccggatttcgctaaggagatggtgcagcgtcaggcggcgtggaggagagtcgtcgggctagcgatctcggctgggattagtacaccgggaatgtgtgctagtcttgcttattttgacacttacagacgggctcggttgcctgctaaccttgttcaagctcaaagggacttgttcggggctcatacttatgagagggtggatcgcgagggtgcttttcatactgaatggacgaaactcgctaggaagagcggttgaagtaaaaaagaaaatcggtaaggcttcaccttgttggtgaacttgtttggtggtttttactgtttttgcttggattattggttgtatttcttgatgaggattatatcgaattcggcgttgcattgttgtagaattttcttaacattattaataagttatgcatgccattgaagcttcattgagttttgatgtcatatgattaatttgcaaagattcccttgttgaatgagtacccgttataactacatggacaagtgacttgtaagttcattgaattgtagttggatacttagtagatcaattaataaagc

SEQ ID NO: 1880 - DNA, 1746 bp, Arabidopsis lyrata
ggctccatcgacgagtccgtcattttcacagtataaatatctccgcccactctctctcatcagtcccactacctcattttctctctctaccaaaaatcctaagctctctctatctccaatggagtccgccgcactatcccgaattggtctcgccggactcgccgtaatgggccagaacctcgccttaaacatcgccgagaaaggtttcccaatctcagtctacaatcgtaccacttccaaagtcgacgaaaccctagatcgagccgccgtcgaaggaaacctcccagtctccggccaatactcgcctcgcgatttcgtcctctcgatccaacggcctagatctctcatcatcctcgtcaaagctggagctcccgttgaccaaacaatcgacgcgttctccgagtacatggagcccggagattgcatcatcgacggtggaaacgaatggtatcagaacacagagcgacggatctccgaagcagagcaaaaaggattgctctatttaggtatgggagtctccggcggcgaagaaggtgctcgtaacggtccttcgttaatgcctggtggatcatttcaagcttatgataacatcaaagacatcttggggaaagtcgcagctcaagttgaagatggaccttgtgttacttacatcggagaaggtggatctggaaatttcgtgaagatggttcataacgggattgagtatggagatatgcaattgatctctgaagcgtatgatgtgttgaagaacgttggtggtttcagcaatgaagagcttgcggagattttcacggagtggaatcgaggtgagcttgagagtttcttggttgagattacttctgatatatttagggttaaggatgagtttggtgatggagagttagttgataagattttggataagactggtatgaaaggtaccgggaaatggacggtgcagcaagcggcggagctgtctgtggcggctccgacgattgctgcttcgttggattgtaggtatttgagtgggttgaaagatgagagggagaatgctgcgaaagtgttgagggaagctggtttgaaggaagagattggttctgcgtctagcggaatcgataagaagagattggttgatgatgttaggcaagctttgtatgcttcgaagatttgtagttatgctcaagggatgaatttgcttagagctaagagtttagagaaaggttggaacttgaatttcggtgaattggctaggatttggaaaggtgggtgtattataagagcggttttcttggataggatcaagaaagcttaccagaggaacccggatttggccagtcttgtggttgatcctgagtttgctaaagagatggttcagagacaagctgcgtggagaagagtggtgggcttggctgtttccgcagggattagcacacctggaatgtgcgcaagtcttgcgtatttcgatacttatagacgtgctagattgcccgcaaatctggttcaggcgcagagagatctctttggagctcatacttacgagaggaccgatcgtcccggtgcgtaccacaccgaatggactaagcttgctaggaagaacaattgaacactccattaacgtttttttataacccttttgtctttgctttttataagcatgggaactgggattcaaagtttcaaaccacagattgtttcacgagtcttttgttcagatttcagaataagaaatgcagcagcaccttgatttttgttttagtttctgaccat

SEQ ID NO: 1881 - DNA, 1810 bp, Arabidopsis thaliana
ggctccatcgacgagtccgtcattttcacagtataaatatctccacccactctctctcatcactcccactacctcatttttctctctctacctaaccaatcctaagctcatctctctatctccaatggagtccgccgcactatcccgaatcggtctcgccggactcgccgtgatgggccaaaacctcgccttaaacatcgccgagaaaggtttcccaatctcagtctacaatcgaaccacttccaaagtcgacgaaaccctagatcgagccgccgtcgaaggaaacctcccagtctccggccaatactctccccgcgatttcgtcctctcgatccaacggcctagatctctcatcatcctcgtcaaagctggagctcccgttgaccaaacaatcgacgccttctccgaatacatggagccaggagattgcatcatcgacggtggaaacgaatggtatcagaacacagagcgacggatctccgaagctgagcaaaaaggattgctctatttaggtatgggagtctccggcggcgaagaaggagctcgtaacggtccttcgttaatgcctggtggatcatttcaagcttatgataacatcaaagatattttggagaaagtcgcagctcaagttgaagatggaccttgtgttacttacatcggagaaggtggatctggaaatttcgtgaagatggttcataatgggattgagtatggagatatgcaattgatctctgaagcttatgatgtgttgaagaacgttggtggattaagcaacgaggagcttgctgagattttcactgagtggaattcaggtgagcttgagagtttcttggttgagataacttctgatatatttagggttaaggatgagtttggtgatggagagttagttgataagattttggataagactggtatgaaaggtactgggaaatggacggtgcagcaagcggcggagctgtctgttgcagctccgacgattgctgcttcgttggattgtaggtatttgagtgggttgaaagatgagagggagaatgcagcgaaagtgttgagggaagctggattgaaagaagagattggttctgcgtcgagtggaatcgataagaagagattggttgatgatgttaggcaagctttgtatgcttccaagatttgtagttatgctcaagggatgaatttgcttagagctaagagtttagagaagagttggaacttgaattttggtgaattggctaggatttggaaaggtggttgtattataagagcggttttcttggataggatcaagaaagcttaccagaggaacccggacttggctagtcttgtggttgatcctgagtttgctaaagagatggttcagagacaagctgcttggagaagagttgttggtttggctgtttctgctgggattagcacgcctggaatgtgtgctagtcttgcgtatttcgatacttatagacgtgctagattgccggcgaatctggttcaggcgcagagagatctctttggagctcacacttatgagagaaccgatcgtcctggtgcgtaccatactgaatggactaagcttgccaggaagaaccattgaaaaatccctttctgtttttgtaaaagccctatttgtcttgcttatttttgagcaattggaaatgggatttcaaaccacattgtttaacacgagtattttgttcagatttcagaataagaaatgcagcagcaccttgatttttgtttttgtttctgaacatctttgcttttaaatttgtaaaacatatctcccctgtctttaatagatcgaatgtctagacga

SEQ ID NO: 1882 - DNA, 1745 bp, Eutrema halophilum
aagtttgcagtttgtcccttggctccatcgacgagtccgtcactttcactgtataaaatatctctctctctcactcatcattcacagcccatttctctccctctctatctcctccaaaatcctacgctctctgcaatggagtctgccgctctatcccgaatcgggctcgccggtctcgccgtaatgggccagaaccttgccttgaacatcgccgagaaaggtttcccaatctcagtctacaatcgaaccacatcgaaggtcgacgaaaccctagatcgagcctccgtcgaaggaaacctaccagtttccggccaatactctccgcgcgatttcgtcctctcgatccaacgaccgagatcccttatcatcctcgtcaaagccggagctcccgttgaccatacaatcgccgccttctccgagtacatggagcccggagattgcatcatcgacggtggaaacgaatggtatctgaacacagagcgacggatctctgaggcggagcagaaaggactgctctatataggcatgggagtctccggcggcgaagaaggagctcgtaacggtccgtcgcttatgcccggcggatcgtttcaggcgtatgacaacatcaaagatatcttggagaaagtcgcggctcaggtagaagatggaccttgcgtaacttacatcggagaaggcggatctggaaattttgtgaagatggttcataatgggattgagtatggagatatgcaattgatctctgaagcttacgatgtgttgaagaacgttggtggattgagcaacgaggagcttgcggagatcttcacggagtggaatcgaggtgagcttgagagtttcttggttgagattacttcggatatatttagggtcaaggatgagtttggtgatggagagctagtggataagattttggataaaaccggcatgaaaggtaccggaaaatggactgttcagcaggcggcggagctctctgtggctgctccgacgattgctgcctcgttggattgtcggtacttgagcggattgaaagatgagagggagaatgctgcgaaagtgttgagagaagctggattgaaggaagagattggttctgcatcgagcggtatcgataagaagagattggttgatgatgttaggcaagctctctacgcttcgaaaatctgtagttatgctcaagggatgaatctgcttagagctaagagctcagagaaaggctggaacttgaacttcggtgagctggctcggatttggaaaggaggctgcatcataagagcggttttcttggataggatcaagaaagcataccagagaaacccggatttggcaagtcttgtggttgatcctgactttgctaaagagatggttcagagacaagctgcttggagaagagtggtgggtttggctgtctctgcagggataagcacgcctggaatgtgcgcgagtcttgcatatttcgatacttacaggcgcgctagattgccggcgaatctggttcaggcgcagagagatctctttggagctcatacttatgagaggatcgatcgtcctggtgcgtatcacactgaatggtctaagcttgccaagaagagcacttgaggtttttgctttcctaaaaatcctctctttgtctttgctatttttagcaatagggaattggatttgaaccacattgtttcaagagtctttcagatttcaaaataagaaaatgcagtaccttgaattttgctttagttttctgacat

SEQ ID NO: 1883 - DNA, 1712 bp, Brassica napus
ctctctaccaactctctcaaatggagtccgccgctctctcccgcattggtctcgccggcctcgccgtcatgggccaaaacctcgccctgaacatcgccgacaaaggcttccccatctcggtctacaaccgaaccacctccaaagtcgacgaaaccctagatcgcgcctccgaagaaggcaagctcccagtctccggccaatactcccctcgcgacttcgtcctctccatccagcgccccagatccgtcatcatcctcgtcaaagccggcgcccccgttgaccagaccatctccgccctctccgagtacatggagcccggtgactgcatcatcgacggcggtaacgagtggtaccagaacacagagcgacgaatcgttgaagctgagaagaaaggattgctctacttggggatgggagtctccggaggcgaggaaggggctcgtaacggcccctccctcatgcctggaggttctttccaggcctataacaacgttaaagacattctcgagaaagtcgccgctcaggtggaggacggtccctgcgtgacttatataggagaaggcggatctgggaacttcgtgaaaatggttcataatgggatcgagtacggtgacatgcagctcatttccgaggcgtacgatgttttgaagaacgttgggggttaagcaatgacgagcttgcggagatttttacagagtggaaccgaggtgagctggagagtttcttggttgagattacttcggatatttttagggttaaggatgagtttggggatggagagttagttgataagattttggataagacgggaatgaaaggaaccgggaaatggactgttcagcaggcggctgagctctcagtggcggcgccgactatcgctgcctcgttggattgtaggtacttgagtggactcaaggacgagagggagaatgctgccaaagtgttgaaggaagctgggttgaaggaggatattggttctgcatctcatgggattgataaaaagaggttgattgatgatgtgaggcaagctttgtacgcttctaagatctgtagttatgctcaagggatgaatttgcttagagctaagagtgtggagaaggagtggaacttgaatctcggcgagatggctcggatttggaaaggagggtgtattatcagggcggtgttcttggacaggatcaagaaagcttaccagaggaacccgaacctggcgagtttggtggttgatcctgatttcgctaaagagatggttcagaggcaagctgcgtggaggagagtcgtgggtttggccatctctgcgggaataagcacgccgggaatgtgcgcgagtcttgcctacttcgacacttacaggcgtgcgagattgcctgcgaatctggttcaggcgcagagagatctctttggagctcatacgtatgagaggaccgatcgtcctggtgcgtaccacacggaatggactaagcttgctaggaaggggaattagattgttgagggttatcctctctttctcacgctttgtcttgtgcttaattctgaattcagtgtgtttgctttttccctaaagcttttcatgttgtgtagggctttgtttccatgattttaatcctttgaaaaaaagatagtttcatgcttttgaaggcatagaaaacgaaaacaaaacaaacaaattgtttccgcttattttgttcagttctaataagaaatgcaatgcc

SEQ ID NO: 1884 - DNA, 1684 bp, Brassica napus
ctctctaccaactctctcaaatggagtccgccgctctctcccgcatcggtctcgccggcctcgccgtcatgggccaaaacctcgccctgaacatcgccgacaaaggcttccccatctccgtctacaaccgaaccacctccaaagtcgacgaaaccctagatcgcgcctccgaggaaggcaagctccccgtctccggccaatactcccccgcgacttcgtcctctccatccaacgccccagatccgtcatcatcctcgtcaaagccggcgcccccgttgaccagaccatctccgccctctccgagtacatggagcccggtgactgcatcatcgacggcggaaacgagtggtaccagaacacagagcgaaggatcgtcgaagctgagaagaaaggattgctctacttggggatgggagtctccggaggcgaggaaggggctcgtaacggcccctccctcatgcctggaggatccttccaggcgtataacaatgttaaagacattctcgagaaagtcgccgctcaggtggaggatggtccttgcgtgacttatataggagaaggcggatctgggaacttcgtgaagatggttcataatgggatcgagtacggtgatatgcagctcatttccgaggcttacgatgttttgaagaacgttgggggattaagcaatgatgagctggcggagatttttacagagtggaaccgaggtgagctggagagtttcttggttgagattacttcggatatttttagggttaaggatgagtttggggatggagagttagtggataagattttggataagactggtatgaagggtaccgggaaatggactgttcagcaggcggctgagctatcagtggcggcgccgactattgctgcttcgttggattgtagatacttgagtgggctcaaggacgagagggagaatgcagccaaagtgttggaggaagctggattgaaggaggatattggttctgcgtctcgtgggattgataagaagaggttgattgatgatgtgaggcaagctttgtacgcgtctaagatctgtagttatgctcaagggatgaatttgcttagagctaagagtgtggagaaggagtggggcttgaatcttggtgagatggctcggatttggaaaggagggtgtattatcagggcggtgttcttggacaggatcaagaaagcttaccagaggaacccgaatcttgcgagtttggtggttgatcctgatttcgctaaagagatggttcagaggcaggcggcgtggaggagagtcgtgggtttggccatctctgcggggataagcacgcctggaatgtgcgcgagtcttgcctacttcgacacttacaggcgtgcgagactgcctgcgaatctggttcaggcgcagagagatctctttggagctcatacgtatgagaggaccgatcgtcctggtgcgtaccacacggaatggactaagcttgctaggaaggggaattagattgttgaggttatcctctctttctcacgctttgtcttgtgcttaattctgaattcagtgtgtttgatttttccccgaaagcttttcatgttgtgtagggctttgtttccatgattttaatcctttgaaaaaaagagagtttcatgcttttgaaggcatagaaaacgaaaacaaaacaagcaaattgtttcagcttatttt

SEQ ID NO: 1885 - DNA, 1937 bp, Brassica rapa
cgttctgagtccatcagcatcttacaacctcacctaacgaaacgagattcaactcttcaccagtttgttaagtcgccttcccctttgtctcttggctccatcgacgagtccgtcactttcacccttataaatatctccgccactctcccccccatcaccaacccctctctccaactctctaccaactctctcaaatggagtccgccgctctctcccgcatcggtctcgccggcctcgccgtcatgggccaaaacctcgccctgaacatcgccgacaaaggcttccccatctccgtctacaaccgaaccacctccaaagtcgacgaaaccctagatcgcgcctccgaggaaggcaagctcccagtctccggccaatactcccctcgcgacttcgtcctctccatccagcgccccagatccgtcatcatcctcgtcaaagccggcgcccccgttgaccagaccatctccgccctctccgagtacatggagccaggggactgcatcatcgacggcggtaacgagtggtaccagaacacagagcgaaggatcgtcgaagctgagaagaaaggattgctctacttggggatgggagtctccggaggcgaggaaggggctcgtaacggcccctccctcatgcctggaggatccttccaggcgtataacaatgttaaagacattctcgagaaagtcgctgctcaggtggaggatggtccctgcgtgacttatataggagaaggcggatctgggaacttcgtgaagatggttcataatgggatcgagtacggtgatatgcagctcatttccgaggcttacgatgttttgaagaacgttgggggattaagcaatgatgagctggcggagatttttacagagtggaaccgaggtgagctggagagtttcttggttgagattacttcggatatttttagggttaaagatgagtttggtgatggggagttagtggataagattttggataagactggtatgaaaggtactgggaaatggactgttcagcaggcggctgagctatcagtggcggcaccgactattgctgcttcgttggattgtaggtacttgagtggactcaaggaggagagggagaatgcggccaaagtgttggaggaagctggattgaaggaggatattggttctgcgtctcgtgggattgataaaaagaggttgattgatgatgtgaggcaagctttgtacgcttctaagatctgtagttatgctcaagggatgaatttgcttagagctaagagtgtggagaaggagtggggcttgaatcttggtgagatggctcggatttggaaaggagggtgtattatcagggcggtgttcttggacaggatcaagaaagcttaccagaggaacccgaatcttgcgagtttggtggttgatcctgatttcgctaaagagatggttcagaggcaggcggcgtggaggagagtcgtgggtttggccatctctgcggggataagcacgcctggaatgtgcgcgagtcttgcctacttcgacacttacaggcgtgcgagactgcctgcgaatctggttcaggcgcagagagatctctttggagctcatacgtatgagaggaccgatcgtcctggtgcgtaccacacggaatggactaagcttgctaggaaggggaattagattgttgaggttatcctctctttctcacgctttgtcttgtgcttaattctgaattcagtgtgtttgatttttccccgaaagcttttcatgttgtgtagggctttgtttccatgattttaatcctttgaaaaaaagagagtttcatgcttttgaaggcatagaaaacgaaaacaaaacaagcaaattgtttcagcttattttgttcagttctaataagaaatgcaatgccctgactctgttttttttttgatggaataccaaatttattgatcaaacaaa

SEQ ID NO: 1886 - DNA, 1750 bp, Brassica rapa
tttcgtgtctgtcccttggttccatcgacgagccccgtctctttcactgtataaaaatatctctcctccaacaatctctctctctcatcactctcatttcactttctccatctctctctctacactctcttctccaatggagtccgccgctctctcccgcatcggcctcgccggtctcgccgtaatgggccagaacctcgccttgaacatcgccgagaaaggcttcccaatctccgtctacaaccggaccacctccaaagtcgacgagaccctagatcgcgccgccgtcgaaggaaacctcccggtctccggccaatactccccgcgcgacttcgtcctctcgctccaacgccctcgttccctcatcatcctcgtcaaagccggagcccccgtcgaccagaccatcgctgccttctccgagtacatggagcccggagactgcatcatcgacggaggaaacgagtggtaccagaacacagagcgacggatctccgaagctgagcagaaaggattgctctacttggggatgggagtctccggcggcgaggaaggggctcgtaacggtccctcgctgatgccaggagggtcgtttcaggcgtatgataacatcaaagacatcttggggaaagtggcggctcaggttgaggacgggccttgcgttacttacatcggagaaggcggatctggaaacttcgtgaagatggttcataatgggattgagtatggagatatgcagcttatctctgaggcttacgacgtgttgaagaacgttggtgggttgagcaacgaggagcttgcggagatcttcacggagtggaaccgaggtgagctcgagagtttcttggttgagattacttccgatatctttagggttaaggatgagtttggtgatggagagttggtggataagattttggataagactggtatgaaagggaccgggaaatggactgttcagcaggcggcggagctctctgtggcggcgccgacgattgctgcttcgttggactgtcggtacttgagcgggttgaaagatgagagggagaatgctgctaaagtgttgagagaagctgggttgaaggaagagattggttctgcgtcgagcgggatcgataagaagaggttggttgatgatgttagacaagctctctacgcttcgaagatatgtagttacgcgcaagggatgaatctgcttagagctaagagcttagagaagagctggaacttgaacttcggtgagttggctaggatttggaaaggagggtgtatcataagggcggtgttcttggataggatcaagaaagcttaccagaggaacccggatttggcgagccttgtggttgatcctgagtttgctaaagagatggttcagagacaagctgcttggaggagagtcgtgggtttggctgtctctgctgggataagcacccctggaatgtgcgcgagtcttgcgtatttcgacacttataggcgtgcgagattgccggcgaatctggtgcaggcgcagagagatctatttggagctcatacttacgagaggactgatcgttctggtgcgtaccacacggagtggactaagcttgctaggaagagcaattgaggttatttgtattcgtggaaccgttgtcttgcttatggtggttttgttaaacccaaattgtttcgagagcattttgttaagatttcgaaaataagaaatgcactacattgatctttgtttattctagtatgtctggctactgctagttca

SEQ ID NO: 1887 - DNA, 1729 bp, Brassica rapa
  misc_feature (144)..(144): n is a, c, g, or t
  misc_feature (168)..(168): n is a, c, g, or t
  misc_feature (231)..(231): n is a, c, g, or t
  misc_feature (237)..(237): n is a, c, g, or t
tggttccatcgacgagccccgtctctttcactgtataaaaatatctctcctccaacaatctctctctctcatcactctcatttcactttctccatctctctctctacactctcttctccaatggagtccgccgctctctcccgnatcggcctcgccggtctcgccgtnatgggccagaacctcgccttgaacatcgccgagaaaggcttcccaatctccgtctacaaccgnaccacntccaaagtcgacgagaccctagatcgcgccgccgtcgaaggaaacctcccggtctccggccaatactccccgcgcgacttcgtcctctcgctccaacgccctcgttccctcatcatcctcgtcaaagccggagcccccgtcgaccagaccatcgctgccttctccgagtacatggagcccggagactgcatcatcgacggaggaaacgagtggtaccagaacacagagcgacggatctccgaagctgagcagaaaggattgctctacttggggatgggagtctccggcggcgaggaaggggctcgtaacggtccctcgctgatgccaggagggtcgtttcaggcgtatgataacatcaaagacatcttggggaaagtggcggctcaggttgaggacgggccttgcgttacttacatcggagaaggcggatctggaaacttcgtgaagatggttcataatgggattgagtatggagatatgcagcttatctctgaggcttacgacgtgttgaagaacgttggtgggttgagcaacgaggagcttgcggagatcttcacggagtggaaccgaggtgagctcgagagtttcttggttgagattacttccgatatctttagggttaaggatgagtttggtgatggagagttggtggataagattttggataagactggtatgaaagggaccgggaaatggactgttcagcaggcggcggagctctctgtggcggcgccgacgattgctgcttcgttggactgtcggtacttgagcgggttgaaagatgagagggagaatgctgctaaagtgttgagagaagctgggttgaaggaagagattggttctgcgtcgagcgggatcgataagaagaggttggttgatgatgttagacaagctctctacgcttcgaagatatgtagttacgcgcaagggatgaatctgcttagagctaagagcttagagaagagctggaacttgaacttcggtgagttggctaggatttggaaaggagggtgtatcataagggcggtgttcttggataggatcaagaaagcttaccagaggaacccggatttggcgagccttgtggttgatcctgagtttgctaaagagatggttcagagacaagctgcttggaggagagtcgtgggtttggctgtctctgctgggataagcacccctggaatgtgcgcgagtcttgcgtatttcgacacttataggcgtgcgagattgccggcgaatctggtgcaggcgcagagagatctatttggagctcatacttacgagaggactgatcgttctggtgcgtaccacacggagtggactaagcttgctaggaagagcaattgaggttatttgtattcgtggaaccgttgtcttgcttatggtggttttgttaaacccaaattgtttcgagagcattttgttaagatttcgaaaataagaaatgcactacattgatcccgacacgtggcaacacgtgactagtctggat

SEQ ID NO: 1888 - DNA, 1664 bp, Brassica napus
accgagccccgtctctttcactgtataaaaaatatcctcctccaacaatctctctctcatcactctcatttcactttctcctatctctctctacactctcttctccaatggagtccgccgctctctcccgaatcggcctcgccggtctcgccgtaatgggccagaacctcgccttgaacatcgccgagaaaggcttcccaatctccgtctacaaccgaaccacatctaaagtcgacgaaaccctagatcgcgccgccgtcgaaggaaacctcccggtctccggccaatactccccgcgcgacttcgtcctctcgctccaacgccctcgttccctcatcatcctcgtcaaagccggagcccccgtcgaccagaccatcgccgccttctccgagtacatggagcccggagactgcatcatcgacggaggaaacgagtggtaccagaacacagagcggcggatctccgaagctgagcagaaaggattgctctacttaggcatgggagtctccggcggagaagaaggggctcgtaacggtccctcgctgatgccaggaggttcgtttcaggcctacgataacatcaaagacatcttggggaaagtcgcggctcaggtcgaggacgggccttgcgtcacttacatcggtgaaggcggatctgggaacttcgtgaagatggttcacaacgggattgagtatggagatatgcagcttatctctgaggcttacgacgtgttgaagaacgttggtggattgagcaacgaggagcttgcggagatcttcacggagtggaaccgaggtgagctcgagagtttcttggttgagattacttccgatatctttagggttaaggatgagtttggtgatggagagttggtggataagattttggataagactggtatgaaaggtaccgggaaatggaccgttcagcaggcggcggagctctctgtggcggctccgacgattgctgcttcgttggactgtcggtacttgagcgggttgaaagatgagagggagaatgctgctaaagtgttgagagaagctgggttgaaggaagagattggttctgcgtcgagcgggatcgataagaagaggttggttgatgatgttagacaagctctatacgcttcgaagatatgtagttacgctcaagggatgaatctgcttagagctaagagcttagagaagagctggaacttgaactttggtgagttggctaggatttggaaaggagggtgtatcataagggcggtgttcttggataggatcaagaaagcttaccagaggaacccggatttggcgagccttgtggttgatcctgagttcgctaaagagatggttcagagacaagctgcttggaggagagtggtgggtttggctgtctctgctgggataagcacccctggaatgtgcgcgagtcttgcgtatttcgatacttataggcgtgcgagattaccggcgaatctggttcaggcgcagagagatctctttggagctcatacttacgagaggactgatcgttctggtgcgtaccacacggagtggactaagcttgctaggaagagcaattgaggttatttgtattcgtgaaaccgttgtcttgcttatggtggttttgttaaacccaaaattgtttcaagagcattttattaagatttcaaaaat

SEQ ID NO: 1889 - DNA, 1918 bp, Brassica napus
gtaaagaatgttcccttcgtcccttccttcgtctccaccgactactcaaatagcttactacctcttgtattgagtgctgcgaaagtagcttgcaagttggtcactgagcctgaggacaatcttcttcgtggtcttagcctcttgtggagacaggcttagtctgaccaccataaccagattgcttacggtcataacgacgctttccttgggcggcgagactgtctttacccttttgttattgggtaaccttgtgcaatgtatgcttcttgcattccttgttcttgcagtacgtcttcttcgtctttggaatgttcaccatttccctttctctatctctctctctctctctctacactctcttctccaatggagtccgccgctctctcccgcatcggcctcgccggtctcgccgtaatgggccagaacctcgccttgaacatagccgagaaaggcttcccaatctccgtctacaaccgaaccacatccaaagtcgacgagaccctagatcgcgccgccgtcgaaggaaacctcccggtctccggccaatactccccgcgcgacttcgtcctctctctccaacgccctcgttccctcatcatcctcgtcaaagccggagcccccgtcgaccagaccatcgctgccttctccgagtacatggagcccggagactgcatcatcgacggaggaaacgagtggtaccagaacacagagcgacggatctccgaagctgagcagaaaggattgctctacttggggatgggagtctccggcggagaagaaggggctcgtaacggtccctcgctgatgccaggagggtcgtttcaggcgtatgataacatcaaagacatcttggggaaagtggcggctcaggttgaggacgggccttgcgtcacttacatcggagaaggcggatctggaaacttcgtgaagatggttcataatgggattgagtatggagatatgcagcttatctctgaggcttacgacgtgttgaagaacgttggtgggttgagcaacgaggagcttgcggagatcttcacggagtggaaccgaggtgagctcgagagtttcttggttgagattacttccgatatctttagggttaaggatgagtttggtgatggagagttggtggataagattttggataagactggtatgaaagggaccgggaaatggactgttcagcaggcggcggagctctctgttgcggctccgaccattgctgcttcgttggactgtcggtacttgagcgggttgaaagatgagagggagaatgctgctaaagtgttgagagaagctgggttgaaggaagagattggttctgcgtcgagcgggatcgataagaagaggttggttgatgatgttagacaagctctctacgcttcgaagatctgtagttacgctcaagggatgaatctgcttagagctaagagcttagagaagagttggaacttgaacttcggtgagttggctaggatttggaaaggagggtgtatcataagggcggtgttcttggataggatcaagaaagcttaccagaggaacccggatttggcgagccttgtggttgatcctgagtttgctaaagagatggttcagagacaagctgcttggaggagagtcgtgggtttggctgtctctgctgggataagcacccctggaatgtgcgcgagtcttgcgtatttcgatacttataggcgtgcgagactgccggcgaatctggtgcaggcgcagagagatctatttggagctcatacttacgagaggactgatcgttctggtgcgtaccacacggagtggactaagcttgctaggaagagcaattgaggttatttgtattcgtgaaaccgttgtcttgcttatggtggttttgttaaacccaaattgtttcgagagcattttgttaagatttcaa

SEQ ID NO: 1890 - DNA, 4534 bp, Brassica rapa
aaaaacaaaaatcaaagaatcaaaactgaagaacaaagacaagagtttcgattacatgataatgatggacagagaaaaagggcttcatagatcactccataaataaaagagaaaaaggtaagaacttttatttcggtagccgctaagctctaaagaaatgaaaagtaaagaagaagaggaagaggaagaagatggaggggaagggcaaaaagggaagagctttattgaaaagttaaggagaagagccgtttctgtaggccatagaagagtgtttcgctcaccttccactccagcgcacattagctttaaccctaataactcttcttcttcaaaattcgcatcttcctctagaaagcttgcaggttctctctgggagttttatcagtactacgaccaagaccacgagattcctcctctagctaaaatgcaccgtgctccgtacagttctggtggtgatcctagtaaccgccgtctccgtcacggccatggaaagacggcggttagagataatggtgctcttgatctcactgatgaccagccagagagtgcggggagtataaggaaacagataggccaaatgctaatgaagcatcatcaattaacacaaagaaacgatcaccctttgcagcccttgtctcctgctagctccctcgaggtggctccatataaaggagcaataactcctggaagctcattggatttgcatggaagaagacgagctggtgagcctaactacaacaatctcaagacatcaaccgaacttcttaaagtactgaaccggatctggaccctggaggagcagcattccgctaacatctccttaataaaagcccttaaaagcgagcttgctcatgcacgtgctcgtatcaaagagcttctcagatgccagcaagccgacagacgcgagatggacgatttagtgaagcagctcgcggaagagaagctctcaaaggacacgaaggaacgcgaccggttaagctccgcggttcagcagctagaagaggagcggaaactgaggagacggtccgagagtttgcagaggaaactcgcgcgggagctctcggaagtgaagtcgacgctgtctcactgcgtcgacgagatggagagagggagtaagtcgaagaagatgctggagaggctatgcgacgagttcgcgagagggatcaagagttatgagagggaggttcacgggttgaagcagaaggtggataagagctgggaaggttggggtgaggaggatcagatggttctttgtattgcggaaacgtggcttgacgaaaggatccagagcgctgaggtagggtcagtgctggagaagctggcgctggagatagaagcgtttcttgagagtaagcagaagctgagtggtaatgaggttccaaagaatcgtaggagttcacttgagtctgctccttttaacgctatgagcgcgccgattcaggaagtggacagtcaggaggaggaagattcgaattgctttgagctcaagaaacatggaacggtggaaacaagacggagtcaaagcccgtcgagtttacaggtgaagttcgaggatcagatggcgtgggccatgtctaataatgagaagaagagtaagaagaagtctagagacattgaagctgagaagggggagaaagagaggagcaacgcggttggagagatgattagaactcataggaggttactgtcggaaactcaaggaatcgatgagggttcttgcagttaccaaccaagtaggagagcagagagtccgattcggcattggaatccgagagccatgacgtctgatctaacggcgcaaggagtgaaggacaacactttgaaagctaaactaagcgaagctagaaccaagagttctcgtccacggattcggcttttcaagggctaagattctctatggggagagtacaatgtcggtgaggtggtcggagatggaagaatctgagagattttgtcgggaagtagacacaagtttgatggttacattttctgtaaattgtttgtaactatagtatatctgtgtaatatcagtttcattttctctgacatcggtttgtttgtcgttgtagtagaaaacagagtagtgaaactgttaatcaaatgttgtttaagactatatataaagaagagatcaaaacggcatcgtgttaagttgatttgtggggtttattaccgaagtcatcgttgttttttccgtctctctggagactggagagagatggcgacggcgtcgttcaggtggattttgcagctacacaaagatgtaccaaaagcagctcgattctatgcgcaaggtctcgatttctccgtcaatgtcgtcactttgcgttgggctgagcttcagtctggtcctctcaagctagctcttatgcaatctcccagtgaccatgtggtgagtgagaagggatactcttcgctactatcgttcactgtgactgacattaatacatcaatctccaaacttatggagttaggaggagagctcgatggcgctatcaaatacgaagtccacggcaaggttgcatctgtcagatgtctggacggtcatgtgctcggcctctatgaaccttcttaggttttatcaatttattagtttactctgttcggatgatttcttggtgcatttgattgaaacattgattagactgccgatcagtgaactagcagtagccagacatactagaataaacaaagatcaatgtagtgcatttcttattttcgaaatcttaacaaaatgctctcgaaacaatttgggtttaacaaaaccaccataagcaagacaacggttccacgaatacaaataacctcaattgctcttcctagcaagcttagtccactccgtgtggtacgcaccagaacgatcagtcctctcgtaagtatgagctccaaatagatctctctgcgcctgcaccagattcgccggcaatctcgcacgcctataagtgtcgaaatacgcaagactcgcgcacattccaggggtgcttatcccagcagagacagccaaacccacgactctcctccaagcagcttgtctctgaaccatctctttagcaaactcaggatcaaccacaaggctcgccaaatccgggttcctctggtaagctttcttgatcctatccaagaacaccgcccttatgatacaccctcctttccaaatcctagccaactcaccgaagttcaagttccagctcttctctaagctcttagctctaagcagattcatcccttgcgcgtaactacatatcttcgaagcgtagagagcttgtctaacatcatcaaccaacctcttcttatcgatcccgctcgacgcagaaccaatctcttccttcaacccagcttctctcaacactttagcagcattctccctctcatctttcaacccgctcaagtaccgacagtccaacgaagcagcaatcgtcggcgccgccacagagagctccgccgcctgctgaacagtccatttcccggtccctttcataccagtcttatccaaaatcttatccaccaactctccatcaccaaactcatccttaaccctaaagatatcggaagtaatctcaaccaagaaactctcgagctcacctcggttccactccgtgaagatctccgcaagctcctcgttgctcaacccaccaacgttcttcaacacgtcgtaagcctcagagataagctgcatatctccatactcaatcccattatgaaccatcttcacgaagtttccagatccgccttctccgatgtaagtaacgcaaggcccgtcctcaacctgagccgccactttccccaagatgtctttgatgttatcatacgcctgaaacgaccctcctggcatcagcgagggaccgttacgagccccttcctcgccgccggagactcccatccccaagtagagcaatcctttctgctcagcttcggagatccgtcgctctgtgttctggtaccactcgtttcctccgtcgatgatgcagtctccgggctccatgtactcggagaaggcagcgatggtctggtcgacgggggctccggctttgacgaggatgatgagggaacgagggcgttggagcgagaggacgaagtcgcgcggggagtattggccggagaccgggaggtttccttcgacggcggcgcgatctagggtctcgtcgactttggaggtggtccggttgtagacggagattgggaagcctttctcggcgatgttcaaggcgaggttctggcccattacggcgagaccggcgaggccgatgcgggagagagcggcggactccattggagaagagagtgtagagagagagatggagaaagtgaaatgagagtgatgagagagagagattgttggaggagagatatttttatacagtgaaagagacggggctcgtcgatggaaccaagggacagacacgaaacgtgattcggacaataactgttaattttatttatttggtagacgatgatctcaatgctttaaaacgttgtcgtttattggttttatgtcaaacgatgtcgtttgaacgccattgaattttgatgttct

SEQ ID NO: 1891 - DNA, 1892 bp, Arabidopsis thaliana
ttttgattgtctcttggctccatcgacgagtccgtcactttcaccgtataaatatctccgccactctctctcccccatcaccaccaacctccgtcaaaaccctaaaccactatctctctctctctcttcatatcgcaacaatggagtccgtcgctctatctcgcataggtctcgccggtctcgcagtcatgggacaaaacctcgccttaaacatcgccgataaaggattcccaatctccgtctacaatcgaaccacttccaaagtcgacgaaaccttagatcgtgcctccaacgaaggaaaactcccagtcgctggtcaatactcgcctcgcgatttcgttctctcgatccaacggcctagatccgttatcatccttgtcaaagccggtgctcccgttgaccaaaccatctctgctctctctgaatacatggagcctggtgattgtatcatcgacggtggaaatgagtggtatcagaacacagagcgacgaatcgttgaagctgagaagaaaggattgctttatttaggtatgggagtctccggtggtgaagaaggagctcgtaatggtccttctcttatgcctggtggatctttcactgcgtataacaatgttaaagatattcttgagaaagttgctgctcaagtcgaagatggtccttgtgttacatacattggagaaggtggatctgggaattttgtgaaaatggttcataatgggattgaatatggtgatatgcagctgatttcggaggcgtatgacgtgttgaagaacgttggtggattgagtaatgatgaattggctgagatcttcacggagtggaatcgaggtgagcttgagagtttcttggttgagattacttcggatatatttagggttaaggatgattatggtgatggagagttagtggataagattttggataagactggtatgaaaggtacagggaaatggacggttcagcaggcggctgagctttctgttgcggcgcctacgattgctgcgtcgttggattgtagatacttgagtggattgaaggatgagagggagaatgctgctaaagttttggaagaagctggattgaaggaggatatcggttctgcgtctcgtggtgttgataagaagaggttgattgatgatgtgaggcaagctttgtatgcttctaagatctgtagttatgctcaagggatgaatttgcttagggctaagagtttagagaaaggttgggacttgaatttgggtgaaatggctaggatttggaaaggtgggtgtattatcagggcggttttcttggacaggatcaagaaagcttaccagagaaacccgaatttggcgagcttagtggttgatcctgattttgctaaagagatggttcagaggcaagctgcatggaggagagtggtgggtcttgctatatctgctgggattagcacaccaggaatgtgcgcaagtttagcgtatttcgacacttacaggcgtgctagattacctgcgaatctggttcaggcgcagagagatctctttggagctcatacatatgagagaaccgatcgtcctggtgcataccacactgaatggactaagcttgcaaggaagagtcagtaaagcatggacacagtcccttgatttgagggctttatttcatcatagaacacgaaaacaaattgtttcagcttatttttgttgagttataataagaaatgcaatgccccttgactctctgtatctgtctgttgatgatatctggagagtttcctttattttctcttatgtatggcttggttcatttttcgaatttgaatttgatatctatgttgaaattttggaagctgaagtcttcataattcttctgtagtcttcttgctcgttaaattgacgaatttttttccggtc

SEQ ID NO: 1892 - DNA, 1758 bp, Lactuca sativa
tgcagccacacaacgtttcactccctcgacgagtccgtcgccattcaccaaccccaaaaatctcgatttatagctttcatctgcttgcatctctaaatcctgatttttatcaaaaccctttcacaatttctatttctctcaaaactcatcaatggaggctgctgctctctcgcgtatcggcctcgccggacttgctgtcatgggccaaaacctagcgctcaacgtcgcagagaaagggtttccgatctccgtttacaacaggactacctcgaaagtcgatgagactctagatcgagctcataatgaaggccagcttccgttaactggccactacactcctcgcgacttcgttctttcgatccagaagccccgatctgtcatcatccttgtgaaggcaggcgcgccggttgaccagacgattgaggcgttggcggctcatatggaaccaggagacacgatcatcgacggaggtaacgagtggtacgagaacaccgagcgacgaatcgtcgaagcggaaaatagaggattgctttatctaggaatgggagtctccggcggcgaagaaggggcgcgaaatgggccgtctttgatgccaggtgggtcttacgaagcttataataacattaaagatatcgttgaaaaagttgctgctcaggttgaagatggaccttgtgttacatacattggagaaggcgggtctggtaacttcgttaaaatggttcataatggaatcgaatatggtgatatgcagttgatttctgaagcttatgatgttttgaaaaacgttggtgggttaagcaacaccgaattagctgaaatctttgacgaatggaacagaggcgaattagaaagcttcttgattgaaatcacagctgatatcttcaaggtgaaagatgaacatggtgaaggtgagttagtggacaaaattctagacaaaacagggatgaaaggaaccggtaaatggacagtccagcaggctgctgaactctccgtcgccgcccccaccatcgccgccagtcttgactgccggtatctgagcgggttaaaggacgaacgagaggatgcggccaggatactggcggcagcagggctgaaggaggaggtgggaacagtgagaagtgggattgacaagaagagattgatagacgatgtgaggcaagctttatacgcttctaagatctgtagttatgctcaaggaatgaatcttttaagggcaaaaagcagtgaaaagaactggaacttgaattttggagaattagctagaatttggaaaggagggtgtattatcagagctgtgttcttggacagaatcaagaaagcataccagcggaaccctaatcttgcaagcttgctggtggaccctgatttcgcgaaggagatggtgcagaggcaggcggcatggcggcgggtggtggggctggcgatatccgccggaatcagtacacctggcatgtgtgccagcttgacatattttgacacgtataggcgtgctaggcttcctgcaaatcttgttcaagctcaaagggacttgtttggagctcatacttatgaaaggattgatcgtgaaggagcttttcacactgaatggacaaagcttgcgaggaagaaggcttgaaagaggttgatcaaaaaatggtaactttttttttattggtggtgaaatgaactttcttgtttttgcttcttgaattatgtggttggtgtatttcttgatgaggaggataattattgattctctctattcgggcatagcaattg

SEQ ID NO: 1893 - DNA, 1625 bp, Ambrosia trifida
tggacgccaccactctctcacgcatcggcttagccggcctagccgtcatgggccaaaacctagcccttaacatagccgaaaaggcttcccaatctctgtctacaatcgaaccacatccaaagttgatgaaactctagatcgggctcatacggaaggacagcttccgttaactggtcattatacgcctaaggactttgtcctttctattaagaagcctcgatctgttattattcttgtgaaagctggtgcgcctgttgatcagacgattgctgccttggctcaacatatggagcctggggataccattattgatggtgggaatgagtggtatgagaatactgagagaaggattgttgaggcggctgataaaggattgctttatcttggaatgggagtttccggcggtgaagagggagcaagaaacgggccgtcgttgatgccaggtgggtcttttgaagcctataacaatatcaaagatattgtttcaaaagtggctgcacaggttgaagatgggccttgtgtgacatacattggtgaaggcgggtctggtaactttgttaagatggttcataatgggatagagtatggtgatatgcagttgatttccgaagcatatgatgttttgaaaaacgttggtgggttgagtaacagcgagttagccgagatttttgatgagtggaatagaggggagttagagagtttcttgattgaaatcactgctgatatctttaaagtgaaagatgagcatggtgaaggcgagttagtcgacaagattcttgataaaacagggatgaaggggacgggtaaatggacggtccagcaggctgctgagctctccgttgctgcgcccacaattgccgctagtttagatggtcggtatttgagtggtttaaaggacgaaagggaggctgcctcgaagattttgtcggatgcagggttgaaagatgagattgggagtgttagaagcgggattgataagaagcgattgattgatgatgttaggcaggctttgtatgcttcaaagatttgtagttacgcacaagggatgaacttgttgagggccaagagtgtcgagaaaattggaacttgaatttgggaattagctaggatttggaaaggagggtgtattatcagggcggttttcttggaccgaatcaagaaagcataccagcggaaccctaatctagcgagcctggtggtggaccctgagttcgctaaggaaatggtgcagcgacaggcagcatggaggagagttgtggggctagccatctcagctgggattagtacaccgggaatgtgtgctagtctttcttatttcgacacatacagacgtgctcggctgcctgcgaaccttgttcaagctcaaagggactgttcggggcgcatacttacgagaggattgatcgcccgggtgcttttcataccgaatggacaaaactcgcaaggaagagcggttgaagtaaaaagaaaattggtaagtcttcaccttggtggtgaacttgtttgatgatttttattgtttttgcttgaattattggttgtatttcttgatgaggattatatctagttcggcattgcaattgttgtagaattttcttcacaatattaataagttatgcatgcca

SEQ ID NO: 1894 - DNA, 1646 bp, Ambrosia trifida
ccaaacactctccaacaactcccaacatggacgccactgctctctcacgcatcggcttagccggcctagccgtcatgggccaaaacctgccctaaacatagccgaaaaagggttcccaatctctgtctacaatcgaaccacatctaaagttgatgaaactctagatcgggctcatacggaaggacagcttccgttaactggtcattatacgcctaaggactttgtcctttctattaagaagcctcgatctgttattattcttgtgaaagctggtgcgcctgttgatcagacgattgctgccttggctcaacatatggagcctggggataccattattgatggtgggaatgagtggtatgagaatactgagagaaggattgttgaggcggctgataaaggattgctttatcttggaatgggagtctccggtggtgaagaaggtgctcgaaacgggccgtcattgatgccaggtgggtcttttgaagcctataacaatatcaaagatattgtttcaaaagttgctgcacaggttgaagatgggccgtgtgtgacatacattggtgaaggcgggtctggtaactttgttaaaatggttcataatgggatagagtatggtgatatgcagttgatatccgaagcttatgatgttttgaaaaacgttggtgggttgagtaacagcgagttagccgagatttttgatgagtggaacagaggggagttagagagtttcttgattgaaatcactgctgatatctttaaagtgaaagatgagcatggtgaaggcgagttagtcgacaagattcttgataaaacagggatgaaggggacgggtaaatggacggtccagcaggctgctgagctctccgttgctgcgcccacaattgccgctagtttagatggtcggtatttgagtggtttaaaggaggaaagggaggctgcctcgaagattttgtcggatgcagggttgaaagatgagattgggagtgtgagaagcgggattgataagaagcgattgattgatgatgttaggcaggctttgtatgcttcaaagatttgtagttacgcacaagggatgaatttgttgagggccaagagtgtcgagaaaattggaacttgattttggggaattagctaggatttggaaaggagggtgtattatcagggcggttttcttggaccgaatcaagaaagcataccagcgtaaccctaatcttgcgagtctggtggtggaccctgagtttgccaaggagatggtgcaacggcaggcggcatggaggagagtggtggggctagcgatctcggctgggattagtacacctggaatgtgtgctagtctttcttattttgacacatacagacgcgctcggctgcctgcgaaccttgttcaagctcaaagggacttgttcggggctcatacttatgagaggattgatcgcccgggtgcttttcataccgaatggacaaaactcgcaaggaaaagcggttgaagtaaaaagagaaactggtaagtcttcaccttggtggtgaacttgtttgatgatttttattgtttttgcttgaattattggtttgatgaggattatatctagttcggcattgcaattgttgtagtaatttcttcacaatattaataagttatgcatgcc

SEQ ID NO: 1895 - DNA, 2112 bp, Lactuca sativa
ttcgtgggttgtgcagccacacaacgtttcactccctcgacgagtccgtcgccattcaccaaccccaaaaatctcgatttatagctttcatctgcttgcatctctaaatcctgatttttatcaaaaccctttcacaatttctatttctctcaaaactcatcaatggaggctgctgctctctcgcgtatcggcctcgccggacttgctgtcatgggccaaaacctagcgctcaacgtcgcagagaaagggtttccgatctccgtttacaacaggactacctcgaaagtcgatgagactctagatcgagctcataatgaaggccagcttccgttaactggccactacactcctcgcgacttcgttctttcgatccagaagccccgatctgtcatcatccttgtgaaggcaggcgcgccggttgaccagacgattgaggcgttggcggctcatatggaaccaggagacacgatcatcgacggaggtaacgagtggtacgagaacaccgagcgacgaatcgtcgaagcggaaaatagaggattgctttatctaggaatgggagtctccggcggcgaagaaggggcgcgaaatgggccgtctttgatgccaggtgggtcttacgaagcttataataacattaaagatatcgttgaaaaagttgctgctcaggttgaagatggaccttgtgttacatacattggagaaggcgggtctggtaacttcgttaaaatggttcataatggaatcgaatatggtgatatgcagttgatttctgaagcttatgatgttttgaaaaacgttggtgggttaagcaacaccgaattagctgaaatctttgacgaatggaacagaggcgaattagaaagcttcttgattgaaatcacagctgatatcttcaaggtgaaagatgaacatggtgaaggtgagttagtggacaaaattcttgacaaaacagggatgaaaggaaccggtaaatggacagtccagcaggctgctgaactctccgtcgccgcccccaccatcgccgccagtcttgattgccggtatctgagcgggttaaaggacgaacgagaggatgcggccaggatactggcggcagcagggctgaaggaggaggtgggaacagtgagaagtgggattgacaagaagagattgatagatgatgtgaggcaagctttatacgcttctaagatctgtagttatgctcaaggaatgaatcttttaagggtaaaaagcagtgaaaagaactggaacttggattttggagaattagctagaatttggaaaggagggtgtattatcagagctgtgttcttggacagaatcaagaaagcataccagcggaaccctaatcttgcaagcttgctggtggaccctgatttcgcgaaggaaatggtgcagaggcaggcggcatggcggagggtggtggggctggcaatatccgccggaatcagtacacctggcatgtgtgccagcttgacatattttgacacgtataggcgtgctaggcttcctgcaaatcttgttcaagctcaaagggacttgtttggagctcatacttatgaaaggattgatcgtgaaggagcttttcacactgaatggacaaagcttgcgaggaagaaggcttgaaagaggttgatcaaaaaatggtaactcttttttttttttttggtggtgaaatgaactttcttgtttttgcttcttgaattatgtggttggtgtatttcttgatgaggaggatgattattgattctctctattcgggcatagcaattgttgtagaattttctttgcattattaataagttttgcatgccattgaagcatattttgtgttttttccatgattttggatttcataattatttaaatatgtctggtttggtataatttacgaatttgaccttgtgtagaatttggtagcagaagccgtaggtatgaacatggtacatcattttgtaaaggtggatttgttcaattgatcaagaaattgagaccttttcataattatctaaatatggatatgagacaaatctttaaatgatgaagtacgtgtaacaccctaattttgatagattgtttgttgttagactcaaaagtcaaaaacttgtgatg

SEQ ID NO: 1896 - DNA, 1541 bp, Cirsium arvense
ccccatcaatggaggccgcttctctctctcgcatcggtctcgccggactcgccgtcatgggtcaaaacctagctctcaacatcgccgagaaagggtttccgatctccgtctacaatcgcaccacctcaaagtcgacgagactctagatcgagctcacaccgaaggccaactcccgttaactggccactacacccctcgcgatttcgttctctcaatccagaagccccgatctgtgattatcctcgtgaaggccggtgcgccggtggaccagacgattgcggctttagctgcacacatggagccaggtgacacaataattgacggtggaaacgagtggtacgagaataccgagcgacggatggtggaagcgtcggagaaaggattgctgtatctcggaatgggagtttccggcggtgaagaaggtgctcggaacggaccgtcgatgatgccaggtggatcttatgaagcttataataatattaaagagatcgttgagaaagttgctgcacaggttgaagatggaccttgtgttacatatataggtgaaggtggatcaggtaattttgttaaaatggttcataatgggattgaatatggtgatatgcaattgatttctgaagcttatgatgttttgaaaaatgttggtggtttaagtaatgaagaattagctgagatttttgatgagtggaataaaggggaattagagagtttcttgattgaaatcactgctgatatctttaaagttaaagatgaacatggtgatggtgaattagttgacaagattttagataaaaccggtatgaaaggtactggtaaatggacagttcagcaggctgctgagctttctgtggcggctcccaccattgccgccagtttagattgtcggtttttgagtggtttaaaggacgaaagggtggctgccgccgaagttctggcggcagcagggatgaaggaggaggtgggaaccattaggagtggggtggataagaaaagattgattgatgatgtaaggcaagcattatatgcttccaagatttgtagttacgcacaagggatgaacttattgagggcaaagagtgtagaaaagaattggaatttgaattttggtgaattggctaggatttggaaaggagggtgtattattagagctgtgtttttagataggatcaagaaagcgtatcagcggaaccctaatcttgcaagtttagtggtggatcctgatttcgctaaggagatggttcagcggcaggcggcatggagaagggtggtgggattggctgtttccgccggaattagtacacctggaatgtgtgctagtctttcttatttcgacacttatagacgtgctaggctgcctgcaaatcttgttcaagctcaaagggatttgtttggtgctcatacttatgagagagttgatcgtgctggttcttttcataccgaatggacaaagcttgccagaaagaatgcttgaatcaaagatggtaactttttttcacattgttggtgaacttgcttgctgatattctctactgtttttggtt

SEQ ID NO: 1897 - DNA, 1660 bp, Vinca minor
tatagactgaaaaagggttcccaatctcagtctacaatcgaactatttccaaggtcgatgaaaccgtcgaccgagcccaccgtgaaggtgaactcccgttgaccggccagtacaatcccagagacttcattctctcaatccaaaagcccagatccgtaatcattttagtcaaagccggagctcccgttgaccaaacaatcgcagctttatcggaacacatggaccccggagacaccataatcgatggcgggaatgaatggtacgagaatacggagcgacgtattaatgaagcatctgcaaaagggcttctttatttaggtatgggtgtctccggtggagaagacggtgctcggaatgggccctcactcatgcctggtgggtcccaccaggcgtatacgaatatccgtgatgtgatcgagaaggtggcggctcaggtggaggatggaccttgtgttacttacataggtgagggtggttctggtaattttgttaagatggtccataacggaattgagtatggtgatatgcaattgatttctgaagcttatgatgttttgaagaatgctggtgggttgagtaattctgaattggctgatatttttgctgagtggaatagaggggagcttgagagcttcttgattgaaattactgctgatatatttaatgtgaaagattatgagactggaaatggggaattggttgataagattttggataaaaccgggatgaaagggaccgggaaatggacggtccagcaggcggccgagctttcgattgctgctccaactattgctgcttcgcttgatagtaggtatttgagtggattgaaggaagaaagagaggcggcttcgaagatatttaaggaggaagggttgaaggaggagattaacaatgtggggaatgtggataagaagagattgattgatgatgttaggcaggctttatatgcatcaaagatttgtagttatgcacaagggatgaacttgttgagggcaaaaagtatagagaaaggatggaatttgaatttaggtgaattggctaggatttggaaaggagggtgtattataagagctgttttcttggataggattaagaaagcataccaaaggaattcagggttggcgaatttgttggttgatcctgaatttgctagggaaatggtgcagaggcaggcggcgtggaggcgagtagtcggggtggctgttcagaagggcattagtgttcctggaatgtcagccagtttgcagtatttcgatacttaccggcgtgggagacttccggctaaccttgttcaagctcagagggattattttggggcacatacctatgaaaggatcgatcttcctggggcttatcataccgaatgggcgaagcttgcttcaaagacaaaagtgtaatgctaggcattgtttgattcttgggcttcaaatttggtactcttagcttcattgccccattgttatacattggatgtttcttgaggcctttatttgaatttttcgttgcatcttttggctgaggatctttattcgaatttcttaggcatatagaaaatgttgctgaaatttgagctcttgttatttttaaagttaataagtgatcccagcctttagatgttttagagctttgaaacttttgaatgatccgcaagcaaaaagtt

SEQ ID NO: 1898 - DNA, 1764 bp, Tropaeolum majus
cggccgggggttaaaaattcgtcgatttattaatcattctcctcgttctgttctccatcctcatctcaccaacccatttcctctttctcaaatcctccatggaagcatcgacggctctatctcgtattggtcttgccggccttgccgtcatgggtcagaacttggccttaaacatcgccgagaaaggatttcccatctcagtttacaacagaactacttccaaggttgacgaaaccctcgacagagctaacaacgaaggtcacctaccactctccggtcattattctcctcttgatttcgtactttccatccaacggcccagatctgtcatcattctggtcaaagctggctctcctgttgaccaaaccattgctaccttgtccgagcacatggagcctggtgattgcatcatcgatggtggtaatgagtggtaccagaacactgagcgtcggattgaagaagctcaacagaagaatttactgtatctaggtatgggtgtgtcgggtggagaggaaggagctcgtaacggcccgtctctcatgcctggagggtctttccaagcttataacaacgttaaggatatacttgagaaagtagctgcacaagtggaggatggtccttgtgttacttacatcggcgagggtggtgctggtaattttgttaaaatggttcataatgggatagagtacggtgatatgcagctgatttccgaagcatacgatgttttgaagaatgttggtgggttaaccaacgaggaattagccgagattttcaccgagtggaacaaaggggagcttgagagctttctggttgagataacatctgatatctttagagtcaaagacgaagattacggagatggatatttggttgacaagattttggacaagacaggtatgaaaggcaccgggaaatggactgtgcagcaagccgccgagctttctgttgcagcgccgacgattgcagcctcgctggattgccggtacctcagtgggttaaaggacgagagggaaaacgctgctgaggttttgaagaacgctggattgaatgaggaagttaacacagtttctcatggtattgataagaagagattgattgatgacgtacgacaagctttatatgcatcaaagatctgcagctatgctcaggggatgaacttattaagggccaaaagtggggaaaaaggttggaatctgaatttaggggaaatggctaggatatggaaaggtgggtgtatcatcagggctgtgttcttggataggatcaaacaggcttatcaaaggaaccctaatctgcctagcttgattgtcgacccggagttcgcaagggaaatggtgcagagacaagccgcatggaggagagtagtcgggttagctatctctgcagggattagcacaccgggaatgtgtgctagtcttgcttatttcgatacttataggcgtgctagactcccggcaaatcttgttcaagctcagagggacttgttcggagctcatacatacgagaggattgatcgacctggggcatatcacactgagtggaccaagcttgctaggaagaacaaaggtggtgttggtgcattcaattgaggatctagctttttctgctggtaactcgtttgtttccattgaatcttcatatgtttcgatttgaattatgatttgttgtgtcatttgagaattcatttcatgaatatgcatcggaatcatcgcttagctttgtagttcttggtcttaataacaaatgaataagatttaaagttcc

SEQ ID NO: 1899 - DNA, 2045 bp, Theobroma cacao
acttggatttgtgtgcgtaaaacggcgtcgtttaaggcaaccacccacccctattcctcgagttgatcgtctctctcctcgttggttaagccactgccctttcactccctcgacgagtccgtcactctcacaaaaatccttcctttcttcaaaaggccaaactccccgctttctcctacctttaaaaataaaaggaaaatatctttcaccaaaccccccatttccttcctctctccatctaacccccatttcctttccttgctgtcgtcttttccgcccaaaaatggaagcctccccagctctctctcgcataggcctggcaggcctagcggtcatgggccaaaatctggccctaaacgtcgccgaaaaaggcttcccaatctccgtctacaaccgcaccacctccaaagtcgacgaaactgtccagcgagcccaggaggaagggcagcttccactcttcggccagtactcccctcgcgaattcgtcctctcagtccaaaggcccagatctgtcgtcatcttagtcaaagccggttcacccgtcgatcaaaccatcgccgctttatctgaccacatggaacctggcgactgcatcatcgacggtggtaacgagtggtatgaaaacactgagagaagaatccaagaagtttccaataagggtcttctttatctcggtatgggcgtttccggtggcgaagaaggggcacgtaatggcccatcgttgatgcccggtggatctcaccaagcgtattcgaatatcaaagacatacttgaaaaggtggcggcccaagtcgaagatggaccttgcgtcacttacattggcgaaggaggatcaggtaatttcgttaaaatggttcataatggaatcgaatacggtgatatgcagttaatttctgaagcttatgatgttcttaaacatgttggggggcttacgaatgatgaattggcggagattttttcggaatggaataggggagagcttgaaagtttcttaattgagataacatctgatatatttagagttaaggatgagttggaagatgggtatttggtggataagattttggataagactgggatgaaagggactgggaaatggactgtgcagcaagctgctgagttatctgttgctgctcctactattgctgcttcattggattgtaggtatttgagtggattgaaggaggagagggagaatgcagctggggttttgaaagaagctgggttgaaagaggaagttggaagtttagcacaggggattgataagaaaagattgattgatgatgttaggcaagccttgtacgcttcaaagatatgcagttatgcccaagggatgaatttgttaagagctaagagtgtggaaaaagggtggaatttgaatttgggagagttggctaggatttggaaaggtgggtgtattataagggctgtgtttttggataggatcaagaaggcttaccagaggaatcccaatttggctagcttggttgtggaccctgagtttgctagggagatggttcagaggcaggcggcttggcggagagttgtggggttggctatctctgctgggattagcactccaggaatgtgcgcaagtcttgcctattttgatacctataggcgtgcaaggctcccagccaaccttgtgcaggcacagagggacttgtttggggcgcatacctatgagaggactgatcgtccaggggcatttcatacggagtggacaaagcttgctcgtaagagtactgctggtgttggtgcactcaattgagcttttctagtttagattgttatactctggtttacttgtttgtttcaattgagcattggttatatttctatgttgaaataggattctacctcggcatagcataattgttcagtcttgcagttcttttttttttttggttaataaaatgcatgccctttgagttgtagaaattgagcggttattcaatggatttatgttgcaacttgcggcagattagatggagctgtcttctggttctcaatatattttcctgttataaatttaaataagatag

SEQ ID NO: 1900 - DNA, 1964 bp, Citrus sinensis
ctccctcgacgagtccgtcgcgctctcaccaacctcaatttccagtataaattaatttaaaaaacaaataaatatatatctcctccgccccaaatactcaccatttctcttttttcttcagtttcaatggaagcctctgctctctcacgcatcggtcttgctggcctagccgtcatgggccagaacctggccctaaacgtcgctgaaaaaggcttcccaatctccgtctacaaccgcactacttccaaagtcgacgaaaccctagatcgggcccaccgcgagggtcaactccctttgaccggccactacactcccagggacttcgtcctctccatccaacgccccagatccgtcatcatcttagtcaaagccggctcccccgttgaccagaccatcgccgccctctcggagcacatgtcccccggcgactgcatcatcgacggcggcaacgagtggtacctcaacaccgagcgccgtatccatgaagccagccagaagggtttgctttatctcggcatgggggtctccggcggcgaggaaggcgcgcgtcatggtccctctttgatgcccggtggctccttcgaggcttataataatattcgagatattttgcaaaaagttgccgcccaagttgatgatggcccttgtgttacttacattggtgaaggcgggtctggtaatttcgttaagatggttcataacggaattgaatacggagacatgcagttgatttccgaagcttacgatgttttgaagcacgtgggtggagtcagcaatgccgagttagcggagatatttgatgagtggaataagggcgagttggagagtttcttggttgagatcactgctgatattttcaaggtgaaggatgaatatggtgagggtgagcttgttgataagattttggataagaaccggaatgaaagggaccggcaaatggaccgttcagcaagctgctgagctctcagtcgctgccccaaccattgctgcgtcgttggattgtaggtacttgagcggcttgaaagaggaaagagagaaagccgccaaggtcttgaaagaggcgggattgaaagatgaggttcaaaatgtgggagtacatgttgacaagaagagattgattgatgatgtgaggcaagcgctgtatgcttccaagatttgtagttatgcgcaagggatgaatctgttgaggagtaagagtaatgagaaaggatggaatttgaattttggcgaattggcgaggatttggaaaggtgggtgtattattagagccgtttttttggataggattaagaaggcttatcagaggaatccaaatttagctagtttggtcgtggacccggagtttgcgagggagatggtgcagaggcaggctgcgtggaggagagttgtggggttggctatttcagctgggattagcactcctgggatgtgtgctagtctttcttattttgatacttacaggagggcaaggctgccagcgaatcttgttcaggctcagagagacttgtttggggcgcatacttatgagaggattgatcgccctgggtctttccacactgaatggacaaaacatgcccgccagactggtgccggtgttggtgcgttcaattgagctgctaccttttgttgcttgtttgtttgattgattgtttcaatcgggtattgatgatgttcaatttgaattagggttgtatctttcattgggaatttcatgcctagccattaaggcattgcagttatcaattagtctcacagtttagctgttaataagaaatggatgcctttctataggtacaaggttttctttcatctgcaacgctaaataatgcaatttcttttgctttttgttatgttattatttttccttgtgtctcaaatgcaaatgcaaacatgtgtgcataaacttgctcatccaggaatgttcaataaaagttttcttaactttcagctttgggctgaaggag

SEQ ID NO: 1901 - DNA, 1659 bp, Ambrosia trifida
ctctctccaacaactcccaacatggacgccactactctctcacgcatcggcctagccggtctagccgtcatgggccaaaacctcgccctaaacatagccgaaaaaggcttcccaatctccgtctacaaccgaaccacatccaaagttgatgaaactctagatcgggctcatacggaaggacagcttccgttaaccggtcattataatcctaaggactttgtcctttcgattaagaagcctcgatctgttattattcttgtgaaggctggtgcgcctgttgatcagaccattgctgcccttgctgaacatatggagcctggggatacgattattgatggtgggaatgagtggtatgagaatactgagagaaggattgttgaggcggctgataaaggattgctttatcttggaatgggagtctccggcggtgaagaaggtgctcgaaacgggccgtcattgatgccaggtgggtcttttgaagcctataacaatatcaaagatattgtttcaaaagtggctgcacaggttgaagatggaccgtgcgtgacatacattggtgaaggcgggtctggtaactttgttaagatggttcataatgggatagagtatggcgatatgcagctgatttctgaagcatatgatgttttgaaaaacgttggtgggttgagtaacagtgagttagctgagatttttgatgagtggaatagaggggagttagagagtttcttgattgaaatcactgctgatatctttaaagtgaaagatgagcatggtgaaggcgagttagtcgacaagattcttgataaaacagggatgaaggggacgggtaaatggacggtccagcaggctgctgagctctctgttgctgcgcccacaattgccgctagtttagatggtcggtatttgagtggtttgaaggacgaaagggaggctgctgcgaaggttttgtcggatgcagggttgaaagatgagattgggagtgtgagaagcgggattgataagaagcgattgattgatgacgttaggcaggctttgtatgcttcaaagatatgtagttatgcacaagggatgaacttgttgagggccaagagtgttgagaaaattggacttgattttggggaattagctaggatttggaaagggagggtgtattatcagggcggtttcttggaccgatcaagcagcataccagcggaaccctaatctcgcgagtctggtggtggaccctgagttcgctaaggaaatggtgcagcggcaggcagcatggaggagagttgtgggtctagccatctcagctgggattagtacaccaggaatgtgtgctagtctttcttattttgacacatacagacgcgctcggctgcctgcgaaccttgttcaagctcaaagggacttgttcggggctcatacttatgagaggattgattgcccgggtgcttttcataccgaatggacaaaactcgcaaggaagagcggttgaagtaaaaagaaaaattggtaagtcttcaccttggtggtgaacttgtttgatgattttcattgtttttgcttgaattattggttgtatttcttgatgaggattatatctagttcggcattgcaattgttgtagaattttcttcacaatattaataagttctgcatgccattgaagctaca

SEQ ID NO: 1902 - DNA, 1936 bp, Cucumis sativus
gtcgaaacagcagcctccatttctgacctcgactcctccgtctctttctccctcgttgcttttctttctcctccaacctcccatggaagcttctacagctctttctcgcataggccttgccggcttggccgtcatgggccaaaacctcgccctcaacatcgctgagaaaggcttccccatttccgtttacaatcgcaccacttccaaggttgatgagactgtagatcgcgcccataacgaaggtaatctccctctttttggtcagtacaatcctcgtgattttgttctctctattcaacgtcctagatcggttatcatcctcgttaaggctggtttgcccgtcgatcaaaccattgctgccttgtctgaccacttggagcctggtgatgcaatcattgatggtggtaatgagtggtatgagaatactgagcgtcgaattgcgcaggcttctgaacgagggattctttatcttgggatgggggtttctggtggtgaagatggtgctcgtcatggtccctcgttgatgcctggaggatcttttcaggcttattctaatgttcaagatattctcaagaaggtagctgctcaagttgatgatggtccttgtgttacttacataggtgaagggggttccggaaatttcgttaagatggtgcataatggtattgaatatggtgatatgcagctcatttcggaggcctacgacgttttgaaacatgtcggagggttgtccaattccgaattggctgacattttctctgagtggaacaggggggagttggagagctttctaattgagatatcagctgatatctttaaagttaaagatgaacatggtgatggggaattggtcgataagattttggacaagactgggatgaaaggaactgggaaatggactgtgcagcaagctgctgagctttccattgcagcaccaacgattgcagcctcgttggattgtagatacttgagtggattgaaggacgagagggaaagtgcggcggaggtgttgaaggaagcaggtatgacggatagtgtaggatccgtgagaagtgggattgacaagaagaagttgattgaagatgtaaggcaagctttgtatgcctccaagatttgcagctatgctcaggggatgaacttgctaagggccaagagcttggagaagggatggaacttgaattttggggaattggcgaggatttggaaaggtgggtgcatcataagagctgtgttcttggacaggatcaagaaggcatatcagcgcaatcccaaccttgctagcttgctggtggatcctgagtttgctagagagatggtgcagaggcaggctgcttggaggagagtcgtggggttggccatatcggcagggatcagcaccccggggatgtgtgctagccttgcctatttcgacacatacaggcgtgctaggctgcctgccaatcttgtgcaggcgcaaagagacttatttggggctcatacatatgagcgggtggatcgccaaggctcctaccacacagagtggacaaagctggctcgcagtgctgatgctggagttggcattttcaactgagcctttgagctgcctaccaatttggctggttttctttctctgcttcaattgggtgcaaatttcctacttgattttgcttgcccatttcaaaagttagtaggttttcttttttgtatcacagtttggacagtcttccatgcttcttaggggagtagatagcagataatttttactggccttgagtatttgctatgaataataattaataaggaaaaaacaagaaagaagcaacagctgcagaatggccattgagttctatcgtgttagttctttttcacaactccttgtacttcaaaatgaaagaatttcccttttgtttaatcttgtgtctttgaaattggaatgaaaattattctaccattgatg

SEQ ID NO: 1903 - DNA, 1896 bp, Cynara scolymus
  misc_feature (697)..(697): n is a, c, g, or t
  misc_feature (720)..(720): n is a, c, g, or t
  misc_feature (742)..(742): n is a, c, g, or t
  misc_feature (747)..(747): n is a, c, g, or t
  misc_feature (884)..(884): n is a, c, g, or t
  misc_feature (924)..(924): n is a, c, g, or t
  misc_feature (1878)..(1878): n is a, c, g, or t
  misc_feature (1892)..(1892): n is a, c, g, or t
gggggttgtgcagccaacacgtttcactccctcgacgagtccgtcacccaccccaagaaatctccatttataaacctctctctgcttccaaatccctaatcttgattcatttctttcatctccaaaaacccctcgtaattctctcccaaaaccccttcaatttctctccaaaacccatcaatggaggccgcttctctctcccgcatcggcctcgccggacttgccgtcatgggccaaaacctagctctcaacatcgccgagaaggggtttccgatctccgtctacaatcgcacaacctcaaaagtcgacgagactctggatcgagctcataccgaaggccaactcccgttaactggccactacacccctcgtgatttcgttctctcaatccagaagccccgatctgtcattatcctcgtgaaggtaggtgcgccggtggaccagacgattgcggccttggtggctcacatggaacccggagacaccataatcgacggcgggaacgaatggtacgagaacaccgagcgacggatggtggaagcgtctgagaaaggattgctttatctcggaatgggagtctccggcggtgaagaaggcgcacggaacggaccatccatgatgccaggtgggtcttatgaagcttatagtaatatcaaagaaattgttgagaaagttgctgcacaggttgaagatgggncttgtgttcgtatattggggaangtggatctggtaattttgttanatggntcataatgggattgaatacggtgatatgcaattgatttctgaagcttatgatgttttgaaaaatgttggtgggttgagtaatgatgagttggctgagatttttgatgagtggaataaaggggaattagagagtttcntgattgagatcactgctgatatcttcaaggttaaagatgnacatggtgatggtgaattagtagacaagattttggataaaactggtatgaaagggactggtaaatggacagttcagcaggctgccgagctctctgttgcggctcccaccattgccgccagtctggattgtcggtttttgagtggtttaaaggatgagagggtggctgccgccgaagttctggcggctgcagggatgaaggaggaggtgggaaccatcaggagtgggattgataagaagaggttgattgatgatgtgaggcaagcattatatgcttccaagatttgtagttatgcacaagggatgaacttgttgagagcaaagagtgtagagaagaattggaacttgaattttggtgaattggctaggatttggaaaggagggtgtattattagagctgtgtttttagataggatcaagaaagcataccagcgaaaccctaatcttgcaagcttggtggtggaccctgatttcgccaaggagatggttcagcggcaggcagcatggagaagggtggtgggactggcggtctctgctggaattagtacaccaggaatgtgtgctagtctttcttatttcgacacctatagacgggctaggctgcctgcaaatcttgttcaagctcaaagggatttatttggggctcatacctatgagagggttgatcgtgctggttcttttcatacagaatggacaaagcttgctagaaagaatgcttgaatcgttcaaaagatggtaactctttcacattattgatgaacttgcttgctgatatctactgtttttggttgatttctgtattgtattccttaatgaggattctctctaattcggcatagcaattgttgtagaattttctttgcatcattaataagttatgcatgccattgaagcataactcatgtttttacatgattttgcatgttttctggcactttgggggaattggagttccnacaaatttatgatngatt

SEQ ID NO: 1904 - DNA, 1940 bp, Cajanus cajan
aaagcctcttaaatcttaatccatcctctcctactaacatactaataattttccaattggagaataattaatagcagtaataaacaacaacaaaacatagatttataaaaacaaagttagcacaagactcacccaccctcgctcgctcgcctcgaatcaccacaccaacccttagtaatggagtcagcagctctctcgcgcataggcctggcgggcctggctgtgatgggccagaacctagccctaaacatcgcggaaaagggcttccccatctccgtctacaaccgcacctcctccaaggtcgacgagacggtggatcgggcccgcagcgagggctccctccctctgacgggccagtacactccccgcgacttcgtcctctcgctccagcgccccagatccgtcatcatcctcgtcaaggccggcgcccccgtcgaccacaccatcgccgccctctccgaccacctcgagcccggcgactgcatcatcgacggcggcaacgagtggtacgagaacacggagcgccgcatcgcccacgtcgccgacaaaggcctcctctacctcggcatgggcgtctccggcggcgaggacggcgcccgccacggcccctccctcatgcccggcggcgaccgccaggcttacaacaacatccaggatatcctcaccaaggtcgccgcgcaggtcgaggacggcccctgcgtcacctacatcggcgagggtggctccggcaacttcgtcaagatggtccacaacggaatcgaatacggcgacatgcaactcatctccgaagcctacgacgttctgaaacacgtcggaggcttgtccaattccgaaatcggcgacatcttcgccgagtggaacagaggggaactcgagagtttcttgattgaaatcaccgcggatattttcaaagtgaaggatgaggatggggaagggtttttggtggataagattttggataagaccggtatgaaggggaccgggaaatggacggtgcagcaggcggcggagctgtcgatcgccgcgccgaccatcgcggcgtcgttggactgccggtacttgagtggattgaaggaggagagggagagtgctgccgcagtgttgagggaggcggggttgagtgacgaattagggttagggttgggaaggagtgtgagtggagttgataagaagcgtttgattgatgatgtgaggcaggctttgtatgcttccaagatttgcagctatgcccaggggatgaatttgttgagggcaaagagcaatgagaaggggtggaacttgaatttgggggagttggctaggatttggaagggagggtgcatcataagagctgtgttcttggacaggatcaagaaggcttaccagaggaaccctaacttggccagcttaatagtggaccccgaattcgccagggagatggtgcagaggcaggctgcctggaggagggttgttggcttggctgtttccgccgggattagtactcccgggatgtgcgccagccttgcttacttcgacacttatcgccgggcgaggctcccggcaaaccttgttcaggctcagagggacttgtttggggcgcatacttatgagagggttgatcgccccggtgcgtttcatactgagtggaccaagctagcccgcaatggagttggtgctctcaattgatgatgggttttgttttggttctttgtttgattcgtgcagcatttgagttgtaattgtttgtttctttgaggatacatggtaggcatagcaactattgtttccttgctagaactgtttttgctcttttatttaataaaacaaaggcatgtcatttgactcactatggcttttgcttaagtatagtacaagttgttggtgttcttgtcttacgtcgcttccaattagagttataattgcattttggatttgattcctctcgagtgaggaaggttaaa

SEQ ID NO: 1905 - DNA, 2635 bp, Ricinus communis
ataagccacagttccacttctcttttttataaaaaagaaaaatatttgaacaatcagttccacttctcttaccctttcactatctcgacaagtccgcctaattttcatccataaaaaatatcatatttctttcacaatctttcagttctatcaccaacccgctgtctcttttccactttagatcaaaacccttattttcttttctcaaatggaggcctctgtagctctatcaagaattggccttgctggtttagctgttatgggtcaaaatcttgctttaaacatcgcagagaaagggtttccaatctctgtctataacagaagcacttcgaaagtcgatgaaacaatccatcgtgctcaaaatgaagggccttttcctttgacaggtcattacacacctcgcgattttgtcctttcactccaacggcctagatctgtcataatcttggtcaaagctggcgctcctgttgatcaaacaattgctgcgttgtctgaacatatggaagctggtgattgtattattgatggtggtaatgaatggtatcagaatactgagagaaggattgatgaagctaatcagaaaggtcttctttatttaggtatgggtgtttctggtggtgaagaaggtgctcgttttggtccttctttaatgcctggcggttcttttgaagcttacaacaatattaaagatattttgcaaaaagtagctgctcaagttgaagatggtccttgtgttacttatattggtgaagggggttctggtaattttgttaagatggttcataatggaattgagtatggtgatatgcaattaatttctgaggcttatgatgttttaaagaatgttggtgggttgtctaatgctgaattggctgagatttttactgagtggaataagggagagttggaaagttttctgattgagattacatccgatatatttagggttaaggatgagcatggagatggggagttggttgataagatattggataagactgggatgaaaggaactgggaaatggactgttcagcaagcagctgagctttctgttgcagcaccaacaattgctgcttctttggattgcaggtatttgagtggattgaaggaggagagggaaagcgcagcccaggttttgaaggaggctggattaaaggaggaagtggaggctgttaagagtgggattgataagaagaggttgattgatgatgtgaggcaagcactgtatgcttccaagatttgtagttatgcccaagggatgaatttgttgagggctaagagtgttgaaaagggttggaatttgaatttcggtgagctggctaggatctggaaaggtgggtgtattataagggcagtgtttttggataggattaagaaggcctatcaaaggaatcccaatttggctagcttagttgttgatcctgaatttgcaagggagatggtgcagaggcaggcagcttggaggagagttgtgggtttggctatttcagcagggattagcacaccgggaatgtgtgccagtcttgcttactttgatacttacaggcgtgctagactaccagcaaatcttgttcaggcacaaagggacttgttcggtgcacatacttatgagaggattgatcgcccagggtcattccacactgagtggacaaaacttgctcgcaagagcaatgctggtgttggtgctttcaactaagctttttcatggctttttctttttcaattgggtgttaatgatttttctatttgaattaggttgtacgtctcattgaggattctcttgcacaggcatagcaattattggttagcctcgcagtttttacttttaataagaaatgcatgccatgcctcttgagttccataaggtgtacctttcaggatagacaggataatgctttttaattttactctttttgcttcttctcaataatgttaccatcttgctgcttgattggtggttttcagtaccaagtgatgatttctgtcgaagtgaaattctgttactgactttggtgaatgatatttgatggggtgcctatcagagcactggttctcactttggtggtccttatgaacaaatatttgtgattcggatagatggcttgcaagcaatcagtaacagaggacttaattcaatttaccttttccctccatttccatagagctctttctcttatctctttctgccagacatcctccctgcaagcttatattgtttttgcaaaattgtgcatattgttgcatactactagatgggtaaattgcagaagggtattcaaggacatccaatgtaatcttgttgacgtggcagtaaaaaaataagagaatattatcctgtcacctgccatgtcagattccacatcagatggtacaatctgaagaaatattataaaatgaaatttattttatttttttctctttctattttatatattctcatttctccgttactatttttatcattcctgttcaatttggtcttcattttcagaaattagaaaggaaaaaataagagagggacaatgaagatggtgatggagagaatagagaaaggaagagtagagcaaattttgagtgaaagtgtattcagtgtaaaaggtgatttgatgttttcaaataagatccaaactttttc

SEQ ID NO: 1906 - DNA, 1821 bp, Glycine max
acggcagctcctcgaggagtccgccaacctcaccaaaccccccaaaaagcccttgtcagtttttcccctaatactaataattaatgattaacgattaacgatttataacaacaacaacgacgacgacactttgacacacctaaccctccaaattcctatctctcttcgaatggaatccgcagctctgtcgcgcataggcctggcgggcctggccgtgatgggccaaaacctagccctgaacatcgcggaaaaggggtttcctatctccgtctacaaccgcacagcctcgaaagtggacgagaccgtagatcgggcccgcaacgagggctccctccctctcacgggccaatacacccctcgcgacttcgttctctccctccagcgccctagatccgtcatcatcctcgtcaaggccggcgcccccgtcgaccaaaccatcgccgccctctccgaccacctcgaccccggcgactgcatcatcgacggcggcaacgagtggtacgagaacaccgagcgccgcatgagcctcgtcgccgacaaaggcctcctctacctcggcatgggcgtctccggcggcgaagacggcgcacgccacggcccctccctcatgcccggtgggtcccaccaggcctactccaacgtccaggacatcctccacaaaatcgccgcccaggtcgaggacggcccctgcgtcacttacatcggcgagggaggctccggaaacttcgtcaaaatggtccacaacggaatcgaatacggcgacatgcaactcatctctgaagcctacgatgttttgaagcacgtcggtggcttgtcgaattccgagcttgcagatattttcgccgagtggaaccgaggggaacttgagagtttcttaattgaaattaccgcagatatttttaaagtgaaggatgaagatggtgaagggtttttggtggataagattttggataagaccgggatgaaggggaccgggaaatggacggtgcagcaggcggcggagctttcgatagcggcgcccacgattgcggcttcgttggattgccggtacttgagtgggttgaaggaggagagggagagtgccgcagcggtgttgaaggaggcggggttgagtgatgaattggggagggttagtgtgagtggggtggataagaagaggttgattgatgatgtgaggcaggctttgtatgcttccaagatttgtagctatgctcaggggatgaatttgttgagggctaagagcaatgagaaagggtggaacttgaatttgggggaattggctaggatttggaagggagggtgcatcataagggcggtgttcttggacagaatcaagaaggcctatcagaggaaccctaatttggctagcttgatagtggacccggagttcgccagggaaatggtgcagaggcaggctgcgtggaggagggttgtggggttggcggtttcagctgggattagtactcccggaatgtgtgccagtcttgcttactttgatacctatcggagggcaaggctgccggcaaaccttgttcaggctcagagggacttgtttggggcgcatacttatgagagggttgatcgccccggggcttttcataccgagtggacgaagctcgcccgcaagagtgggactggagttggtgcactcaattgattgatgatgggttttggttgtttgcttgattgtcgtgcagtgcagcatttgagttgtaattgtttgtttcttttgaggatctttggtaggcagagagcagctattgttttcttgctataactgtttttaatcttaataaaacaaaggcgtgtcatttggcttcc

SEQ ID NO: 1907 - DNA, 1872 bp, Gossypium hirsutum
tggaagcatcccctgctctttctcgcataggccttgccggcttggccgtcatgggccaaaacctcgctctaaacgtcgccgaaaaaggcttccctatctctgtctacaatcgtactacctccaaagtcgatgaaaccgttcagcgagcccaagacgaaggccaactcccactcttcggtcactacacccctcgtgaattcgttctctctatcaaacgacccagatctgttgttatcttagtcaaagctggttcacccgtcgatcaaaccattgctgctttatccgatcatatggagcccggtgactgtatcatcgatggtggtaacgagtggtatgagaacaccgagagaagaatccaagaagtttcaaataagggtcttctttatctcggtatgggtgtttccggtggcgaagaaggggctcgtaacggtccgtcgttgatgcctggtggatctcaccaggcttattcgaacatccaagacatacttgaaaaagtggcagcgcaagtcgaggatgggccttgtgttacttacattggcgaaggaggatctggtaatttcgttaaaatggttcataatggaatcgaatacggtgatatgcagttgatttctgaagcttatgacgtgcttaaacatgttgggggactttcgaatgatgaattagctgagatttttgctgaatggaatcggggtgagcttgaaagtttcttaattgagataacatcggatatttttagagttaaggatgatttgagtgatgggtttttggtggataagattttagacaagactgggatgaaaggtaccgggaaatggactgtgcagcaagctgctgagttgtctgttgctgcccctacgatcgcagcttcattggattgtaggtatttgagtgggttaaaggaggagagggaaaatgctgctgaggttttgaaagaagctggattgaaagaagaagttgggagcctagcaaatggaattgataagaaaagattgattgatgatgttaggcaagctttatatgcgtccaagatatgcagttatgctcaagggatgaatttgttgagagcgaaaagtgttgaaaaagggtggaatttgaactttggagagttggctaggatttggaaaggtgggtgtattattagggctgtgtttttggataggatcaagaaggcttaccagaggaaccccaatttggctagcttggttgtagaccctgagtttgctagggagatggttcagaggcaagctgcttggaggagagttgtggggttggccatctctgctgggatcagcacaccaggaatgtgtgctagtcttgcctatttcgatacctataggcgtgcaaggctcccggccaatctcgtgcaggcacagagggacttgttcggggcacacacctatgagaggatcgatcgtccagggtcatttcatacagagtggaaaaagtccgctcaaaagagtaatgccggtgttggtgcactcaattgaggtttctgagtttagtttgttgtactgtggctttacttgtttgtttcaaatgagcattggttatgttatgtttttatgttggaataggattctaccttggcatagcaaggattgttcagccttgaagtttttctttttcttttaataaaatgcatgccttttgagtcgtgaaaattgaatgattcttggcagactgggtaaagccttgtattcctgttatactgttataggtttaaacaagaaaggatgaaatgaatctgttcaagagtttgaactaagcattttggtaataatgattgtgaaatttggtacatttgttagtgtaaaaggcaaaaaggttgtcagaaaaagggcgagtaacattgctaatgccttctcaattaaa

SEQ ID NO: 1908 - DNA, 2352 bp, Ricinus communis
tgacagtttacaagtcacagccaaatcaatttataagaaagcaaaacgtacaccaaccataattttattttatttttgtccacttgtgcatttcccttagcataattattttgactctattctcccatttacctactaacttcagagaaaaagaaaacgccgtcgtatcatcttgaccttctcgttgctaggaagcatcgacggtcacggcacccttctgtttggtggttaagccaaaaagctacagttccacttctcttaccctttcactatctcgaccagtccgcctaacttcgccatttatacatccataaaaatatcatctttctttcacaatcttcaattctatcgccaacccattctctcttttcctctttagatcaaaacccgtattttcttttctgaaatggaggcctctgtagctctatcaagaattggccttgctggtttagctgtgatgggtcaaaatcttgctttaaacattgcagagaaagggtttccaatctctgtctataatagaagtacttcgaaagttgatgatacaatccatcgtgctcaaaatgaagggccttttcctttgacaggtcattacactcctcgcgattttgttctttcactccaacggcctagatctgttataatcttggtcaaagctggcgctcctgttgatcaaaccattgctgctttgtctgaacatatggaggctggtgattgtattattgatggtggtaatgaatggtatcaaaatactgagagaaggattgatgaagctaatcaaaagggtattctttatttaggtatgggtgtctctggtggtgaagaaggtgctcgttttggtccttctttaatgcctggcggctctttcgaagcttataataatattaaagatattttgcaaaaagtagctgctcaagttgaagatggtccttgtgttacttatattggtgaagggggctctggtaattttgttaagatggttcataatgggattgagtatggtgatatgcaattaatttctgaggcttatgatgttttaaagaatgttggcgggttgtctaatgctgaattggctgatatttttactgagtggaataagggagagttggagagttttctgattgagattacatctgatatatttagggttaaggatgagcatggagacggggagttggttgataagatattggataagactgggatgaaagggactgggaaatggactgttcagcaagcagctgagctttctgttgcagcaccaacaattgctgcttctttggattgcaggtatttaagtggattgaaggaggagagagaaagcgcagccgaggttttgaaggaggctggattaaaggaggaagtggggactgttaagagtgggattgataagaagaggttgattgatgatgtgaggcaagcattgtatgcttccaagatttgtagttatgcccaagggatgaatttgttgagggctaagagtgttgaaaagcgttggaatttgaatttcggtgagttggctaggatttggaaaggtgggtgtattataagggcggtgtttttggatagaattaagaaggcttatcaaaggaatcccaatttggctagcttagttgttgacccggaatttgctagggagatggtgcagaggcaggcagcttggaggagagttgtgggtttggctatttcagcagggattagcacaccgggaatgtgtgccagtcttgcatactttgatacttacaggcgtgctagactgccagcaaatcttgttcaggcacaaagggacttgtttggtgcgcatacttatgagaggattgatcgcccagggtccttccacactgagtggacaaagctcgctcgcaagagcaatgctggtgttggtgctttcaactaagctttttttgtcatggttcggttgcttctttctttcaattggatgttaatgatgtttctatttgaattaggttgtatgtctcattgaggattctcttgcccgggcatagcaattattgattagcctcgcagtttttgcttttaataagaaattcatgcctcttgagttccataagttatccttcctttctggttagacaggatactgcccaattatggttttaattttactccttttgcttcttctcaataatgttaccctcttcctgcttgattgctggttttcaataccaagtgatgaaaaaagaagaagaaaatacgcacttatgacaggtcaaaggcatgtttttgtggcgtctaggttcttaatgcactgtgttttgggctactgtcttgatgtagcttgatgtcaaaattctttccatgggaatccttggctttcatttgccacgtacatat

SEQ ID NO: 1909 - DNA, 1872 bp, Euonymus alatus
cggccgggggggagtcatcgcagctacagcaccctctggatgtaggttaagtccaccctgtcctttcactacctcgacgggtccgtcgctgcccatttgcaccaaacgtcaaaatactaccaaaccagtagtactatattattccttcttcaatctctctaaaccctaacctcaccaacccccaaatcttctctctatcagatcatggaagcgtcacaagctctttctcgcataggcctagctggcctcgccgtcatgggccagaatttggctctcaacatcgctgataagggcttcccaatcaccgtctacaaccgtactggctccaaagtcgacgagactctcgtccgggcacatgaagagggtcagctacctctcaccggcaaatatactcctcgagactttgtcctctccctccagcgcccccgatcaatcatcatccttgtaaaggctggcgcacctgttgaccagactatcgctgctctcgcggaccatatggaacccggtgacaccatcatcgacggcggaaatgagtggtatgagaatactgagcgccggatgcaggaggctgctagtagaggtcttctctatctaggcatgggtgtctctggcggcgaggaaggtgctcgttacggcccgtccttgatgcccggcggatctttccaggcttacaacaacatcaatgatattctccagaaggtcgccgctcaagtggaggatggaccttgtgtgacctacattggcgaagggggatctggtaatttcgtcaagatggtccacaatggaattgagtacggtgacatgcagctgatatctgaggcttacgatgtgttgaagaatgttgggggactaaccaatgcggaattggcagagatttttgatgagtggaataagggggaactggagagtttcttgattgaaatcaccgccgatattttcaaagtgaaggatgaacacggagatggtgaattggtggataagattctggacaagactggaatgaagggtactgggaaatggactgtacaacaggcagcggagctgtcagtggctgcaccaactattgctgcttccctggactgtaggtacctgagtgggctgaaggaagagagggagaatgcggcagagattttgaaggaagcaggactgaaggaggaggtgggatctgtcaggagtggcgttgataagaagaggttgattgatgatgtgagacaggcattgtacgcgtccaagatttgtagttatgcgcaaggcatgaatttattgagggcgaagagcaatgagaagggttggaatctgaattttggagagttggcgaggatctggaagggagggtgcatcattagagctgtcttcttggataggattaagaaggcttatcagaggaatcccaatttggcgagcttggttgttgacccagagtttgccagggagatggttcagaggcaggctgcttggaggagagttgtggggttggctatctcagctggtattagcacacctggtatgtgtgctagtctttcttattttgatacttataggcgtgccaggctcccagcaaaccttgtccaggcccagagggacttgtttggggcgcatacctatgagagggttgatcgaccaggttcatttcatacagagtggactaaacttgctaggaaaagtaatgctggtgttggtgctcttaattgagcttgttttgaatagttgtacttctatcgactttcttgtttgattcagttgggtgctggtatgtccagtttgaactagaattgtatgtttcattgaaaatttcaagcttaggctgttaggcattgaagtttttttagcctcacagttgtagcttttaataaaaaatgcgtgccttcttga

SEQ ID NO: 1910 - DNA, 2328 bp, Vitis vinifera
caatgatggggtagttggtcattgggcctccaaaacggcgccgtttggcagttctttcttgacattggaggcatcgacgttcacgacaccctctcgttggtggttcggtcgctgccctttcactccctcgacgagtccgtcacttcactttctcagaatcagaacacccctcttatacacatactagagtacatctccatcgacgctcggtcttttgctctgaatctttctcagctgccaaacgtccctctcagctctccctaaatggaagcctccactctctcacgaatcggcctcgccggcctggccgtcatgggccaaaacctagctctcaacatcgccgaaaaagggtttccgatctccgtttataatcggacgacctccaaggtggatgaaacgctagatcgggcgcaccgcgaaggccatctacctctcagtggccactactcgcctcgtgacttcgtgctctccatccaacggcctagatccattgttatcctcgtcaaggccggcgctcccgtcgaccaaaccattgctgctttgtctgagcacatggaggccggggattgtattattgacggtggaaacgagtggtacgagaacaccgagcgccggattgtggaagcttctggcaagggcattctgtatctgggcatgggcgtctccggtggcgaagagggtgcgcgccacggcccgtcgttgatgcccggtggatcttatcaggcgtatcagaacatcgaggatattgtgaagaaagtggctgctcaggtcgatgatggtccctgcgttacctatattggcgaagggggttcggggaatttcgtgaaaatggtgcacaatgggattgaatacggcgatatgcagttgatttcggaagcctacgatgtgttgaagaacgttggagggttgtcgaactccgaattgtctgacattttcggtgaatggaacaggggagagcttgagagcttcctgattgagattacagctgatattttcaaggtgaaggacgagcatggagatggggaattggtggataagattttggataagacggggatgaaagggaccggaaaatggacagtgcagcaggccgcggagctgtccgttgcagcaccaactattgcagcctctttggattgtaggtacttgagcggcttgaaggaggaacgagaggctgcagctggggttttgagcgaggcggggttgaaggatgaggtggggtttgccaggagtggggtcgataagaagaggttgattgatgatgtgaggcaggcattgtatgcctcaaagatttgtagttatgctcagggaatgaatctgttgagggcgaagagtgttgagaagggttggaatttgaatttcggggagttggcaaggatttggaaaggtgggtgtatcataagggcagtgtttttggaccgaatcaagaaggcatatcagaggaatccaaatttagcaagtttgattgtggaccctgagtttgcaagggagatggtgcagaggcaggcagcatggaggagagtcgtgggcttggcgatttctgcagggattagtactcctggaatgtgtgctagtcttgcttattttgatacatataggcgtgcaaggcttcctgcaaatcttgtgcaggctcagagggacttattcggggcacatacttatgagaggattgatcgcccaggctcatttcataccgaatggacaaaacttgctcgaaagagtgatgctggttttgctaccctgaaatgagaatttctgttgctgtcacccatgtttgttccaattggatgttatttaactttctattcgaatccgggttgtatttcttgctgagtagtcctttgattaggcagtgcaattggtgttagaccttgcagttcttcagctgctaataagtagtgcatgccttttgagttatgctggccaaatgaatgccaaatgttttctttcccttccagtagagaagataaagagtttcctgtcttcttcttagtattttacctttaacatgtctttgatttgcatattgatagaagtgttcatgtctaatattaagttggtggttgttgcatattttcaatatcctacaaaatgcagaatcatggttctgttgaatctgtaaagatatcaaataatttgggcttgtattggaatcaagtcgtgtttggaattctggaatagagaatggccacgagaaatcaattccattttctcttctcattcattactgtgcttgaattgttttttagaatgggaacgagagtaagaaattcattaacatggaaaccaaatctcactgggattttgattcctcacttctacatgtaa

SEQ ID NO: 1911 - DNA, 1694 bp, Tripterygium wilfordii
aactttctctctcaatcggatcatggagacgtcacaagctctttctcgcataggtctcgccggcctcgctgtcatgggccagaatctggctctcaacatcgccgagaagggcttcccaatcactgtctacaaccgtactggttccaaagtcgacgagactctcgtccgggcacatgaagagggtcagctacctctcaccggcaaatatactcctcgcgacttcgtcctctccctccagcgtccccgatccgttataatccttgtcaaggccggagcacctgttgaccagaccattgctgctctcgcggaccatatggaacccggtgacaccattatcgacggcgggaatgagtggtatgagaatactgagcgccggatgcaggaggctgccagtagaggtcttctctatctaggcatgggggtatctggcggcgaggaaggtgctcgtcaaggcccgtccttgatgcccggcggatctttccaggcttacaataacatcaatgatattctccagaaggtcgccgcgcaagtggaggatggaccttgtgtgacctacattggcgaagggggttctggtaatttcgtcaagatggtccacaatggaattgagtatggtgacatgcagctgatatctgaggcctacgatgtgttgaagaatgttggtgggctaaccaacgcggaattggcagagatttttgatgagtggaataagggggaactggaaagtttcttgattgaaatcaccgccgatattttcaaagtgaaggatgaacacggagatggtgaattggtggataagattctggacaagactggaatgaagggtactggtaaatggaccgtacaacaggcagcggagctgtcggtggctgcaccaactattgcggcttccctggactgtaggtacctgagtgggctgaaggaggagagggagaatgcggcagaggttttgaaggaagcaggactgaaggaggaggtggggtctgtgaggagtggagttgacaagaagaggttgattgatgatgtgagacaggcattgtacgcgtccaagatttgtagttatgcgcaaggcatgaatttattgagggcgaagagcaatgagaagggttggaatttgaattttggagagttggcgaggatctggaagggagggtgcatcatcagagctgtcttcttggataggattaagaaggcttatcagaggaattccaatttggcgagcttggttgttgacccagagtttgccagggaaatggttcagaggcaggctgcttggaggagagttgttgggttggctatctcagctggtattagcacacctggtatgtgtgctagtctttcttattttgatacttataggcgtgccaggctcccagcaaaccttgtccaggcccagagggacttgtttggggcgcatacctatgagagagttgatcgaccaggttcatttcatacagaatggactaaacttgctaggaacactaatgctggtgttggcgcttttaattgagcttgttttgaattgttgtatcagactttcttgtttgattcagttgggtactggtatgtccagtactccagtttgaattagaattgtatgtttcattaaaaattttcgagcttaggctgttaggcacagcactacagcagttattttttagcctcacagttctagctgtttaataaagaatgcg

SEQ ID NO: 1912 - DNA, 2231 bp, Gossypium raimondii
ggcaaaggttgttttagtgccagttgagacggtgccgtataagggagccgtcagtaacgattcctcgaacagatcgcctctctcatcgtttgttgaggccaatttgccctttcactccctcgacgagtccgtcactctcaacaaaaatctttccttccttcaaaaagccaaactctctcccttcctacctcccttccttcctttaaaaattaaccaaatatctctcaccaaaccctcccccatttcccttctcccttcatatatctaacacccttttttccccctcccatttcctccctcttttccatctccccccaaaatggaagcatcccctgctctttctcgcataggccttgccggcttggccgtcatgggccaaaacctcgctctaaacgtcgccgaaaaaggcttccctatctctgtctacaatcgtactacctccaaagtcgatgaaaccgttcagcgagcccaagacgaaggccaactcccactcttcggtcactacactcctcgtgaattcgttctctctatcaaacgacccagatctgttgttatcttagtcaaagctggttcacctgtcgatcaaactattgctgctttatccgatcatatggagcccggtgactgtatcatcgatggtggtaacgagtggtatgagaacaccgagagaagaatccaagaagtttcaaataagggtcttctttacctcggtatgggtgtttccggtggcgaagaaggggctcgtaacggtccgtcgttgatgcctggtggatctcaccaggcttattcgaacatccaagacatacttgaaaaagtggcggcgcaagtcgaggatgggccttgtgttacttacattggcgaaggaggatcaggtaatttcgttaaaatggttcataatggaatcgaatacggtgatatgcagttgatttctgaagcgtatgacgtgcttaaacatgttgggggactttcgaatgatgaattagctgagatttttgctgaatggaatcggggtgagcttgaaagtttcttaattgagataacatcggatatttttagagttaaggatgatttgagtgatgggtttttggtggataagattttagacaagactgggatgaaaggtaccgggaaatggactgtacagcaagctgctgagttgtctgttgctgcccctacgatcgcagcttcattggattgtaggtatttgagtgggttaaaggaggagagggaaaatgctgctgaggttttgaaagaagctggattgaaagaagaagttgggagcctagcaaaaggaattgataagaaaagattgattgatgatgttaggcaagctttatatgcgtccaagatatgcagttatgctcaagggatgaatttgttgagagcgaaaagtgttgaaaaagggtggaatttgaactttggagagttggctaggatttggaaaggtgggtgtattattagggctgtgtttttggataggatcaagaaggcttaccagaggaaccctaatttggctagcttggttgtagaccctgagtttgctagggagatggttcagaggcaagctgcttggaggagagttgtggggttggccatctctgctgggatcagcacaccaggaatgtgtgctagtcttgcctatttcgatacctataggcgtgcaaggctcccggccaatctcgtgcaggcacagagggacttgttcggggcacacacctatgagaggatcgatcgtccagggtcatttcatacagagtggaaaaagtccgctcaaaagagtaatgccggtgttggtgcactcaattgaggtttctgagtttagtttgttgtactgtggctttacttgtttgtttcaaatgagcattggttatgttatgtttttatgttggaataggattctaccttggcatagcaaggattgttcagccttgaagtttttctttttcttttaataaaatgcatgccttatgagtcgtgaaaattgaatgattcttggcagactgggtaaagccttgtattcctgttatactgttataggtttaaacaagaaacgatgaaatgaatctgttcaagagtttgaactaagcattttggtaataatgattgtgaaatttggtacatttgttagtgtaaaaggcaaaaaggttgtcagaaaaagggcgagtaacattgctaatgccttctccaattaatttcgatgaatggatattgtaatttattttagcccccca

SEQ ID NO: 1913 - DNA, 1993 bp, Gossypium hirsutum
ggcacgagaaactctctcccttcctacctcccatccttcctttaaaaattaaccaaatatctctcaccaaaccctcccccatttcccttctcccttcatatatctaacacccttttttccccctcccatttcctccctcttttccatctccccccaaaatggaagcatcccctgctctttctcgcataggccttgccggcttggcggtcatgggccaaaacctcgctctaaacgtcgccgaaaaaggcttccctatctctgtctacaatcgtactacctccaaagtcgatgaaaccgttcagcgagcccaagacgaaggccaactcccactcttcggtcactacacccctcgtgaattcgttctctctatcaaacgacccagatctgttgttatcttagtcaaagctggttcacccgtcgatcaaaccattgctgctttatccgatcatatggagcccggtgactgtatcatcgatggtggtaacgagtggtatgagaacaccgagagaagaatccaagaagtttcaaataagggtcttctttatctcggtatgggtgtttccggtggcgaagaaggggctcgtaacggtccgtcgttgatgcctggtggatctcaccaggcttattcgaacatccaagacatacttgaaaaagtggcagcgcaagtcgaggatgggccttgtgttacttacattggcgaaggaggatcaggtaatttcgttaaaatggttcataatggaatcgaatacggtgatatgcagttgatttctgaagcttatgacgtgcttaaacatgttgggggactttcgaatgatgaattagctgagatttttgctgaatggaatcggggtgagcttgaaagtttcttaattgagataacatcggatatttttagagttaaggatgatttgagtgatgggtttttggtggataagattttagacaagactgggatgaaaggtaccgggaaatggactgtgcagcaagctgctgagttgtctgttgctgcccctacgatcgcagcttcattggattgtaggtatttgagtgggttaaaggaggagagggaaaatgctgctgaggttttgaaagaagctggattgaaagaagaagttgggagcctagcaaaaggaattgataagaaaagattgattgatgatgttaggcaagctttatatgcgtccaagatatgcagttatgctcaagggatgaatttgttgagagcgaaaagtgttgaaaaagggtggaatttgaactttggagagttggctaggatttggaaaggtgggtgtattattagggctgtgtttttggataggatcaagaaggcttaccagaggaaccccaatttggctagcttggttgtagaccctgagtttgctagggagatggttcagaggcaagctgcttggaggagagttgtggggttggccatctctgctgggatcagcacaccaggaatgtgtgctagtcttgcctatttcgatacctataggcgtgcaaggctcccggccaatctcgtgcaggcacagagggacttgttcggggcacacacctatgagaggatcgatcgtccagggtcatttcatacagagtggaaaaagtatgctcaaaagagtaatgccggtgttggtgcactcaattgaggtttctgagtttggtttgttgtactgtggctttacttgtttgtttcaaatgagcattggttatgttatgtttttatgttggaataggattctaccttggcatagcaaggattgttcagccttgaagtttttctttttcttttaataaaatgcatgccttatgagtcgtgaaaattgaatgattcttggcagactgggtaaagccttgtattcctgttatactgttataggtttaaacaagaaaggatgaaatgaatctgttcaagagtttgaactaagcattttggtaataatgattgtgaaatttggtacatttgttagtgtaaaaggcaaaaaggttgtcaggc

SEQ ID NO: 1914 - DNA, 1997 bp, Citrullus lanatus
tcttcttcttcttcatcgaaacagcagcctccatttctgacctcgacgcctccgtctctctccttcatcgtttttccttctgctcctctctctctcaacatctctaagctgcaatggaagcttctccagctctttctcgcataggcctcgccggcttggccgtcatgggccaaaacctcgcactcaacatcgccgagaaaggcttccccatttccgtctacaatcgcaccacttccaaggttgacgagactgtagatcgtgctcacaacgaaggtaatctccctctttttggtcagtacaatcctcgtgactttgttctctctattcaacgccctagatcggttatcatcctcgttaaggctggcttgcccgtcgatcagaccattgctgcgttgtccgaccacttggagcctggtgatgccatcattgacggtggtaatgagtggtatgagaatactgagcgtcggattgcgcaggcttctgagcgagggattctgtatcttgggatgggggtttctggtggtgaagatggtgctcgtcatggaccatcgttgatgcctggagggtcttttcaggcttattctaatgttgaggatattctgaagaaggtagctgctcaagtcgatgatggtccttgcgttacttacataggtgaagggggttccggcaatttcgttaagatggtgcataatggtattgaatatggtgatatgcagctgatttcggaggcctacgacgttttaaaacatgtaggagggttatccaattccgaattggctgacattttctccgagtggaacaggggggagttggagagctttctaattgagatatcagctgatatctttaaagttaaagatgaacatggtgatggggaattggtggacaagattttggacaagactgggatgaaaggaactgggaaatggactgtgcagcaagctgctgagctttccatcgcagcgccgacgattgcggcgtcgttagattgtaggtacttgagtggattgaaggaggaaagggagaatgcagccgaggtgttgaaggaagcagggctgaatgacagcgtggggtcagtgaggagtgggattgacaagaagaagttgattgaagatgtgaggcaagctttgtatgcctccaagatttgcagctatgctcaggggatgaacttgctgagggccaagagcttggagaagggatggaacttgaatttgggggagttggcaaggatttggaagggtgggtgcatcataagagctgttttcttggacaggatcaagaaggcatatcagcgcaatcccaaccttgcaagcttgctggtggatcctgagtttgctagagagatggtgcagaggcaggctgcttggaggagggttgtcgggttggccatatcggcagggatcagcacgccggggatgtgtgctagccttgcctatttcgatacgtacaggcgcgccaggctgcctgccaatcttgtgcaggcgcagagagacctatttggggctcatacatatgaacgtgtggatcgccaaggctcctaccacacagagtggacaaaactcgctcgcaatgctgatgctggtgttggcattttcaactaagcttttgagctgcctacccatttggttggttttctttctctttcttcagttgggtgcaaatttcctacttgattttgcttgcccatttcaaaagttggtaggttttcttctttgtatcacagtttggacagtcttccatgcttcttagggtggggagtagatagcagatattttttactggccttaagtatttgctatgaataataattaataaggaaaaaaaacaagaaagaagcaacagcagcaaggatggccaatgagttctatcgtgttagttcttttcacatctccatgtagttcaaaatgaaaaaagtttcccttttgtttaatcatgtgtctttgaaattgcaatgaaaattattctaccattgatgtcacttaaaaaacattgaaatt

SEQ ID NO: 1915 - DNA, 1877 bp, Fragaria vesca
cccatttctcaaatggaggcctccaccgcactctcccgcatcggcctcgccggcctcgccgtcatgggccagaacctcgccctcaacatcgccgagaaaggcttccccatttccgtctacaaccgcacctcctccaaggtcgacgagaccgtccaccgcgccgccaccgagggcgacctccctctctccggccagtacacccccaaagacttcgtcctctctctccagcgcccccgatccgtcatcatcctcgtcaaggccggcgcccccgtcgaccagaccatcgccgccttgtccgcctacatggagcccggcgacgccatcatcgacggcggcaacgagtggtacgagaacaccgagcgccgcatccacgaggcttccgccaagggcctcctctacctcggcatgggcgtctccggcggcgaggaaggcgctcgccacggccccagcctcatgcccggggggtcccaccaagcctactccaatgtccaggacattctccacaaggtcgccgcccaggtcgaggacgggccctgcgtcacctacatcggcgagggcggctccggcaacttcgtcaagatggtccacaacgggatcgagtacggcgacatgcagctcatttccgaggcctacgacgtgttgaagaacatcggcggcctctccaactccgagctggcgcaaatcttcgaggagtggaacaggggagagctggagagcttcttagtcgagattaccgccgatattttcaaggtcaaggacgatttggccgacggctttttggtcgacaagttgctggataagactgggatgaaggggactggcaaatggacggttcagcaggctgctgagctgtccgtggccgctcctactattgcggcctcgcttgattgtagattcttgagtgggttgaaggaggagagggagagcgccgaggaggctttgaaggaagctggtttcaaggaggagattgggaatgtggttagtgggattgataagaagaggttgatcgatgatgtgaggcaggctttgtatgcttccaagatttgtagctatgctcaggggatgaacttgttgagggctaagagtatggagaagggatggaatttgaatttgggggaattggctaggatttggaaaggaggctgtatcataagagcggtgttcttggataggattaagaacgcgtaccagaggaatcagggtctgcctaacttgattgttgatcccgactttgctaaggaaatggtgcagaggcaagccgcgtggaggagagttgtggggttggctgtggccgctgggattagtactccaggaatgtgtgctagtttgtcatactttgatacatataggcgtggtaggcttccggctaatctcgttcaggctcaaagagatttgtttggagcgcatacttatgagagggttgatcgccccggatcatttcatacagagtggactaaacttgctcagaagagttcgggtgtgggtgctctcaactgagctgttgttacttaatagtttggttagttgttgggacgtttattggtttgatagttgaattggaattgtatgtctctttgaggcttccttgcttaggcgtaacgatcattgcttacccttttcaataaaaagtgtttgccttttgagttcagtgagctaatagtcttctgatgttttatttctttgttcccttctgcattttgaaatgattactctgctgaataatcattttgcaagaggggacattgcacctcagttctgaagtgtgacatcttctctgttgcattgtatatgaactggaatttacattgaagacgatgtatgccctgtttgacttgtaacgaaactccgttgatacaaaattattctgtttttgctag

SEQ ID NO: 1916 - DNA, 1911 bp, Glycine max
gaaccgaagcgcagtcgtttgattgtgaagtgagttccgattgagcacgtcttggaggcaacgacgtctacggcagctcctcgttggtggttaagtcgcttgtcctttcagtccctcgatgagtccgccaacccctaaaaagcacttcttagttctccctctcccactaaaaaccatagtaatctagataataattaacatcagccctcactccttcgcacaccaaacccttccttcctatctctcactaatctaatggaatccgcagcactgtcgcgcataggcctggcgggcctggcggtgatgggccaaaacctagccctaaacatcgcagaaaaggggttcccgatctccgtgtacaaccgcacggcctccaaagtggaccagaccgtagatcgtgcccgcaacgagggctccctccctctcacgggccaatacacccctcgcgacttcgttctctccctccagcgccccagatccgtcatcatcctcgtcaaggccggctccccagtcgaccacaccatcgccgccctctccgaccacctcgaccccggcgactgcatcatcgacggcggcaacgagtggtacgagaacaccgagcgccgcatgaacctcgtcgccgacaaaggcctcctctacctcggcatgggcgtctccggcggcgaagacggcgcacgccacggcccctccctcatgcccggtgggtcccaccatgcctactccaacgtccaggacatcctccacaaaatcgccgcccaggtcgaggacggcccctgcgtcacctacatcggcgagggaggctctggaaacttcgtcaaaatggtccacaacggaatcgaatacggcgacatgcaactcatctctgaagcctacgatgttttgaagcacgtcggtggcttgtcgaattccgagcttgcggagattttcgtggagtggaacagaggggaacttgagagtttcttgattgaaattaccgccgatatttttaaagtgaaagatgaagatggtgaagggtttttggtggataagattttggataagactgggatgaaggggaccgggaaatggacggtgcagcaggcggcagagctttcgatagccgcgcccacgattgcggcgtcgttggattgccggtacttgagtgggttgaaggaggagagggagagtgccgcggcggtgctgaaggaagcggggttgagtgatgaattggggagggtaaatgtgagtggggtggataagaagaggttgattgatgatgtgaggcaggctctgtatgcttccaagatttgtagttatgctcaggggatgaatttgttgagggctaagagtaatgagaaaggatggaacttgaatttgggggagttagctaggatttggaagggagggtgcatcataagggccgtgttcttggaccggatcaagaaggcttatcagaggaaccctaatttggcgagtttgattgtggacccggagtttgcaagggaaatggtgcagagacaggctgcgtggaggagggttgtggggttggcggtttcggctgggattagtactcccggaatgtgtgccagtcttgcttactttgatacctatcggagggcaagacttccggcaaaccttgtccaggctcagagggacttgtttggggcgcatacttacgagagggttgatcgccctggggcttttcataccgagtggacgaaactcgctcgcaatagtggggctggagttggtgcactcaattgattgattttgggttttggttgtttgtttaatggtcgtgcattgcagtgcagcatttgagttgtaattgtttgtttctttgaggatctttggtagggagagagcagctattgttttcttgctataactgtttttaatcttaataaaacaaaggcatgtcatttggcttcc

SEQ ID NO: 1917 - DNA, 2086 bp, Trigonella foenum-graecum
tcatgctgactatagtttgtaagttgactggaatggatattgtgaaacgcagtcgtttatgtgataatttgaacacatcttggaggtaacgttgtctacgcacggtagctcctcgttggtggttaagtcactgtcctttcacaccctcgacgagtccgccactctccaacaactcatcatacaaaaacacttgactccttcccctctcaccaaccatttcataacttcattcaattcaactatctcaatcaacgatggacgcttctaccctctctcgcataggcctagcaggcctagccgtcatgggccaaaacctagccctaaatatcgccgaaaaaggcttcccaatctccgtctacaaccgcactacttccaaagtcgatgaaaccgtagatcgggctcaccgtgaaggctccctccctttaaccggtcaatactccccccgcgaattcgtcctctctctccaacgtcctagatcagtcatcatccttgtcaaagccggcgcccccgtcgatcaaacaatcgccgcgctctccgatcatatggagcccggcgattgtataatcgacggaggtaacgaatggtatgaaaacactgaacgaagaatccaacaaatctccgagaaaggaatactttatctcggtatgggtgtttctggtggtgaagaaggtgctagaaatggaccttctcttatgcctggtggctcctaccaggcttatagtaatattcaagatattcttatgaaggttgctgctcaggttgaagatggtccttgtgttacttacattggtgaaggtggttctggtaattttgttaagatggttcataatggtattgaatatggtgatatgcagcttatttctgaagcttatgatgttttgaagcatgttggtggtttgtccaattctgaaattgctgatatttttgctgagtggaatagtggggagttagagagttttcttattgaaattactgctgatatttttaaggtgaaggatgaaggtggtgatgggtatttagtggataagattttggataagactggtatgaagggtactggtaaatggacggtgcagcaggctgcggagttgtcggttgcagcgccgacgattgctgcttcgttggattgtaggtatttgagtgggttgaaggaggagagggagaatgctgcggcggttttgaaggaagcggggttgagtgaggaagtgggagggtttgtgagaagtggggtggataagaaaaggttgattgatgatgtgagacaagctttgtatgcttctaagatttgtagttatgctcaagggatgaatttgttgagggcaaagagtgatgagaaaggttggaacttgaattttggggagttggctaggatttggaaaggtgggtgtattataagagcagtgtttttggataggattaagaaggcttatcagaggaaccctaatttggctagtttgatagtggatcctgaatttgccaaggaaatggtgcagaggcaaggagcatggagaagggttgttggattggctatttcagctgggattagtactcctggaatgtgtgctagtcttgcttactttgatacatatagaagagcaaggcttcctgctaaccttgttcaagctcagagagacttgtttggtgctcatacctacgagcgtctcgatcgtcccggcgcgtttcatactgagtgggcgaaacttgctcgtcagagtggtactggtgctgctgctcttaattgatgatacgtctctttgtgtggttagttgtttgtctgttgtttaatgcagcatttgtgttgcgactgtatgttttgtttgaggatctttggttaggcagagcaactattgtttccttattattgtagctgtttttgcttttaatttaactaataaaagaaaagctttgtcatttgaattaaccggctttttttgtttcaagtttgagtccttgaagtacactctaaattgttgatgctttgtctcttaagtctgtgtttaaagactgtgtattatcaacgacagaaacatcctcccaggcttcaatatattttggactttgtttccttagctttactttacagctg

SEQ ID NO: 1918 - DNA, 1917 bp, Medicago truncatula
cacttcacactccttcccctctctctctatctcaccaactccttctttcatttcatttcatttcttcaattcaactatggacgcttccactctctctcgcataggcctcgctggcctagccgtaatgggccaaacctagcctaaacatcgccgagaaaggcttcccaatctccgtctacaatcgtactacttccaaagtcgatgaaaccgtagatcgtgcccaccgtgaaggctccctccctttaaccggtcaatactcccctcgcgaattcgttctctctctccaacgtcctagatcagttatcatccttgtcaaagctggtgctcccgtcgatcaaacaatctccgccctctcagatcacatggagcccggcgattgtattatcgacggtggtaacgaatggtatgaaaataccgaacgaagaatccaacaaatctctgaaaagggaatactctatctcggtatgggtgtttctggtggtgaagaaggtgctagaaatggaccttctcttatgcctggtggctcctaccaggcttatagtaatattcaagatattcttaccaaggttgctgctcaggttgaagatggtccttgtgttacttacattggtgaaggtggttctggtaattttgttaagatggttcataatggtattgaatatggtgacatgcagcttatttctgaagcttatgatgttttgaagcatgttggtggattgtccaattctgaacttgctgatatttttgctgagtggaatagtggtgagctagagagttttcttattgagattactgctgatatttttaaggggaaggatgaaggtggtgatgggtatttggtggataagattttggataagactggtatgaaggggaccggtaaatggactgttcaacaagctgcggagttgtcagttgctgctccgactattgctgcttcgttggactgtaggtatttgagtgggttgaaggaggagagggagaatgccgcggcagttttgaaggaagcggggttgggcgaggaagtgggagggtttgtgagaagtggggttgataagaaaaggttgattgatgatgtgagacaagctttgtatgcttctaagatttgtagttatgcacaaggaatgaatttgttgagggcaaagagtgatgagaaaggttggaatttgaattttggggagttagctaggatttggaaaggtgggtgtattataagagctgtgtttttggataggattaagaaggcttatcagaggaaccctaatttggctagtttgatagtggatcctgaatttgctaaggaaatggtgcaaaggcaaggtgcatggagaagggttgttggattggctatttcagctgggattagtactcctggaatgtgtgctagtcttgcttactttgatacatataggagagcaaggcttcctgctaaccttgttcaggctcagagggatttgtttggagctcatacctatgagcgtctcgatcgtcccggcgctttccataccgagtggacaaaacttgctcgtcagagtggtactggtgctgctgctcttaattgatgatatgtctcttagtgtggttagttgtttgtttgttgtttaatgcagcatttgtgttgcaactgtatgtttcgttgagattgaggttcttcggttaggcagagcaattattgtttccttattgttgtagctgtttttccttttaatttaacaaataaaagaaaagctttgtcatttgttcacctgctttttttgtttcaagtttgagtcctgaattacactttaaattgttgatgcttttgtctcatagatacctttaaagctgtgtttaaagactgtgtattaacaatgacagaaacatcctctcaggtttcaatatattttggactttgtttccttagctttaaaaaaaaaa

SEQ ID NO: 1919 - DNA, 1831 bp, Citrus clementina
aaaaaaaaaaaaggctgcgtacgccgtcgtatgggtaggtagctcaatttgtattgtctctcggaatcatcgcacgctctttttcgtttggtttggtcgttaagtcagtggcctttcgctccctcgacgagtccgtcgcgctctcaccaacctcaatttccatttcaatggaagcctctgctctctcacgcatcggtcttgctggcctagccgtcatgggccagaacctggccctaaacgtcgctgaaaaaggcttcccaatctccgtctacaaccgcactacttccaaagtcgacgaaaccctagatcgggcccaccgcgagggtcaactccctttgaccggccactacactcccagggacttcgtcctctccatccaacgccccagatccgtcatcatcttagtcaaagccggctcccccgttgaccagaccatcgccgccctctcggagcacatgtcccccggcgactgcatcatcgacggcggcaacgagtggtacctcaacaccgagcgccgtatccatgaagccagccagaagggtttgctttatctcggcatgggggtctccggcggcgaggaaggcgcgcgtcatggtccctctttgatgcccggtggctccttcgaggcctataataatattcgagatattttgcaaaaagttgccgcccaagttgatgatggcccttgtgttacttacattggtgaaggcgggtctggtaatttcgttaagatggttcataacggaattgaatacggagacatgcagttgatttccgaagcttacgatgttttgaagcacgtgggtggagtcagcaatgccgagttagcggagatatttgatgagtggaataagggcgagttggagagtttcttggttgagatcactgctgatattttcaaggtgaaggatgaatatggtgagggtgagcttgttgataagattttggataagaccggaatgaaagggaccggcaaatggaccgttcagcaagctgctgagctctcagtcgctgccccgaccattgctgcgtcgttggattgtaggtacttgagcggcttgaaagaggaaagagagaaagccgccaaggtattgaaagaggcgggattgaaagatgaggttcaaaatgtgggagtacatgttgataagaagagattgattgatgatgtgaggcaagcgctgtatgcttccaagatttgtagttatgcgcaagggatgaatctgttgaggagtaagagtaatgagaaaggatggaatttgaattttggcgaattggcgaggatttggaaaggtgggtgtattattagagccgtttttttggataggattaagaaggcttatcagaggaatccaaatttagctagtttggtcgtggacccggagtttgcgagggagatggtgcagaggcaggctgcgtggaggagagttgtggggttggctatttcagctgggattagcactcctgggatgtgtgctagtctttcttattttgatacttacaggagggctcggctgccagcgaatcttgttcaggctcagagagacttgtttggggcgcatacttatgagaggattgatcgccctgggtctttccacactgaatggacaaaacttgcccgccagactggtgctggtgttggtgcgttcaattgagctgctaccttttgttgcttgtttgtttgattgattgtttcaatcgggtattgatgatgttcaatttgaattagggttgtatctttcattgggaatttcatgcctagccattaaggcattgcaattatcaattagtctcacagtttagctgttaataagaaatggatgcctttctatag

SEQ ID NO: 1920 - DNA, 1714 bp, Prunus persica
ctctcttcaccaaacccccctctctcactctctctttctctttgtacagcagtagccatggaagcttcacctgctctctcgcgcatcggcctcgcaggcctcgccgtcatgggccaaaacctcgccctcaacatcgccgagaaaggcttccccatctccgtatacaaccgcaccacctccaaggtcgacgagaccgtcgaccgggcccacaacgagggcaatcttcctctcttcggtcagaacaatcctcgcgacttcgtgctctccatccaacggcccagatccgtcatcatcctcgtcaaggccggtgctccggtcgatcagactatcgctgcgctctccgcccacatggagcccggcgacgccatcatcgacggcggcaacgagtggtacgagaatacggagcgtcgaattgctgaggccaccggtaggggacttctctacctcgggatgggagtctccggcggtgaggagggggcccgccacggccccagcctcatgcccggtgggtcccaccaggcctacaccaacgtccaggatattctccacaaggttgccgcccaggtcgaggatggtccctgcgtgacctacatcggagaagggggttctggtaatttcgtgaagatggtgcataatgggattgagtacggcgatatgcagctgatttcggaggcgtacgacgtgttgaagaacgtcggggggttgagcaatgaggaattgggtgagatttttgcagagtggaacaagggagagctggagagcttcttgattgagataacggctgatattttcaaggttagggatgatttggcagatgggtttttggtggataagcttttggacaagactgggatgaaggggactgggaagtggactgtgcagcaggctgctgagctgtctgtagctgcgcccaccattgctgcttctttggactgcagatacttgagtgggttgaaggaggagagggagaaggctgaggagactttgaagcaagctgggtttaaggaagtgattgggagtgtgacgagtgggattgataagaagaggttgattgatgatgtgaggcaggctttgtatgcttctaagatttgcagttatgctcaagggatgaacttgttgagggccaagagtgtggagaagggttggggtttgaatttgggggagttggctaggatttggaaaggtgggtgtattatccgagcagtgttcttggatcggattaagaatgcttatcagaggaatcaaaacttgcccaacttgattgttgatcctgattttgctaaagaaatggtgcagaggcaagctgcgtggaggagagttgttgggttggctgtatcagccgggattagcactcccggaatgtgtgccagtttgtcctatttcgatacctatcggaggggtaggcttccggccaatcttgttcaggcgcagagggacttgtttggagctcatacttatgagagggttgatcgccctggagcttttcataccgagtggaccaagcttgctcagaagagtggttctggtgttggtgctctcaattgagcggttggttgttgatttggattggatgctggttgttttgatacttgaattggaattgtatgtttcttagaggcttctttgcttaggcatagcgaatagcgatcattgcttacccttgttaataagaaatgcatgccttttgagttcaatgagctaaattgttgtctta

SEQ ID NO: 1921 - DNA, 1554 bp, Eutrema halophilum
ttgggccagaaccttgccttgaacatcgccgagaaaggtttcccaatctcagtctacaatcgaaccacatcgaaggtcgacgaaaccctagatcgagcctccgtcgaaggaaacctaccagtttccggccaatactctccgcgcgatttcgtcctctccatccaacgaccgagatccctaatcatcctcgtcaaagccggagctcccgttgaccagacaatcgccgccttctccgagtacatggagcccggagattgcatcatcgacggtggaaacgaatggtatctgaacacagagcgacggatctctgaggcggagcagaaaggactgctctatttaggcatgggagtctccggcggcgaagaaggagctcgtaacggtccgtcgcttatgcccggcggatcgtttcaggcgtatgacaacatcaaagatatcttggagaaagtcgcggctcaggtagaagatggaccttgcgttacttacatcggagaaggaggatctggaaatttcgtgaagatggttcataatgggattgagtatggagatatgcaattgatctctgaagcttacgatgtgctgaagaacgttggtggattgagcaacgaggagcttgcggagatcttcacggagtggaatcaaggtgagcttgagagcttcttggttgagattacttcggatatatttagggtcaaggatgagttcggtgatggagagctggtggataagatattggataaaaccggcatgaaaggtaccggaaaatggactgttcagcaggcggcggagctctctgtggcggctccgacgattgctgcctcgttggattgtcggtacttgagcggattgaaagatgagagggagaatgctgcgaaagtgttgagagaagctggattgaaggaagagattggttctgcatcgagcgggatcgataagaagagattggttgatgatgttaggcaagctctctacgcttcgaaaatctgtagttatgctcaagggatgaatctgcttagagctaagagctcagagaaaggctggaacttgaacttcggtgaactggctcggatttggaaaggaggctgcatcataagagcggttttcttggataggatcaagaaagcataccagagaaacccggatttggcaagtcttgtggttgatcctgactttgctaaagagatggttcagaggcaagctgcttggagaagagtggtgggtttggctgttgctgcagggataagcacgcctggaatgtgcgcgagtcttgcatatttcgatacttacaggcgcgctagattgccggcgaatctagttcaggcgcagagagatctctttggagctcatacttatgagaggatcgatcgtcctggtgcgtatcacactgaatggtctaagcttgccaagaagagcacttgaggtttttgttttcctaaaaatcctctctttgtctttgctttttttagcaatagggaatgggattttaaccacattgtttcaagagtattttgttcagatttcaaaataagaaaatgcagtaccttgaattttgcttta

SEQ ID NO: 1922 - DNA, 1793 bp, Euonymus alatus
ggggatcatcgctgcaagtctgcaactgctccccctcgaccaccctgtcctttaactacctcgacgagtccgacactggccatccatttgcacaaaaaaggtagataacctcaacctcaccaacccctaatccttctctctccataggatcatggaggcctcgcaggctctttctcgcataggcctcgccggcctcgccgtcatgggccagaatctggctcttaacatagccgagaagggctttccaatcaccgtctacaaccgtactggctccaaagttgacgagactcttgtccgggcacatgaagagggtaagcttcctctcaccggcaaatacactcctcgcgatttcgtcctctccctccagcgtccccgatctgtgatcatccttgtcaaggccggcgcacctgttgaccaaaccattgctgctcttgcagaccacatggaacccggtgatactatcatcgacggcggaaatgagtggtatgagaatactgagcgccggatgcaggaagcttccagcagaggccttctctatctaggcatgggtgtctccggcggagaggaaggtgctcgttacggcccgtccttgatgccaggcgggtctttccaggcttacaacaacatcgaggatattctccataaggtcgccgcgcaagtggaggatggaccttgtgtgacctacatcggcgaagggggatctggtaatttcgtcaagatggtccacaatggaattgagtacggtgacatgcagctgatatcggaagcctacgatgtgttgaagaatgttggcgggctaaccaatggggaattggcagagatttttgatgagtggaataagggggaactagaaagtttcttgattgaaatcactgctgatattttcaaagttaaggatgaacacggagatggtgaattggtggataagattctagacaagactggaatgaagggtactgggaaatggactgtacagcaagcggcagagttgtcagtggcggcaccgactattgccgcgtcgctggactgtaggtacctgagtgggttgaaggaggagagagagaatgcggcggcggttttgaaggaagcaggactgaaggaggaggcggggtctgtgaggagtggagttgataagaagagtttgattgatgatgtgagaaaggcattgtacgcatccaagatttgtagttacgctcaaggcatgaatttattgagggcgaagagcaatgagaaggattggaatttgaattttggagagttggcgcggatctggaagggagggtgcatcatcagagctgtcttcttagatagaattaagaaggcttatcagaggaatcccaatttggcgagcttggttgtcgacccagagtttgccagggagatggttcagaggaaggctgcttggaggagagttgtggggttggctatctcagctggtattagcacacctggtatgtgtgctagtctttgttattttgatacttacaggcgtgccaggctcccagcaaaccttgtccaggcccagagagacttgtttggggctcatacctatgagagggttgatcgaccaggctcatttcatacagagtggactaaacttgctaggaacactgatgctggtgcttttaattgagcttgttttgaatatttgtttcggatgtactggtttgattcagttgggtgctgctatttccagactgaattataattgtatgtttcattcagaatctcaagcttaggctgttttattattaacctcacagtttcagcgtttaatgagagatgtgttgtga

SEQ ID NO: 1923 - DNA, 1549 bp, Platanus occidentalis
tcgacagctctttcccgcatcggactcgcaggcctagctgtgatgggccagaatctcgccctcaacatcgccgagaaaggcttccccatctccgtctacaaccgaaccacctccaaagtcgacgaaaccatagagcgagccaagcaggaaggcaacctccccctcatcggccagtactccccacgcgatttcgtgctctcgctccaacgacccagatccgtaatcatcctcgtcaaggccggttcccccgtcgatcaaaccatcgccgccctttccgaattcatggactccggcgactgcatcatcgacggtggcaacgagtggtacgagaacactgagcgccgaacgcgggaagtcgccgataaggggattctctacctgggtatgggcgtgtcgggcggcgaagagggtgcccgtcacggcccttcgctgatgcctggtgggtcttatcaggcttacttgaacatcgaggatatcgtgaagaaggtcgccgcgcaggtggaggacgggccatgtgtgacgtatatcggtgagggtgggtctgggaattttgtgaagatggttcacaatggaattgagtacggtgatatgcagttgatttcggaagcttacgatgtgttgaaggtcgttggggggttgtccaattctgaattggcggagatttttgcagactggaacagaggggagcttgagagcttcttgattgagataactgctgatattttcaaggttaaggatgactacggggaaggtgaattggtggataagattttggataagacggggatgaagggaactgggaagtggacggttcaacaggcggctgagttgtctgttgctgcgcccacgattgcagcttcgttggattgtagatatttgagtggattgaaggaggagagagaggcggccgctgaggttttgaaggaggcgggcatgaaggaggaggttggagcagtgaggagtggaatcgataagaagaggctgattgatgatgtgaggcaggctttgtatgcttcaaagatatgtagctatgctcagggaatgaatttgttgagggcgaagagtgtggagaagggctggaatttgaactttggggagttggcaaggatttggaaaggtggttgtattataagggctgtcttcttggataggatcaagaaggcgtaccagaggaaccctcaattagcaagtttggttgttgatccagagtttgcgagggagatggtgcagaggcaggcggcgtggagaagagttgtgggtttggcaatttctgcagggattagcactccgggaatgtgtgctagtcttgcttactttgacacatacaggcgagcaagactgcctgcaaaccttgtccaggcacagagggacttgtttggggcacatacctatgaacgcattgatcgtccgggatcattccatactgaatggacaaagctcgctcggcagagtaagactagtgttggtgcttttaactgagctttgttattgcttgctcactggctaggtagtttgaattcgaggttgattttttttttttttttttttt

SEQ ID NO: 1924 - DNA, 2189 bp, Lotus japonicus
actgtcctttcacaccctcgacgagtcgccaccacaacaacaaccaatagaacagcttatatcctcactcactcacttcactcaaaatcaaatccccaaagccaaaacctctttcattttcccttatggagtcttctatagctgcttctcgcatcggccttggcggcctcgccgtcatgggccaaaacctcgccctcaacatcgccgacaaaggcttcccaatctccgtctacaaccgcaccacctccaaagtcgacgaaaccgtagatcgggcccaccgcgaaggctccctccctctcatcggccagtacaacccgcgtgacttcgtcctctccctccaacgccctagatcggtcatcatcctcgtcaaggccggcgcccccgtcgaccaaaccatcgccggcctctccgagcatctcgagcctggtgactgcatcatcgacggcggtaacgagtggtatgaaaacaccgagcgccgaatccaaaccgtcaccgagaagggtctcctgtatctcgggatgggcgtctccggcggcgaagagggtgctcggaacgggccctcgctcatgcccggtgggtccttccaggcctacaataacattcaggacattttgttcaaggtcgctgctcaggttgaagatgggccttgtgtgacttatatcggtgaaggtggttctggaaacttcgtgaagatggtgcataatgggattgagtatggtgacatgcagcttatttctgaggcttatgatgttttgaagcatgtgggtggtttgtcgaattctgagcttgctgatattttcggtgagtggaatagaggtgagcttgagagctttctcattgagattactgcggatattttcaaggtgaaggatgaggagtttggtgctgatgggtatttggtggataagattttggataagacgggtatgaagggtactgggaaatggaccgtgcagcaggcggcggagctgtcagtggcggccccgactatcgcggcgtcgttggattgcaggttcttgagtgggttgaaggaggagagggagaatgctgcggcggtgttgaaggaggcagggttgagtgagggtgaggaagtggggtctgtgagagttgataagaagcggttgattgatgatgtgaggcaggctttgtatgcttccaagatttgcagctatgctcaggggatgaacttgctgagggcgaagagcaatgaaaaagggtggggtttgaattttggggaattggctaggatttggaaaggtgggtgcattattagggcagtgtttttggataggatcaagaaggcgtatcagaggaaccctaacttggcgagtttgatagtggaccctgaatttgctaaggaaatggtgcagaggcaagctgcgtggagaagggttgtggggttggctatatcagctgggattagtactccagggatgtgtgctagtcttgcttactttgacacctaccggagagcgaggcttccggcgaaccttgttcaggctcagagggacttgtttggggctcacacctatgagcgggttgatcgccctggcaatttccataccgagtggactaaacttgctcgcaagagtggtactggagttggtgctctcaattgatgtctttagcatggttagttttgtttgcttgtttgttggtcattgtaatcctggcttaggcacagcaactattgtttccttactgtagctgtttttgctcttaataaaagaaaagacatgcaatttgatatccgcaggcttttacttgtatcagaggttgcttccttgaattgattcccaactatttgtgttttcacctcctaagtatgttctcaatgagaaagtgttgcgtgaatatagaactgtattgatgatttatgtatctgcaatgacagaaatgtcctgtcaagcatcaagagatttttgtttcacttgccttaaactataggtgatcttgttacttgtcctatttggccctttttccccctttgtaactcccacatgtatccagttctgttatggatacgttcacatgcctgtaagcttttcagttttaactttcttgttgatgccttgctagtcaagtgtttctttcttgtttactctgttggtgcgtgctttgtagacctttgactactttttctctggggtgaggaatcaggaatgcttttctgatattgtttctgctgg

SEQ ID NO: 1925 - DNA, 1715 bp, Quercus alba
tctctctctctctaatccaaaaaagctcagctcattgaaaccatggcgacgccagctctctcacacataggcctagcagggctagccgtgatgggccaaaacctagccctaaacatcgccgagaaaggcttcccaatctccgtctacaaccgcaccgcttctaaagtcgacgagacccaccaccgcgcccaatccgaaggcgacctccctctcaccccacactacactcctcgcgacttcgtcctctcaatccagcgccccagatccatcatcatcctcgtcaaggccggctccccggtcgatcaaaccatcgccgccctctcctctttcatggagccaggcgattccatcatcgacggcggcaacgaatggtacctaaacaccgagcgccgtatcgaacaggcctcgacgcaaggcttgctgtatctcggcatgggcgtatcgggcggcgaagaaggtgcccgatacggtccttcgttgatgcccggaggttcttatcaagcgtattcgaatgtccagaatattcttcagagagtcgccgctcaggtcgacgacggtccttgcgtgacctacatcggcgaaggcggttccggcaacttcgtcaaaatggtacacaacggaattgaatacggcgacatgcaattgatttccgaagcctacgatgtgttgaagaatatcggcgggttgtcgaattcggagctcgccgatattttcgccgagtggaatcgcggcgagttggagagcttcttggtggagattacggcggatatttttagggttaaggatgagtttggcgagggcgaattggtggataaggtgttggataagacggggatgaaagggactgggaaatggactgttcagcaggcggcggagctttcgatagcagcgccgacgattgcggcgtcgttggatggtcggtatatgagtgggttgaaggaggagagagagagcgccgccgcggcgttgagggaggcgggtttgaaagaagatgagcagttgggaggagtgaagaagggaattgataagaagagactgattgatgatgtgaggcaagctttatacgcttcgaaaatttgtagttacgctcaaggaatgaatttgttgagagcaaagagcgtggagaaaggttgggacttgaatttgggggaattagcgaggatttggaaaggtgggtgtattataagagctgtgtttttggataggattaagaaggcttataagaggaatccgaatttggcgagtttggtggtggacccggagtttgctagggagatggtgcagaggcaggcggcgtggaggagggttgttgggttggcggtgtcagcggggattagcacgccggggatgtgtgctagtctgtcgtattttgatacgtataggcgggcgaggctgcctgcaaacttggtgcaggcgcagagggaccttttcggtgcgcatacttatgagaggattgataggcccggttcgtttcatactgagtggactaaacttgctcgcacgagtgagaattccggtgttgctgctctcaattgagctttttttgtttgttcaatcgttttgttacttgttgtgttttgatgtcgatgatgattatcatgatgatgatatttgaattacagtttgtatgccttggttaggattctctgcttagccagaacaatcgttgtttagcattgctgtttggctgttaataagaaatgcataccttttga

SEQ ID NO: 1926 - DNA, 1650 bp, Fagus grandifolia
tctctctttctctatcactctcaaacaaacatggaagccgccacgccagctctttctcacataggcctagctggcctcgccgtaatgggccaaaacctagctctaaacatcgccgaaaaaggcttcccaatctccgtttacaaccgtaccgcttccaaaaccgacgaaacactccaacgtgctcacaacgaaggagccctccctctcaccggtcattacaccccgcaagatttcgtcctctcaatccaacggcctagatccatcatcatcctcgtcaaagccggctcccccgtcgaccaaacaatctccgccctctcttcctttatggaacctggagactccatcatcgacggtgggaacgagtggtacctaaacactgagcgccgtatcgaccacgtgtcctcccagggcctactctatctcggcatgggcgtatcgggcggcgaggaaggtgctcgtttcggtccttcgttgatgcctggtggatcttatcaagcttatacgaatgtccaaaatatcctccagaaagtcgcggcgcaagtcgacgacggtccctgcgtgacctacatcggcgagggcgggtcggggaacttcgtcaagatggtacacaacggaatcgaatacggcgacatgcaattgatctccgaggcttacgacgtgttgaagaacatcggcgggttgtcgaaccgggaactcgccgagattttcgacgagtggaatcgcggcgaattggagagtttcttggtcgagattaccgccgatatatttagggttaaggatgagtacggcgaaggtgaattggtggataaggttttggataagaccggtatgaaagggaccgggaaatggacggttcagcaggcggcggagctttccatcgctgcgccaacgatcacggcgtcgttagatggtcgcttcttgagtgcgttgaaggaggagagagagagcgcggcggaggcgttgagaaacgctgggttgaatgaagatgaagagttgggagctgtcaagaagggaattgataagaagagattgattgacgatgtgaggcaggctttatacgcttcgaaaatttgtagctacgcgcaagggatgaatttgttgagagcgaagagcgtggagaaaagttgggatttgaatttcggtgaattggcgaggatttggaaaggcgggtgtattataagggcggtgtttttggataggattaagaaggcgtatcagaggaatccgaatttggcgagtttggtggtcgacccggagtttgcaaaggagatggtgcagaggcaggcggcgtggagaagggttgttgggttggcggtgtcggcgggaattagcacaccggggatgtgcgctagcctgtcgtatttcgatacgtataggcgggcgaggctgcctgctaacttggtgcaggcgcagagggacctttttggggcgcatacctatgagaggattgatcggccgggttcgtttcatactgagtggactaaacttgcccggaatgccggtgttggtgcactcaattgagcttttctcgtctatggtttggttacattttgtgttttgatgttgttggtgatgacatttgaattggggttacgtgccttgtttagttttctctgcttagacagagctaattgtttagccttgcctatt

SEQ ID NO: 1927 - DNA, 1983 bp, Cicer arietinum
aaacacttcactccttccactctcaccaaacaaatatttactattattattaattaattaatagataaatacagaaataaattttataacctcactcaacctgcactctgaaattgaattaagcattcaccaaacccctctctcacccctccctcaaaattcaacaacaatggattcttccactctctctcgcataggcttagcgggactagccgtcatgggccaaaacttagccctaaacatcgccgaaaaaggcttccctatttccgtctacaaccgcacaacctccaaagtcgacgaaaccgtagatcgggcccaccgtgaaggttctctcccgttaaccggccaatacagcccccgcgaatttgtcctctctctccaacgtcctagatcagtcatcatcctcgtcaaagctggcaatcccgtcgaccaaaccatcgccgctctctccgatcatatggagcccggtgactgcatcatcgacggcggtaacgaatggtacgaaaacaccgaacgaagaatccaacaaatctcgaataaaggtatcctttatctcggtatgggagtatccggcggcgaagaaggtgctcgtaacggtccttccctcatgcccggtgggtcttaccaagcctacagcaacatccaggatattctcatgaaggtcgccgctcaggttgaagacggtccttgtgtcacttacatcggcgaaggaggtgccggaaatttcgttaaaatggttcataacggtattgaatacggtgacatgcaacttatttcagaagcttatgatgttttgaagcacgttggtggtttatcgaattctgaactcgctgatatttttgccgaatggaacagtggtgaactcgagagtttccttgtagaaatcactgctgatattttcaaagtgaaagatgatattggtgatggttatttagttgataagattttggataaaaccggtatgaaaggtaccggtaaatggacagttcaacaagcagccgagctttctgttgcggcgcccacgattgccgcttcgttggattgtaggtatttgagtgggttgaaggaagagagggagaatgcatctgcggttttgaaggaagcagggttgaacgaggaagcagggtttgtgaaaagtgggattgataagaagaggttaattgatgatgtgagacaagctttgtatgcttcaaagatttgtagctatgctcaagggatgaatttgttgagggcaaagagtgacgagaaaggttggaatttgaatttaggggaattagctaggatttggaaaggtgggtgtattataagagcagtgtttttggataggattaagaaagcttatcaaaggaaccctaatttggctagtttgatagtggatcctgaatttgctaaggaaatggtgcaaagacaaggagcatggagaagggttgttggattggctatatcggccgggattagtacacctggaatgtgtgctagtcttgcttattttgatacttataggagagctaggcttcctgctaaccttgttcaggctcagagggatttgtttggagctcatacctatgagcggctcgatcgccccggcgcgtttcataccgagtggacgaaaattgctcgtcagagtggtactggtgttgctgctcttaattgatcattggtgatgtgtcacttttgtgtggttagttcagttgtttctttgttggctggttaatgcagcatttgtgttgcgattgtatgtttctgaggatctttggttatggttaggcagagcaactattgtttccttaatattattgtttttgcttttaagttaacaaataaaagaaaggccttgtcatttgaattaatcaggcttttgtgtttcaactttgcttccttaagtacactttgaattgttgatgctttgtctggtagatacatttcaagctgtgtttaaagattgtgtattagcaataatagaaacatcctctcaggcttcaa

SEQ ID NO: 1928 - DNA, 1893 bp, Papaver somniferum
gattcccatttctcaattttcatctctgatttcaatctccaaatatggaagcatcagcaggattatcacgaatcggactagcaggtctagcagtaatgggccaaaacctagcactcaacatagcagaaaaagggttcccaatctcagtctacaaccgaaccacctccaaagtcgacgaaacaatcgaacgagcaaaatcagaaggagatcttccactaacaggtcattactcgcctcgtgatttcgtgttgtctttgcaaaaacctagatctgttatcattttagtcaaagccggtactccggtcgatcagaccatatcgactctgtcggagtacatggaggaaggggataccattattgatggtgggaatgaatggtatgagaacactgagcgtcggattcgggagaccgagcagaaggggattttgtatttggggatgggtgttagtggtggtgaagagggagccaggaatggacccagtatgatgcctggtgggagtttgacggcgtataagaatattgaggagattgtgaagaaggttgccgcgcaggtggaggatggaccgtgtgttacgtatattggcgaaggtgggtcggggaatttcgtgaagatggtgcataatgggattgagtatggtgatatgcagttgattagtgaggcgtatgatgtgttgaagaatgttggtgggttgagtaatgaggagttggcgaggattttcgatgagtggaataagggggagctggagagttttttggttgagattactgcggatatttttaaagttaaggatgatttgagtgaaggggagttggttgataagatattggacaagactgggatgaaagggactgggaaatggacggttcaacaagcagcggagttgtctgttgctgcgccgactattgctgcttcgttggattgtaggtatctgagtgggttgaaagaggagagggagaatgccgaggcgattttgaaggaagctggtatggttgatcaggttggaccggtcaggtctgggattgataagaagaggttgattgatgatgtgagacaagcattgtatgcttccaagatttgtagttatgctcagggtatgaatttgttgagagcaaagagtaatgagaaaggttggggtttggatttgggtgaaatggcgaggatttggaaaggtgggtgtatcattagagctgtgtttttggataggattaaacaagcctaccagagaaacccacaactggcaagtttggttgttgatcccgagtttgcaaaggaaatggtgcagagacaagcagcatggaggagagttgttggtttggctgttcaagctggaattagtactcctggaatgtgcgctagtcttgcttactttgatacttacaggcgcgcaagactgccggcaaatcttgttcaagcacagagagatttgtttggtgcacacacttacgagcgcattgatcgtcctggggcattccacaccgaatggaccaagcttgctaggcagagtaacttcaaataagcaggcagttttcctcgttatcggctcattgctggttagtttggtctatgagttactaatgcttcttcatttttcctgcatttttatagaggtttaatcatagtagaaatttcttgtagtggattttctgcttaggcttttctttcttgttctagctctttagtttgtttgttaataagaggtgctctgaatactccgaaaatatttccgaccttcctaattttaatttaggaggtgatagatgagccaaatgtactttgcttttgttgtcgcgagatttaaaaaaccaagtgatttgtttgtgttgtttcaataatggtcttccccattagttcactaggaaaatctcagtaatgtcgcctctaggcatgcttaa

SEQ ID NO: 1929 - DNA, 1827 bp, Aquilegia formosa
tttcctttcaacaaagcttcctttctcagctctactgactttggaagctcgtttctttattccggtgatttcaattcattttccgatatcaaacgagttattagccatggacgcatcagcagcaggtctctcacgcattggactagctggtctagctgtcatgggtcagaatcttgctctcaacatagcggataaaggattccccatctctgtttacaatcgtacaacttctaaagtcgatgaaaccctagaacgagctaagcacgaaggagatctccctctcactggtcattattcaccacgtgatttcgttctctccatccaacgacctagatctgtcgtcatcctcgtcaaagccgggtcccctgtggatcagacaatttctgctctctctgagtacatggagtcaggtgacacaatcattgatggtggcaatgaatggtatgagaataccgagcgccgtatgcgtgaagttgctgataaaggtattctttatttgggcatgggtgtgtcaggcggtgaagagggtgccaggaatggaccttcccttatgcccggtggatcctaccaagcttacttgaatgttgaagacattgtgaaaaaggttgctgcacaagtggaggatggcccttgcgtcacctacataggtgaaggtggctcaggtaattttgttaagatggtccacaatggcattgaatatggtgacatgcaattgatttcagaggcttatgatgtgttaaagaatgttggaggactgtccaattccgagttggcagacatttttgctgagtggaatagaggagagcttgaaagctttttgattgagataacggctgatatatttaaggtacaagatgaacatggtaatggcgaattagttgataaaattttggataagacggggatgaaggggacagggaaatggacggttcagcaggcagccgaattgtctgttgctgctccaaccattgctgcgtctttggattgtcggtatttgagtggtttgaaagaggagagagaggttgccgctgcagttttgaaggaagcaggcatgcaggacgtgtttggagctgcgatgccaaatattgataagaagagattgattgatgatgttagacaagcgttgtatgcatcaaagatatgtagttatgcgcaaggaatgaacttgctgagagccaagagtgtagagcaaagttggaatctcaactttggtgaactagcaaggatttggaaaggtggttgtattatacgggctgtgttcttggaccgaattaagaaagcgtaccaaaggaatccacaattggcaagtttgattgttgatccagactttgcaaaggagatggtgcagaggcaggcagcgtggagaagggttgtagggttggctatccaagcagggattagcactccaggaatgtgtgctagccttgcttattttgacacctataggcgtgcgagacttcctgcaaaccttgtccaggcacagagagatttgtttggggctcatacatatgaacgcattgatcgtccaggagccttccacactgagtggacaaagcttgcaaggcagggcaagactggtatgggtgttttacactgagtttatcttctacattcttgcaattcggattggttaaaatgggttgacattgttcgttaattttaattgggcgagttgcacaatgtattcactgcctaggcctttatagttgttgttttgccttgaagtttttgttgtcaataagagatgcatctgcctattgagcttggtcggctatattgtgatttttctatgaattctgtcctttgcaatagatgtagataaggaaa

SEQ ID NO: 1930 - DNA, 2055 bp, Populus trichocarpa
tctctctccctctctctccccaaccccatttgttctctctctacaccatggacgcctctactctttcacgcataggcctagccggtctagccgtgatgggtcagaacttagccctaaacattgctgaaaaaggtttcccaatttcagtctacaacagaaccacctccaaagtcgacgaaacccttcaccgtgcccaatccgaaggcccatttcctttaactggtcagtactcccctcgtgattttgttctctcaatccaacgccccagatccatcattatcttggtcaaagctggaaaccctgttgaccaaacgatttctgctttgaccgagttcatggagcctggtgatactatcatcgatggcgggaatgagtggtatcagaatactgagaggaggattcaagaagtgggagataaagggattctttatttgggtatgggggtttcgggtggagaagaaggtgcacgacatgggccttcgttgatgcctggtgggtctttggaggcgtataataatattgagtctgttttgaagagtgttgccgctcaagttgatgatgggccttgtgttacgtatattggtgaagggggttctggcaattttgttaaaatggttcataatgggattgagtatggagatatgcagttgatttcggaagcctatgatgttttgaagaatgttggtgggctttctaatggcgaattagctgagattttcggggagtggaatagaggggagttggagagttttttgattgagattacgagtgatatttttaaggttaaggatgatttggctgacggggatctggttgataagatattggataaaactggaatgaaagggactgggaaatggactgtccagcaagctgctgagttgtctgttgctgcgcctacaattgctgcttcgttggattgtaggtatttgagtgggttgaaggaggagagggagagtgcggccgagattttggaaaaagctggcttgaaggaggaaatggggagtgttaagagtgagattgacaagaagaggttgattgatgatgtgaggcaagcattgtatgcgtcgaagatttgcagttacgctcaggggatgaatttgttgaggtctaagagtgttgagaaagggtgggatttgaatttgggtgagttagctaggatttggaaaggtggatgcattattagggctgtgtttttggataggattaaaaaggcttaccagaggaatcctagcttggctagtttagttgtggacccggaatttgcgagggagatggtgcagaggcaggcggcatggaggagagtcgtggggctggcgatttcagctggtattagcactccagggatgtgtgctagtcttgcatattttgatacttacaggcgtgctaggctgccagcaaaccttgtccaggctcagagggacttgtttggggctcatacttatgagaggaccgatcgtccaggggcatttcatactgagtggacaaagcttgctcgtaagagcaatgctggttttggagctttcaattgagcatgttcatgagtcggttggctgtttgtttgtttgtttcaattggccgttggtaatgtttctctttgaactatggttgtatgtttccttgagaggattcgttgcagttattggttagcctcacagattttactgttaataagaaatgcatgcctcttgagttcagtaaattggtttttcatctgcagcaggcacgatagagttgagttctgccttttagattttgcttatttgctcctgaataatgtttcgacctcttgtgaggctatttgatttgaaactttgtaatttgcatactttacgtaagtatgtgtatgtccttctagaaataaacctgttcgaatgcatcttatgtgtttatgaaacaattctgatacaaatgtatcataggttacaaggttggttgcaatgtgaaaacgtggttgttgggcaggaatgttaacttcatcataagttcaagttagctgttgatttttttttttttttttgaagtcaatgaacacttgatgatttgttgagtttt

SEQ ID NO: 1931 - DNA, 1939 bp, Papaver somniferum
tggaagcatcagcaggattatcacgaatcggactagcaggtctagcagtaatgggccaaaacctagcactcaacatagcagaaaaagggttcccaatctcagtctacaaccgaaccacctccaaagtcgacgaaacaatcgaacgagcaaaatcagaaggagatcttccactaacaggtcattactcgcctcgtgatttcgtattatctttgcaaaaacctagatctgttatcattttagtcaaagccggtactccggtggatcagaccatatcgactttatcggagtacatggaggaaggggatacgattattgatggtggtaacgaatggtacgagaacactgagcgtcggattcgggagaccgaacagaaggggattttgtatttggggatgggtgtcagtggtggtgaagagggtgcgaggaatggacccagtatgatgcctggtgggagtttgacggcgtataagaatattgaggagattgtgaagaaggttgccgcgcaggtggaggacggaccgtgtgttacgtatattggcgaaggtgggtcggggaattttgttaagatggtgcataatgggattgagtatggtgatatgcagttgattagtgaggcgtatgatgtgttgaagaatgttggtgggttgagtaatgaggagttggcgaggattttcgatgagtggaataagggggagttggagagctttttggttgagattactgcagatatttttaaagtcaaggatgatttgagtgagggggagttggttgataagatattggataagactgggatgaaagggactgggaagtggactgttcagcaagccgcagagttgtctgttgctgcaccaacgattgctgcttcgttggattgtaggtatttgagtgggttgaaagaggagagggagaatgcggaggcgattttgaaggaagctggtatggttgatcaggttggaccggtcaggtcggggatcgataagaagagactgattgatgatgtgagacaagcgttgtatgcttcgaagatttgtagttatgctcaaggtatgaatttgctgagagcaaagagtaatgagaaaggttggggtttggatttgggtgaaatggctaggatttggaaaggcgggtgtatcattagagctgtgtttttggataggattaaacaagcctaccagagaaacccacaactggcaagtttggttgttgatcctgaattcgcaaaggaaatggtgcagagacaagccgcgtggaggagagttgttggtttggctgttcaagctggaattagtactcctggaatgtgcgctagtctcgcttactttgatacttacaggcgtgcaagattgccagctaatcttgttcaagcacagagagatttgtttggtgcacacacttacgagcgcattgatcgtcctggggcattccacaccgaatggaccaagcttgctaggcagagtaacttcaaataagcaagcagttttcctcgttatcggctcgatgctggttagtttggtttatgagttactaatgcttcttcatttttcctgcatttttatagagatttaatcgtagtagaatttcttgtagtggattttctgcttaggcttttctttgttgttctagctctttagtttgtttgttaataagaggtgctctgaatactctgaaaatatttccgaccttcctaatttaggaggtgatagatgagccaaatgtactttgcttttgttgtcgcgagatttaaaaaaccaagtgatttgtttgtgttgtttataatggtcttcccattagttcactgggaaaatctcagtaatggtctaggcatgcttaagcggaacatatgctcttgctaacataaaactgatattcaacaccttcattctcatttgccccaggccgagcaattttcatttaatgtttgagttctaattggata

SEQ ID NO: 1932 - DNA, 1589 bp, Castanea mollissima
  misc_feature (40)..(40): n is a, c, g, or t
cgtacgtccgtacctccttaccgacgacgtaccgtacganatatatactaactaaacctaaccctcctctctctctctctctctcactcaccaaccctacccaccatttccaatctctctctctaatccaaaaaaggtcagctcattgaaaccatggcgacgccagctctctcacacataggcctagcagggctagccgtgatgggccaaaacctagccctaaacatcgccgagaaaggcttcccaatctccgtctacaaccgcaccgcttccaaagtcgacgagacccaccaccgcgcccaaaccgaaggcgacctccctctcactccacactacactcctcgcgacttcgtcctctcaattcagcgccccagatccatcatcatcctcgtcaaggccggctccccggtcgatcaaaccatcgccgccctctcctctttcatggaccccggcgactccatcatcgacggcggcaacgaatggtacctgaacaccgagcgccgtatccaacaggtctcctcccaaggcttgctgtatcttggcatgggcgtatcgggcggcgaagaaggcgcccgatacggtccttccttgatgcccgggggttcttttcaagcgtattccaacgtccagaatattcttcagagagtcgcggctcaggtcgacgacggtccttgcgtcacctacatcggcgaaggcggttccggcaacttcgtcaaaatggtacacaacggaattgaatacggcgacatgcaattgatttccgaagcctacgatgtgttgaagaatatcggcgggttgtcgaattcggaactcgccgatattttcgccgagtggaatcgcggcgagttggagagcttcttggtggagattacggcggatatttttagggttagggatgagttcggcgagggcgaattggtggataaggtcttggataagactgggatgaaagggactgggaaatggactgttcagcaggcggcggagctttccatagcggcgccaacgattgcggcgtcgttggacggtcggtatatgagtgggttgaaggaggagagagaaagcgccgccgcggcgttgagggaggcgggtttgaaagaagaagagcagttgggaggagtgaagaagggaattgataagaagagactgattgatgatgtgaggcaagctttatacgcttcgaaaatttgtagttacgctcaagggatgaatttgttgagagcaaagagtgtggagaaaggttgggacttgaatttgggggaattggcgaggatttggaaaggtgggtgtattataagggctgtgtttttggataggattaagaaggcttatcagaggaatccgaatttggcgagtttggtggtggacccggagtttgcaagggagatggtgcagaggcaggcggcgtggaggagggttgttgggttggcggtgtcagcggggattagcacgccggggatgtgtgctagtctgtcgtattttgatacgtataggcgggcgaggctgcctgcaaacttggtgcaggcgcagagggaccttttcggggcgcatacttatgagaggattgataggcccggttcgtttcatac

SEQ ID NO: 1933 - DNA, 1819 bp, Papaver somniferum
atggaagcatcagcaggattatcgcgaatcggactagcaggtctagcagtaatgggccaaaacctagcactcaacatagcagaaaagggattcccaatctcagtctacaaccgcaccacctccaaagtcgacgaaacaatcgaacgagcaaaatcagaaggagatcttcctctaacaggtcattactcgcctcgtgatttcgtattatctttgcaaaaacctagatctgttatcattttagtcaaagccggtactccggtcgatcagaccatatcgactctatcggaatacatggaggaaggagatacgattattgatggtgggaatgagtggtatgagaacactgagcgtcggattcgggagaccgaacagaaggggattttgtatttggggatgggtgttagtggtggtgaagagggagccaggaatggacccagtatgatgcctggtgggagtttgacggcgtataagaatattgaggagattgtgaagaaggttgcggctcaggtggaggatggaccttgtgttacgtatattggcgaaggtgggtcggggaattttgtgaagatggtgcataatgggattgagtatggtgatatgcagttgattagtgaggcgtatgatgtgttgaagaatgttggtgggtgagtaatgaggagttggcgaggattttcgatgagtggaataagggggagctggagagttttttggttgaaattactgctgatatttttaaagttaaggatgatttgagtgaaggagagttggttgataagatattggataagactgggatgaaagggactgggaaatggacggttcaacaagctgcggagttgtctgttgctgcgccgactattgctgcttcattggattgtaggtatttgagtgggttgaaagaggagagggagaatgccgaggcgattttgaaggaagctgggatggttgatcaggttggaccggttaggtctgggattgataagaagaggttgattgatgatgtgagacaagcattgtatgcgtcaaagatttgtagttatgctcagggtatgaatttgctgagagcaaagagtaatgagaagggttggggtttggatttgggtgaaatggcgaggatatggaaaggtgggtgtattattagagctgtgtttttggataggattaaacaagcttaccgtagaaacccacaactggcgagcttggttgttgatcccgagttcgcaaaggaaatggtgcagagacaagcagcgtggaggagagttgttggtttggctgttcaagctggaattagtactcctggaatgtgcgctagtctcgcttactttgacacttacaggcgtgcaagactgccagctaatcttgttcaagcacagagagatttgtttggtgcacacacttacgagcgcattgatcgtcctggggcattccacaccgaatggaccaagcttgctaggcagagtaacttcaaataagcaagcagttttcctcgttatcggctcgttgctggttagtttggtttatgagttactaatgcttcttcatttttcctgcatttttatagagattaatcatagtagaatttcttgtagtggattttctgcttaggcttttctttcctgttctagctttttagtttgtttgttaataagaggtgctctgaatacttcgaaaatatttccgaccttcctaatttaggaggtgatagatgagccaaatgtactttgcttttgttgtcgcgagatttaaaaaaccaagtgatttgtttgtgttgttccaataatggtctccccattagtttactgggaaaatctcagtaatg

SEQ ID NO: 1934 - DNA, 1810 bp, Papaver somniferum
tttactacaaattagtaccaatttacttagaatttacaatacttacgatttcctgattacatctctaaaaatggaagcatcagcaggattatcacgaatcggactagcaggtctagcagtaatgggccaaaacctagcactcaacatagcagaaaaagggttcccaatctcagtctacaaccgaaccacctccaaagtcgacgaaacaatcgaacgagcaaaatcagaaggagatcccccattaacaggtcattactcgcctcgtgatttcgtattatctttgcaaaaacctagatctgttatcattttagtcaaagccgggactccggtcgatcagaccatatcgactctatcggagtacatggaggaaggggatacgataattgatggtgggaatgagtggtatgagaacactgagcgtcggattcgggagaccgaacagaaggggattttgtatttggggatgggtgttagtggtggtgaagagggagcgaggaatggacccagtatgatgcctggtgggagtttgatggcgtataagaatattgaggagattgtgaagaaggttgccgcgcaggtggaggatggaccctgtgttacgtatattggcgaaggtgggtcggggaattttgtgaagatggtgcataatgggattgagtatggggatatgcagttgattagtgaggcgtatgatgtgttgaagaatgttggtgggttgagtaatgaggagttggcgaggattttcgatgagtggaataagggggagctggagagttttttggttgagattactgcagatatttttaaagtgaaagatgatttgagtgaaggggagttggttgataagatattggataagactgggatgaaagggactgggaaatggacggttcaacaagctgcggagttgtctgttgctgcgccgactattgctgcttcattggattgtaggtatttgagtgggttgaaagaggagagggagaatgccgaggcgattttgaaagaagccggtatggttgatcaggttggaccggttaggtctgggattgataagaagaggttgattgatgatgtgagacaagcgttgtatgcttcgaagatttgtagttatgctcaaggtatgaatttgctgagagcaaagagtaatgagaagggttggggtttggatctgggtgaaatggcgaggatttggaaaggtgggtgtattattagagctgtgtttttggataggattaaacaagcttaccgtagaaacccacaactggcaagtttggttgttgatcccgagtttgcaaaggaaatggtgcagagacaagcagcgtggaggagagttgttggtttggctgttcaagctggaattagtactcctggaatgtgtgctagtcttgcttactttgacacttacaggcgcgcaaggctgccagctaatcttgttcaagcacagagagatttgtttggtgcacacacttacgagcgcattgatcgtcctggggcatttcacaccgaatggaccaagcttgctaggcagagtaacttcaaataagcaagcagttttcctcgttatcggctcgttgctggttagtttggtttatgagttactaatgcttcttcatttttcctgcattttatagaggtttaatcatagtagaatttctttgtagtggattttctgcttaggcttttctttgttgttctagcttgtttgttaataagaggtgctctgaatactccgaaattatttccgaccttcctaattttaatttaggaggttgatagatgagccaaatgtactttgcttttgtgtcgcgag

SEQ ID NO: 1935 - DNA, 2180 bp, Populus trichocarpa
ctctttactctctgtctaccatggacgcctctactctttcacgcataggcctagcaggtctagccgtgatgggtcaaaacttagccctaaacattgccgaaaaaggttttccaatctcagtctataaccgaacaacttccaaagtcgacgaaactcttatccgtgctcaatccgaaggcccattctccctaactggtcactactctcctcgtgattttgttctctcaatccaaaggcctagatccatcatcatcttggtcaaagctggaaacccagttgaccaaacgatctctgctctgaccgagttcatggagcctggtgacactatcatcgatggtgggaatgagtggtaccagaatactgagaggagaattcaacaggtggcagataaagggattctttatttgggcatgggggtttccggtggcgaagaaggtgcaagacacgggccttcgttgatgcctggtggttcttttgaggcgtataagaatattgagtctgtcttgaagagtgttgcagctcaagttgatgacggtccttgtgttacttatattggcgaagggggttctggaaattttgttaaaatggttcataatgggattgagtatggagatatgcagttgatatcggaagcttatgatgttttgaagaatgttggtgggctttcgaatagcgaactggcggaaatttttggggagtggaatagaggggagttggagagtttcttgattgagattacgagtgatatttttaaggtcaaggataatttggttgatggggatttggttgataagatattggataagactggaatgaaagggacagggaaatggactgttcagcaagctgctgaattgtctgttgctgcaccgacgattgctgcttcgttggattgtagatatttgagtggtttgaaagaggagagggagagtgcggcggagattttgaaggaagctgggttggaggaggaagtggggagtgttaagagtggggttgataagaagaggttgattgatgatgtgaggaaagcattgtatgcatccaagatttgtagttatgctcaagggatgaacttgttgagggctaagagtgttgagaaaggttgggatttggattttggtgagctagctaggatttggaaaggtgggtgcattattagggctgtgtttttggataggattaaaaaggcttaccagaggaatcctaacttggcaagtttagttgtcgacccggagtttgccagggagatggtgcagaggcaggcggcttggaggagagttgtggggttggcgatttcagctggaattagcactccgggaatgtgtgccagtcttgcttattttgatacttataggcgtgctaggctgccagcaaatcttgttcaggctcagagagacttgtttggggcccatacttatgagaggactgatcgtccaggggcatttcatactgagtggacaaaacttgctcgcaagagcagtgctggtgctttcagttaagcctgttcatgggttgatcggctgtttgtttgtttcaattggctgttggtaatgtttctctttgagctgtagtacttgtatgtttccttgagaggattcgttgctgttattggttagcctcacagaatttgctgttaataagaaacgcatgcctcttgagtacagcaagtttgtttttttattttctgtagataggatacagttcagctctgctttatagattttgcttatttgctgctgaataatgtttacaactcctgtgaggctattcgatatgaaacttcttagttcgcatgctctatgaaagttccttgttccagtaataagcctgtttgaatgcgtcgtacatgttcatgaaaatcaatgctacaaggttggttgcagtgtgaaagcatgcttgttggcggggatgttaacttcatcttcagttcaagtttgctgttgatttgcttatattcaatgaacaattgatgatttgctgattttttggatcttgaatgctctgttaagagagaagggaatgcactctattccagcctttaaggtgtttgtggcagtttatcatcggttgctttttagtttgtgtttattccaaaccttttccatggaaatctttagttttcatgcatcatctgctatgaactttacatgatgctcaacttctgcacgattcaccagaag

SEQ ID NO: 1936 - DNA, 2341 bp, Aristolochia fimbriata
aaaaaagagggaaaagagttttttttaatttttggtacaccctccacgttggttgccacgtcacaggtaagggggtgaagtgtgaatagcaaagtatctgtttattattatttttttttactcgttgccgtggttcccgagggcatccatttcagtttctataatagtgagatcgacctataagaaatcgactgccgactgccaaggtctgctctggtgtgtgcgactgcctctgcctggtgagaagaaacgcgacaatttgtccaaccttcggaggttccaagggtcaccctcaccctctcttcgaagttcgaagacaccttccttccccggttccccctttttattcccggagattttgaggggggtttcagttttcagtctctctctctctctctctctctttatctaatcgaagtcatcctacccgtttcaattttgctcccgtagacgcaatggatgcctctgctctggcgctatctcagatagggctcgcgggtctggccgtcatgggccagaacctcgccctcaacatcgccgagaaggggtttcccatctccgtctacaatcggacatcctctaaagtcgacgagactgtctctcgtgctcaacaggaagggggtctcccgctcgccggccactactcgccccgggacttcgtcctctcgattaaacgtccccgctccatcgtcatcctcgtcaaggcgggcgccccagtggaccagactatctccgcgctctcccagttcatggagcccggcgatgcgattattgacggcgggaacgagtggtacgagaatacggagcgtcggatggaggaggcggatcaaaggggtctgctgtacctcgggatgggggtttctggcggcgaggagggtgcccgtcgggggccatccttgatgcctggcggttcttatcaggcgtacgagaacgtcagagacatcgtgcagaaagtcgcagcgcaggttgatgatggaccttgtgttacctatgttggtcccggcggttcggggaatttcgtgaagatggtccacaatggcatcgagtacggcgacatgcagctcatttcggaggcctatgatgtgttgaagacggtgggagggctttctaattccgagttagcggatattttctctgagtggaatcgaggggagctcgagagcttcctaattgagatcacggcggacatattcaaggttaaagatgatcttgccggggaaggcgagttggtggataagattcttgataaaaccggcatgaaggggaccggcaaatggaccgtccaacaggctgcagagctctccattgcagcccccaccattgctgcctcactggactgccgatacttgagcgggcttaaggaagagagagaaaatgcttcgcgggttttggaggatgctgggattggccgacctggggaagtattgcttggccgttccgtcgataagaagaggttaattgacgatgtcaggcaggccctgtatgcgtcgaagatttgcagctacgcccagggaatgaaccttctgcgggcaaagagcgtcgaaaaagcatgggaccttaatctgggcgagttagcaaggatttggaagggtggctgcattattagagcagtatttttggatcggattaagaaggcttacgagcgcaaccgggagctgccaaacttggtggtagaccctgagtttgccagggagatggtgcaacgccaggctgcttggaggcgggtcgtgggtttggccattgaagccgggattagtactcctgggatgtgtgcaagtctggcatatttcgatacttacagacgggccaggctccctgctaatcttgtccaagctcaaagagacctctttggtgcccatacttacgagcgagtggaccgatctggttccttccacactgagtggacaaagatcgctaggcagagtaagccaggtgctgttggtgcttttaattgaggtgattatgggcactgtgctctctttaccttctagtaagtcagttgcttagactataggcgccaattaattggtgttttttcttcatgaggcattactgctgccatctgtttagcagtttgataataattacaatctgaagactcctttttcttggttttgattgttgaagaaggtggaattatgttccttcattcttactgaagatatgcaaaatcatcacattttgcacacttgattgatttgctgtgagcgtgtagttattttttgctttggttgagtataggtctgttatattgcattggagttcccttggcatagaaacttccttctccggttgagattttttgataattatatactgctgtgatgcgtgactgcgttca

SEQ ID NO: 1937 - DNA, 1964 bp, Phaseolus coccineus
cattctcaggcgtagttgttgcatcctccaaaactccttcgcactttacacactctcaacaatcttctctttttcgaatggagtcagcagctttgtcgcgcataggtctggctggcttggccgtgatgggccagaacctagccttaaacattgcggagaagggatttcccatttccgtctataaccgtacggcctccaaggtcgatgagaccgtagatcgggcccgcaatgagggcttcctaccgctcacggggcaatacaatcctcgtgaattcgtcttgtccatccagcgtcccagatctgttatcatcctcgtcaaggccggcgcccccgtcgatcaaaccattgccgcgctctccgaccacctcgagcccggcgactgcatcattgacggcggtaacgagtggtacgagaacactgagcgccgcatcagccaagtggcagataaaggtctcctctaccttggcatgggcgtgtctggcggggaagatggagcgcgttacggcccatctctgatgcccggcggttccaaaacagcctacaacaatgtacacgacatcctccacaaaatcgcagcgcaggtcgatgacgggccttgcgtcacgtacatcggggagggaggttctgggaacttcgtgaagatggtccacaacggaatcgaatacggagatatgcaactcatctcggaggcttacgacgtgttgaagcacgtcggtggcctgtcgaattccgagcttgcggatatcaacgcagagtggccattacggccggggagcttgagagtttcttgattgaaatcactgcggatatttttaaagtgaaggatgaggatggtgaagggtttttggtggataagattttggacaaaacagggatgaaggggacggggaaatggacggtgcagcaggcggcggagctgtcgatacccgtccccacgattgcggcgtcgttggattgcaggtacttgagcgggttaaaggaagagagggagaatgctgagatggtgttgaaggaggcggggatgagtgatgaattcgggagaattggtatgactggggtggaaaaaaagaggttgattgatgatgttaggcaggctttgtatgcttcaaagatttgtagctatgctcaaggaatgaatttgttgagggccaagagtaatcaaaaagggtggaacttgaatttgggggaattggctaggatttggaagggaggatgcattataagggcagccttcttggacaggatcaagaaggcttatcaaaggaaccctaatttggctaatttaatagttgacccggaatttacaagggaaatgatgcagaggttggctgcatggaaacgggttgtggggttgacagtttcagctgggattagtgctccaggaatgtgcgctagtcttgtttactttgatacctaccggaggggcacgatgccggcgaaccttgttcaggctcagagggacttgtttggggcccatacatatgagagggttgatcgtcctggagctttccataccgagtggacaaagcttgcacgccaaagtgggactggagttggtgctctcaattgatgatgagttttggttgtttggctgttggccctacagtgcagcctttgagttgtaattgtttgtttctttgaggatctttggtaggcagagcaactattgttttcttgctagaactgttttgttccttaataaaacgaaggcatgtcatttggcttttgcttcagtagagtacaagttgttgatgttcttgtcaaatgtatatttgtttgaaattatagctataattgcatttttggatttgattcctcaaagtgaggaaggttaaagtaagtaatctaatcaaatgctcatgatttttgtatatatgtgcatatgatgctccttgcttgattatccgaagtaaccctgtagaagaaaagattgatccctgcattttatattttatgatgaaaca

SEQ ID NO: 1938 - DNA, 1840 bp, Amborella trichopoda
taatggaggtcgccacgctctcgcgcatcggccttgcaggccttgcggtcatgggccagaacctcgccctcaacatcgccgagaagggattccccatctccgtctacaaccgaaccacttcaaaggtcgacgacaccgtccatcgcgccgatgccgaggggggcctccccctcttaggccaccgctccccacaggacttcatcctctccatccagcggccccgctctgttgtcatcctcgtcaaggccgggagacctgtcgaccagaccatcgcgaccctctcggccttcatggagcctggggactgtttgattgatgggggaaacgaatggtatgagaacactgagcggcgcattgaggaggcgtctgcccgtggcctcttgtatctcggcatgggcgtgtcgggcggcgaggagggtgctcgcaacggcccctcgctgatgcctggcggatcgtttgatgcgtatcagaatatcagagatattctcgagaaggtggcggcccaggtgtctgatggtccttgtgttacttatataggacccgggggttcaggcaatttcgtgaagatggtgcacaatggcattgagtatggtgatatgcagttaatctctgaggcctatgatgttttgaagcatgttggtgggttgagtaaccaggaattggttgagatttttgaagggtggaataggggggagcttgagagtttcttgattgagatcacctctgatatatttagggtcaaggatgagtttggagagggggaactggttgataagatcttggataaaactgggatgaaggggactgggaaatggacggttcagcaagcggccgagctctctgtggcggcacccacaatcgcagcttcgcttgattgcaggtatctcagtgggttaaaagaagagagagaggcggcatcaaaggctttttcggagtttgggctgagtgaggttttggcgaggccggcagtcgataagaagaagctcattgaagatgtgaggcaggctttgtacgcctcgaaaatttgcagttacgctcaagggatgaacttgcttcgagcaaagagcgtcgagaaagggtgggggttgaaccttggcgaattggcaaggatatggaagggtgggtgcattataagggctgtgtttttggataggatcaagaaggcatatgagaggaatcgcgagctcccaaatcttatggtggacccggaattcgctagagagatggtgcaaaggcaagcagcctggaggagagtggtgggtttggcaattgaggccggaatcagtacacctggtatgaatgcgagcttggcttatttcgatagttataggcgagcgaggctcccagcaaatcttgtgcaggcacagagggacttgtttggggctcacacttatgagaggatcgataggccaggctcgtaccatactgagtggaccaagctcgccaggcagaacaaggcaggtgtcagtgctcttaactgaagtagttggtaagagagaaaaattaattttttgtctgtcatctgcttcatcatgccttagtcttgaatgtggctgcaattccgtctttcttttttctttttaatgttatgggactctgcatgggtgtttgaatctcgattttgcctggagggttcggaacaatgtgcttgatttggtggtttgaataatgagcatagtatatggtttctgggtttcttctggagctgtagtttatgtattttaatgaattgctctagaattttagaggagataagaaggatgtttttgctgttttttttcctacatctgtgaatcgtgttgctattcaattgaaatcatgagctgtctatagatatttg

SEQ ID NO: 1939 - DNA, 1831 bp, Citrus sinensis
aaaaaaaaaaaagggctgcgtacgccgtcgtatgggcaggtagctcaatttgtattgtccctcggaatcatcgcacgctctttttcgtttggtttggtcgttaagtcagtggcctttcgctccctcgacgagtccgtcgcgctctcaccaacctcaatttgcatttcaatggaagcctctgctctctcacgcatcggtcttgctggcctagccgtcatgggccagaacctggccctaaacgtcgctgaaaaaggcttcccaatctccgtctacaaccgcactacttccaaagtcgacgaaaccctagatcgggcccaccgcgagggtcaactccctttgaccggccactacactcccagggacttcgtcctctccatccaacgccccagatccgtcatcatcttagtcaaagccggctcccccgttgaccagaccatcgccgccctctcggagcacatgtcccccggcgactgcatcatcgacggcggcaacgagtggtacctcaacaccgagcgccgtatccatgaagccagccagaagggtttgctttatctcggcatgggggtctccggcggcgaggaaggcgcgcgtcatggtccctctttgatgcccggtggctccttcgaggcttataataatattcgagatattttgcaaaaagttgccgcccaagttgatgatggcccttgtgttacttacattggtgaaggcgggtctggtaatttcgttaagatggttcataacggaattgaatacggagacatgcagttgatttccgaagcttacgatgttttgaagcacgtgggtggactcagcaatgccgagttagcggagatatttgatgagtggaataagggcgagttggagagtttcttggttgagatcactgctgatattttcaaggtgaaggatgaatatggtgagggtgagcttgttgataagattttggataagaccggaatgaaagggaccggcaaatggaccgttcagcaagctgctgagctctcagtcgctgccccaaccattgctgcgtcgttggattgtaggtacttgagcggcttgaaagaggaaagagagaaagccgccaaggtcttgaaagaggcgggattgaaagatgaggttcaaaatgtgggagtacatgttgacaagaagagattgattgatgatgtgaggcaagcgctgtatgcttccaagatttgtagttatgcgcaagggatgaatctgttgaggagtaagagtaatgagaaaggatggaatttgaattttggcgaattggcgaggatttggaaaggtgggtgtattattagagccgtttttttggataggattaagaaggcttatcagaggaatccaaatttagctagtttggtcgtggacccggagtttgcgagggagatggtgcagaggcaggctgcgtggaggagagttgtggggttggctatttcagctgggattagcactcctgggatgtgtgctagtctttcttattttgatacttacaggagggctcggctgccagcgaatcttgttcaggctcagagagacttgtttggggcgcatacttatgagaggattgatcgccctgggtctttccacactgaatggacaaaactgcccgccagactggtgccggtgttggtgcgttcaattgagctgctaccttttgttgcttgtttgtttgattgattgtttcaatcgggtattgatgatgttcaatttgaattagggttgtatctttcattgggaatttcatgcctagccattaaggcattgcaattatcaattagtctcacagtttagctgttaataagaaatggatgcctttctatag

SEQ ID NO: 1940 - DNA, 1818 bp, Silene vulgaris
caaccatccccacctaacccaacctcacctaaccgaaccatggcagcagtaaccccagcccaaatcggtctagccggactagccgtaatgggtcagaacctagccttaaacatagccgaaaaaggcttcccaatctccgtctacaaccgaaccacaaccaaagtcgatgaaaccatacaccgagcccaaaccgaaggtaatcttcctatgtacggtcaatactccccacgtgactttgtcctttcaattcaacggccgagatctattatcatcttggtcaaggctggtgcccccgttgaccagactattgctggtttagccgagtttatggaacctggcgatacgattattgatggcgggaatgagtggtatgagaatactgagaggaggattgttgatgctcatgctcgcggtttgctttatcttggtatgggtgtttctggtggcgaagatggcgcccgctttggaccgtctcttatgcctggtggagactttgaggcttactcaaatgtggaaaatgtgttgaagaaaattgctgcccaagttgatgatggtccatgtgtgacttacattggggagggtggtgccggtaactttgtgaagatggtgcacaatgggattgaatacggtgatatgcagttgatttcagaggcttatgatgtgttgaggcatgtgggtgggctgagtaatgaggagttggggagtatttttgacgagtggaatcgaggtgagctagagagcttcttagttgagattacagctgacatttttaaggttaaagacgagttagcagacggtgagttggttgataaaattttggataagaccggaatgaagggtactgggaagtggactgttcagcaagctgctgagctctctgttgctgctcccaccattgccgcctctttggactgcaggtacctaagtgggttaaaagaggaaagagagagtgcagccaaggcactgctcgatgcaggcatgaaggaagaagtgagcgcagttagaagtggggttgacaagaagcgattgatcgatgatgttcgacaagctttgtacgcttcgaaaatctgtagctacgctcaagggatgaacttgttgagggcaaagagtactgaaaagaattggaatttgaatttgggagaattggcaaggatttggaaaggcggttgcattatcagggccgttttcttggacaggattaaacaggcataccaaaggaactctaacttagctagcttggttgtcgaccctgaatttgccaaggagatggttcagaggcaggcagcctggagacgggttgtcggtttagccatttctgctgggattagtacacctggcatgtgcgccagtcttgcatattttgacacctacaggcgggcccggctaccagctaaccttgttcaagctcagagagactactttggggctcatacctatgagagggttgaccgctctggttcttaccacactgagtggtccaagctcgctcgtaagggtgcccaacactgagctacggtttacccttgtctcatgttttaccgtcttgtatttgttgtttcatttgtaatccggagctttggcctccgatggtgacgatgagttattaagcatagaagtcacacaattgtcttttaggtccattaggaaaggtagatgaagttgatgagaataagataatttctgatggaaaattctgaaaccaatacaatcaacattttcggaatatggttttctttcccttttcaagtcgatttcaatgtatgttgctctcaatcgtacaatttgtcttcaatggaccagttccttcatccttgtcat

SEQ ID NO: 1941 - DNA, 2052 bp, Solanum phureja
aaatacaacgttacacaccaaatctttaaatttcttttttcaaactttacattaaaaaattatttcttgatccaatcttgaaccataatggctgattatgaataaagcctacttttttgtcctgtcacccttactcttacctttataaactctcgtgaacaagtctccaatggggagttctacagcgacccatttcatattttcttgcaattttgagctgctagctatgttagagaaacatagatcttgatattatttagctaaagtttttatcttttttcaattttgataaatatggattctttatttttgcaaaagggagtgttggtgtggctttttttgtttagtttgagatttatttgtggaacaacagctcaaggtactgtgtttatagatgggaaaattgctattggaagaatagataagcattttatttgtgctactttggattggtggccacctgagaagtgtgattatggaacttgtgcttgggaccattcttctttcttgaatctggatcttaacaacattatttttctcaatgcaataaaagcgttctcaccattaaagattcgtttgggcggaactttgcaagacaaagtcatataccaaactgaagatcataaacagccctgtgtctcatttgttagaaacacaacagagatgtttggttttactccagggtgccttcccttgtcgagatgggatgaactcaatgcattctttaataaatctggggctagtataatttttggattaaatgctctttatggaagatcggtacaccctgacggtttatctgtcggagcttgggatccaagcaatgctgaatcgcttatacgttatactgtcaaaaagggatatgatatccatggttgggaactcgggaacgaattgagtggtagcggagttggaaccagagttgcagcagatcaatatgcatctgatactattgccttgtacaaaacagtgcaagatgcttacgagaattctgaaaccaaaccgttggtcctggcaccgggaggtttctttgatgaaggctggttcaaggaagtagtaaataaagccggggcatcatttgatgtggcaactcaccacatatataatcttggtccaggaagagatgaacaccttcttgaaaaaatcctcgatccatcttatctcgacggtgaagctgatacatttaataaacttcagaatatcctcaaggcatctggtagttcagtggttgcgtgggttggtgaggctggaggggcttataacagtggccgcaaccatgtcacaaatgcctttgcttttagcttctggtatttggaccagcttggtatgtcagctgcctatgataccaagacatactgtcgacagacattgattggtggaaactacggtttactcaatacgactacctttgtaccaaatccagattactacagtgctcttctttggcaccgattgatgggaaggaacgttttggcaacgagtttctcagggacaaagaaaatacgtgcatacgctcattgtgcaaagcaatctcaaggtatcacattactgttgatcaaccttgatggcaacaccaccattcatgccagagttgattttaacggtactatgttacatcgacgaaaacacagacatcatcataaccacagaaagagttcaatcaaactgcctagaagtagcaaaatagcatcaaacacaagagaagagtaccatttaacagcaaaagatggaaatttacaaagccagacaatgctgctaaatggaaatgcactgattgtagattcatctggaaatatacctacatttgagcctatatatgtcaattcaacagaggcgataaccgtcgcgccattctctattgtatttgtacacataccatatgtacttttgcctgcttgtagctgagtttgtgttatgtattaagtgatgtatggagccaaaaggggttccatttgattattgaaccaataatttacacacagaaaatgtaaagaggatacatgtattatatttttctctaagagaaaatataagcattttattcttgctata

SEQ ID NO: 1942 - DNA, 1990 bp, Solanum phureja
gactttcttgtccctctagcctcttccttaatcacttaaacaaagaatacaaaaaccatcaaacaaaacctatcttttctccccttatataaaccaaaaaaaaatcactacaattatttaattcttctatatttgattcctataccctttccttaataaatccattattaatattcctcttcaaattttttttccttaattccatatattcatcactagttacaaaaaaattattaatggattttttctacaaagccaaagctgtaaaattaaaaagtcatctagacaagtaccttgtagccgatgatgatcaagaaaatatccgacaaagccgaaacggctcatcaagaaaagcccggtggcttgttgagcttgtcgaagccgaaaacagccactttatacggcttaaaagtagctccggcaagtatctcacggcttccgacgagccgtttcttcttggcatgaccggaaaaaaggtatttcaaactttgcctgaaaagatgaaggacttgagaatcgaatgggaagtaataagggatggatttcaagtaaaattaaggggttttggaggaaaatatttacgtgcaaatggaggaatgccaccatggagaaataaagtgacacatgataatccttatagtggtagcacactaaattggattttgtggaatgttgaacctatcgatgtgcccgaaaatgaatcgttgactgattatttaactatggtttcaagtttttcatcagtttctgatgaacttttaagtttggatttaggatctccaacttctgtacattcaagtttttctttctcacctaggagtgctaagatttctttaccaaaaagatcagcaatggagctatttcacaaagcaaaagctgttcgtttacagagtcaccatgaaaagtacttaacagctgaagaagatgaagagtcagtaactcaagatcgtaacggagcttcaaaaaacgcgaaatggacagttgaatttgttgaaaaaaccgaaaacgttattcgattaaagagctgttatgggaaatatttaacagcttcgaatcagccatttcttctgggtatgactggtagaaaagttcttcaaactttgcctaatcgacttgattcttcgattgaatgggaacccattagagaaggacatcaagttaagctaaggacgagatatgggcagtttttgaggggaaatgggggtcttcctccatggagaaattccgttactcatgatattcctcatcgttcgaaaactcaagattgggttctttgggatgttcatgttgttgaaattttggcgcattcaacggcggagacggcggcggcgatggcggagacgacgttggtgggtggtaattctgattcgtttgcttctgaatcgagttctgctactactactggttcatcaaaatcttacagcttttccagacaagagtcaagtgattcattgattagttcgccgcctaagttggtagatggaaggcatatatattatcacattatggatgaatttggagaaattgacgaaggaacagagggactttgcataactttcaagggaaatagtgttgatgatctaaagaagagattggaggaggaaactgggctcgaggatattactgtgtgtactcggagtgctttgaatgggaagctttatcctctccgtttgcagcttcctccaaacaacgcaaatatgaacgttattattttgccatcttcatctaaagaggctagagatattgcataaccaagaatgccattgtagccgaactcgtggagcacttaacgcggattgttgcagtagatggatttttgtatcagtaaaagatgaacgtcgtgtaaatgtatatctccattgttttttaagcatttgtgcataaggttttgagtattgagagagatataatagttactagaatatctgctcttgatgttaatatcatcatacacttccacagaataattgaaaaaattgaaatctggtgg

SEQ ID NO: 1943 - DNA, 1988 bp, Capsicum annuum
atttcatcctacaccccattattcgtcttcaatattactactactttcatatttttattcatcattaacaacaaagtttattcatggattttttcaacaaagcaaaagctggaaaattaaaaagtcatctggataagtacttagtagctgatgatgatcaagaaaatattagacaaagtcgaaatggctcatcaagaaaagcacgctggatcgttgaagttgtcgatgacgacgtcgaaaacagacatttaattcgactgaaaagtgtctccggcaagcatttgacggcttctgatgaaccatttctacttggcatgaccggaagaaaggtacttcagactttgccagaaaaaataaaggacgaaagaattgagtgggaaccaataagagatggatttcaagtaaaattaaggggttttggaggaaaatatttacgtgcaaatggagggacacctccatggagaaataaagtaacacatgataatccttatactggtagcacacaaaattggattttgtggaacgttgaacctatcgacgtaccagaaaatgaatcgttgacggattatttaacgatggtttcgagtttttcatcggtttctgatgaactttcaagcttggatttgggttctccagtgtctgtacattcaagtttttctttctcaccaaggacgatgactaagacaacttgtataacaaaaacatcagcaatggagttattccacaaagcaaaagctgttcgtttacaaagccaccatgacaagtacttaacagctgaggaagacgaagaatccgtaacacaagatcgtaacggagcatcaaaaaatgcaaaatggacagtcgagttcgtgccaaaaactgataacgttattcgtttaaagagttgttatggaaaatatttaactgcatcaaatcagccatttcttcttggtatgactggtaggaaagtgcttcagacgattccagctagacttgattcatccatcgaatgggaacctattagggaagggcaacaagttaagttgagaacaagatatggacagtttttgagagggaatggtggacttcccccgtggagaaattctgttacgcatgatattcctcagaggactaagacacaagattgggtgctttgggatattcatgttgttgaaatattgcctcattcgaatggtgttcctgcagcgcctgcggtggagttggggaggagttcagattcgtttgcttctgaatctggttctcctactactgggtcctcaaaatctctcagcttttctagacaagagtcaagtgattctttggttaattcgccgcctaagatgggagacggaaggcttatatattatcacatgacggatgaatttggagaagttgaagagggaacagagggactttgcataactttcaagggaaatagtgttgaggatctaaggaagagattggaagaggaaacggggcttgaagatattactgtgtgtactaagagtcctctgaacgggaagctttatcctctccgcttgcagcttcctcccaacaatgcaaatatgaatgttattattttgccatcttcatcaaaagaggcattgtaggccaactcgaggaacactacacggattgatgcagtagatggatgtgtagctggatatttttcagagtaaaagatggatttcatcgtacatggatgtgtagctgaatttttgtatcagtaaaagatggagaccgtttaaaacgtatagctcctttattattatgcatttgtatataaggtttgtatataaggttttgagtgctgagaaagatgatagttactggaatatctactcttttgatgttgatatcatcatactattccacgaaataattgaaaattgaagggacctgctggctcgaacacctcttgttctaaaacgcacatgaattcgaatgctatattgaatgtgcggttattttggttcattagtcggcaggtctcttcaactgtttttttt

SEQ ID NO: 1944 - DNA, 938 bp, Solanum phureja
agacatatgcaaagaaacctctggaagggtatagtaaattccatttacttgtaaggtgctggaagtctctcaacattttccgaactttcaagattcttaaacattaccccctttttctctatataaattgcaccgatcgaacccccaaactcagtcaacaaattatcacagaaaatcaaacactaaagaagaagaagatcatcaagactacacagtatgaggtttgtcagtaaattaacattcctcatcatttcaattggttgcatttttcaggtatcatcactaggcgcagatgcctcatcacttctaccattaatcttagaccaaatgataggcagcaatcctgctaatacatttcttgatccattcaaagttttggaacaaataccattcggattagaaaactttctattgcgagagtcgactggaaagagacggcggaggggcacgtgataagcatagacgtaccaggattgaagaaagatgatataaagatagagattgaagaaaacagagtgttgagagtgagtggagagcggaagaaagaagaagagaaaaatgatgagcagaatcattggcattgtgttgaaaggagctacgggaagttttggagacagtttcgtttgccggagaatgctgatattgatacaatgaaagctaagcttgaaaatggggtgcttactatttcttttgctaaattgtctgctgatagaattaaaggtcctaaagttgtctctattgagagcaaacaagaaggaaaagagtcctctgttagagaagagctttgattttatgagttactctgttttctgttcatcatctgttcctctgctttaatttcatgttttctaatattttggtatgtgatatgtgataaaagaatgcttaaatgtaatcttattttgaaatattatataaatttttaatttgagattttc

SEQ ID NO: 1945 - DNA, 772 bp, Solanum tuberosum
gaagatcatcaaaactacatagtatagtatgagggtcatcagcaaattaacattgctcatcatttcaattggttgcattttccaggtatcatcactaggcgcagatgcctcatcacttctaccattaatcttagaccaaatgattggcagcaatcctgctaatacatttcttgatccattcaaagttttggaacaaataccattcggattagaaaacagagaggagactactctgccgctttctattgcgagagtagactggaaagagacggcggaggggcacgtgataagcatagacgtaccaggattgaagaaagatgatataaagatagagattgaagaaaacagagtgttgagagtgagcggagagcggaagaaagaagaagagaaaaatgatgagcagaatcattggcattgtgttgaaaggagctacgggaagttctggagacagttccgtttgccggagaatgctgatattgatacaatgaaagctaagcttgaaaatggggtgcttactatttcttttgctaaattgtctgctgatagaattaaaggtcctaaagttgtctctattgagagcaaacaagaaggaaaagagtcctctgttagagaagagctttgattttatgagttactctgttttctgttcatcatctgctcctctgctttaatttgatgttttctaatattttggtatgtgatatgtgataaaagatgcttaaatgtaatcttattttgaaatattatataaatttttaatttgagattttcg

SEQ ID NO: 1946 - DNA, 1607 bp, Solanum phureja
gaagaaagattgaatctttcttgattttggttatctggggttaagtttttttaagaaagattgtatctttcttgaatttgggtatctggggttaagtttttttggaaaaaagattcaatcttttattgttttggttgtgtggggtgtaatttggtgtaaatacataaattttggtgtaaaagaaaggtgttttttagagggatgaggatgggaggtgaaaatgtagtggggtatgagagggaggtagaagaagtggaagaggaaagggaaaaggaaatggtggtgactcatgggtctccccagcaacagatgaagttggtggtggtaggctatgctcttacatccaagaaaactaagagctttttgcagcccaagcttgtaggtctagctaggaataagggaatactgtttgttgctatagaccagagcagacccctttcagatcaaggtccttttgacattgtgctccacaagttgtcaggaagcaagtggagttgtattcttgaggattacaggaaaacacatccacatgtcgcggtccttgatcctccagatgccatacagcaggtatataatcgtcaatacatgcttgaagatgttgcagacttgaacttgtcagatagctatggcaaagtaggtgttcccaggcaattggttatagagaaagatccttcgtctatctcagatgcagtggataaagctggtctttcactacctcttgtggcaaagcctttggttgcaaggtcacatgagttgtctctggcctacgatatggcctctcttcagaagcttgaacccccacttgttctgcaggagtttatcaatcatggaggtgtactctttaaggtttttattgttggggaagccgttaaggttgtcaggcgtttcagtttacctgatgttagcaaacgcgagctgtccaacaatgctggggttttccatttccctagggtttcgtgtgttgcagcatctgcggaagaagctgatttagatcctagtgttggtgagcttcctccgcggccattacttgagaggcttgctagggaacttcgtcgtagactgggtctcaggctcttcaacttggatataattcgagagcacgggaccaaagaccgttattacgtaatagatatcaactatttccctggatacggtaaaatgccagaatacgagcacatatttacagattttctcctgagcctaatgaagcagaaataacaagaaaatccgtcctgtatataacttgtctatgctgttgaagagaagaagaggatataatccagtcagaacaagcaaggagaaaactcatacaagtgcagtgactaaaagctaatattagaagacgcgggcggagaagcacgaacgaagttccatcaaatgtctgaaatgacttctggctgaagcacacagttacactattctagcaacaaagccttgactccaatttttgtttgtttgtttaaaagttttggccattttattcctcctttgggttaacaagaggaatttgagttcctggtaaatgttttgctggaaagtaaatgtgtgtgtacataaagtaccaaactttttgctgccaccttgtatatatatatgtgcattgtgta

SEQ ID NO: 1947 - DNA, 1794 bp, Solanum phureja
ctgttacagctaataacacacatacacataccaacccacaaattttgctatcccttctctaaactttacgcgtggatacccaatttctctcttataaataaaccccctcactgtacaattcttctttctctcttttccattcttgcaccttcttttgttgccattcaagaattactgaaaattttatctttttttctattggagtttgtgggggttcaaagatcttaactttaactatttgggtttcttgggattaaagatttgaactttttttcattttatattttgggtaatcttggttttcttaaattggttggtgtggaaagagggagagggagatttgtggggtgaaaatatctgtaaaagggaatgaggatgaggggtgagatagtggggtacaaagaagaggaagattacaagacagaagaggaagaagaagagagggaaatggttggtggagggttaccagagtctaagtttgttgtggtgggttatgctcttacttctaagaaagttaagagctttttgcagcctaagcttgaaggtctagctaggagtaagggaatattatttgttgctattgatcagagcaaatccctttcagatcaaggtccttttgacattgtgctccataagttgtcaggaaccaagtggcggcgtattcttgaggaatataggctaacgcatccagatgtcacagttcttgaccctccggatgccatacagcaggtatacaaccgccaatacatgcttgaagatgttgcggacctgaatttgtcggacacctatgggaaagttggtgttcccaggcaactggttattgagaaagattcttcatctattccagatgcagtaggtaaagctgatctgagactacctattgttgcaaagcctttggctgccaagtcccatgagttgtctctagcctatgacaaattctctcttcagatgctagaacccccacttgtgctacaggaatttatcaaccatggaggaattctgtttaaagtatacattgttggggaagcagttaaggttgttagacgattcagtttacctgatattagcaagcgtgagctggcaaaaaaccctggggtttttcgattcccaagagtttcttgtgctgctgcatctgcagatgaagcagatttagacccttctgtcggggagcttcctccgcggccattacttgagaagcttgctaaggaacttcgacgtagactgggtctccgtctcttcaacttggatataattagagagcttggaaccaaagatcgatattatgtcatagatattaattactttcctggttatgggaaaatgccagagtatgagcacatattcactgattttctcctaagccttgtgaagcagaaacaatgagaaattgcgaaaatctgctcctcgttaactattactttaaatggaactactgggaaggaatcctccccatagcacgaggatgatagaatcttgcaaagatttctgtggcagtttctataagctgatcggagacactggtggttaagtgcagaagagctctctcgataatggttgctactttggaagcttgcccccccttagtacacaattccaatttactgagcttggggtctctttcatttcctgtctttggataattgatagatttagcggattcaagaaagcttgagcccttggtaaatgttggctggaggggcaaataattgcttctaccttgtaaatatgccatttacagtaggaacataaaatgtacattgttggctcttctaatctactggatagcttgttttt

SEQ ID NO: 1948 - DNA, 1832 bp, Solanum lycopersicum
ctgttacagctaataacacacataaacatatcaacccacaaattttgctatcccttctctaaactttacgcgtggatacccagtttctctcttataaataaaccccctcactgtacaactcttctttctctcttttccattcttgcaacttcttttgtagccattcaagaaatagtgaaaatcataaaagattttatctttttgtggactggagtttgtgggggggtcaaagatcttaacttgtaagtatttgggtttcttgggattaaagatttgaactttttttcattttatattttgggtaaacttggttttcttgaattggttggtgtggaaagagggagaggagatttgtggggtgaaaatatctgttaaagggaaggaggatgagggatgagatagtggggtacaaagaagaggaaaattacaagaaagaagaagagagggaaatggttggtggagggttagtagagtctaagaaatttgttgtggtgggttatgctcttacttctaagaaagttaagagctttttgcagcctaagcttgaaggtctagctaggagtaaggggatattatttgttgctattgatcagagcaaacccctttcagatcaaggtccttttgacattgtgctccataagttgtcaggaagcaagtggcggcgtattcttgaggaatataggctaacacatccagatgtgacagttcttgaccctccggaggccatacaacacatatacaaccgccaatacatgcttgaagatgttgcggacctgaatttgtcggacacctatggggaagttggtgttcccaggcaactggttattgagaaagattcttcatctattccagatgcagtaggtaaagctgagctgagactacctattgttgcaaagcctttggctgccaagtcccatgagttgtctctagcctatgacaaattctctcttcagatgctagaacccccacttgtgctacaggaatttatcaaccacggaggaattctgtttaaagtatacattgttggggaagcagttaaggttgttagacgattcagtttacctgatattagcaagcgtgagctgtcaacaaaccctggggtttttagattcccaagagtttcttgtgctgctgcatctgcagatgaagcagatttagacccttgtgtcggggagcttcctccgcggccattacttgaaaagcttgctaaggaacttcgacgtagactgggtctccatctcttcaacttggatataattagagagcttggaaccaaagaccgatattatgtcatagatattaattactttcctggttatgggaaaatgccagagtatgagcacatattcactgattttctcctgagccttgtgaagcagaaacaatgagaaatttgtgaaaatctgctcctcgttaactattacttcaaacggaactgctgggaaggaatctcctgcgcaatttctgtaagctgatcggagacagtggtggaaagtgcagaagagctctctcgataacggttgctactttggaagcttttgccccttttggtacacgattccaattaagtgagcttggggtcttttttgtttcccgtctttgaataattgatagattcaagaaaagctttgaggccttggtaaatgttgtctggagggcaaataattgggtttcatactttgtaaatatgccatttacagtaggaacataaaatgtacattgttggctcgtctaatctactggatagtttggttttgatcggaatggttgttgcgacatagttcaaaggattccgatgttgaatgagcgagtatattgccttaatgcaaata

SEQ ID NO: 1949 - DNA, 1642 bp, Amsonia hubrichtii
taaccgactccgagcgtctgtatctccgatactctgatttcgccattttgatttcgtgtaaaattagtctatagttttcgtacgtattcttaatcgtaataaggatctcttcatattaagattgttttttaattgaaaaaaagattcgtcgatttgcgaattttggaactagggttgtttttccgaattttcgaggttgtggttgggtgtcgtatagaattttgtgaatgaaaatgagggatgacgttgggtataagatggttgaggaggatgggatgaggaagagtgaggaggaggtggtagcggcggcgaagtattcggttgcgggggggttcactcagccgatgaaggtagttgttgtagggtatgctcttacgtcgaagaagaccaagagctttttgcagcccaagcttgaaggtctagctaggaataaggggatcttatttgttgctattgaccacacaagacccctgtccgatcagggtccttttgatattgttttgcataagttatcaggaaaggagtgggggcatattcttgaggattataggcaaacacatccagaggtcactgtccttgatcctccagatgctatacaacatgtgtacaatcgtcaatccatgcttcaagacgtggcggacttgaacttgtctgatgcttatggaaaagttggtgttccaaagcaactagtgataaagaaagatccatcttctattcctgatgcagttggcaaagctgggctgaggctacctcttgttgcaaaaccattggttgcgaaatcacatgagttatcgctagcttatgaccaatactcactcaagaagctagaacccccacttgttctgcaagagtttattaatcatggtggtgtcctctttaaggtttatatagttggggaagccattaaagttgtcaggcgcttctctttgcctgatgtcagtaagcgtgagttgtcagaaagtgctggtgtattccgctttcctagggtttcttgtgctgctgcatctgcagatgaagcagatctagatccaaatgttgcagagcttcctccacgtccattactggagagactggcaagggagctgcgtcgtaggctgggtcttcgtctcttcaatttagatataatccgagagcatggaacaaaagacaattactatgtcatagacatcaactacttccctggatatgggaaaatgccagaatatgagcacatatttacagattttcttctgagtcttgtgagaagcaagtagaaagcaagatgaggaagagttcataaaaaaagatgctgataagttgctttttggtacgtggaaatgttgtatcaatgagccagtacaagcaggaagaaattgtgttgcaacaattgcaacaaatgctgagcgttggcggcagttcgagtgcaaaatgagaggaagttctaaattgttttatcctgacactgctcacctgcagagaggataggactactcaagatgcaagcatcttgtacaatcaagagttgacaagcttctttcttgtttctaatttcgttttcctagtcattcttttcttcttttttctggttcaattctcccgtttttatttggattctgataaaaggtgaacgtagcaaggctgaattatcgtgtacgtctaatat

SEQ ID NO: 1950 - DNA, 3484 bp, Solanum phureja
aaaaatggggttgattgattctcaatctttatcatctccagttaaaattacagttacttcatctccaactggtggctgccatggcttaactagtccgattcggagacattcgttatcgacgaatcctaattcacctcttagtggaaaagggttgaggggttcttctggtggaaggtatctttctatgtctaaagagagtactgatgaatttgtagcttatacagttcatattccaccaaccccagataatcgtaccgtggcggattctcagaatagtcctgttggggttgggagtagtagaaaaagctatgggtatggaaatccgagtgatgggtatattaaagatacgatttttactgggggttttaattctgcaactaaagcacatgttagaaaaagctctgaggatgaacctatggtgatgaaatgtaaaacaatgtgtcaaatggatggttgtgatgagaagaaagctgaggagaagtgtgaatgtggatatgtgatttgtagagagtgttatttggattgtgtggggtttgatggagggcattgtcctggttgtaaagagtcttataaggggattagtgatgatgaaagtgatgaaccgagatcggaagctaaggatcaagcgaatccgttaccttcgaggggaagaggagggagaatggagaagaatttttcacttgtgcagtcattcaagaatccaaatcaagattttgatcatacaagatggctttttgagactaaagggacttatggttatgggaatgctttgtggccttctgatggtcatgaatttgggagaggtcttgatagatctgaaaatcctcctgattttagtgacagaagaaataggcctttgacaaggaaagttggaatctcagctgcaataatcagtccatataggttgctcatggttcttcgtcttggtgcgttggcttgtttcttgacatggaggatttctcatccaaatcatgaagcactgtggttatggataatgtctgtagtgtgtgaggtttggtttgcaatatcttggcttcttgatcagttgccaaagctctgccctgttagaagaatcactgacctctctgtattgaaagaaaggtttgaaagttcaggaccaaaccttcgaaacccgaagggattgtctgatttgccaggcattgatgtgtttgtttcaactgctgatgcagaaaaagaaccacctcttgtcactgcaaacacaatcctttccattcttgctgttgattatcctgttgaaaaggtggcatgttatttatcagatgatggaggttccttagtgacatttgaggctcttgcagaagctgctagctttgcaagaatatgggttcccttctgtaaaaaacataagatagaacccagaaatcctgagtcatactttgggcaaaagcgtgatccactgaaaaacaaagtgaaacttgactttgttagggacagaagaagggtgaagagggaatatgatgaattcaaggtgaggataaatgccttgcctgagtcaataaggcgacgatcagatgcttacaacacccaacaggagttgagggctaaaagaaaacaggtggaacttggagaggatctctctgaacccatcaaggtccctaaagctacttggatgtctgatggaactcactggcatggtacttggtcatcagctgaggaaggacattcaagaggtgatcatgagggtattatacagatcatgttggttcctccaaatgcagagccactttatgggaatgaagctgacgagaagaacatgattgacacaacagatgttgatgtcagactgccaatgctggtttatgtttccagagaaaagagacctggttttgatcacaacaagaaagctggagcgatgaatgctttagttcgagccagtgcaataatgtcaaatggtgcattcattctcaatcttgattgtgaccattacatctacaactcattggctatgagagagggaatgtgctttatgcttgacaaagggggtgacaggatctgttatgttcagtttcctcagaggtttgagggtgttgatccaaatgatcgatatgcaaaccacaatacagttttctttgatgttggcatgagagccctggatggtttgcagggtccaatgtatgtaggaacaggatgcattttccgaagaattgctctttatggttttagtccaccaagagcaactgaacatcgtggatggtttggtagcaggaagactcgaaagcttttgaggaaacctaatatacaaaaggatcaagaggatgatgagatgtttttgccaatgattgggaataaggatgatgaggaggaagtaagcagatctttgcttacaaaacagtttggaaactccattccattggtggactctattgctgtagctgaatttggagggaggctgctccatgagttgagaggcaaaggttgccaaggaaggccagcaggttcacttgctgtacatcgcgagccattggatgcttcagcacttgctgaggctgtaggtgtcataagttgctattatgaggacaaaactgaatggggcaacagagtaggatggatatatggttcgatcacggaagatgtcgtgacaggttacaggatgcacaatagaggctggagatcaatttactgtgtcacaaaaagagatgcatttcgagggacagcaccaatcaatctaactgataggctcatccaagttctcagatgggcaacaggttcagtcgaaatcttcttctctcgcaacaatgcactatttgcaagcccaagaatgaagttccttcagagagtggcatatttcaacgtggggatgtatccgtttacttccattttcctccttgtctattgtctcttgcctgcactttcactcttctcaggaaaattcattgtgcaatccctcaatgtcaccttcttggtgttcttgctagcaatcacaatcaccctgtgcatgcttgctctccttgaaatcaaatggtcaggaatcacccttcatgattggtggaggaatgagcaattctggttaattggtggaactagtgctcatccagctgctgtgatacaaggactattgaaagttatagcaggagttgacatctcattcacattgacatcaaaatcaggtgcacctgctgatggagaagacgaatttgcagagctatacgagttccgttggacagtcctaatgattccaccaatcacaatcatactgatcaacatgattgcaattgcagtaggcacattcaggacagtatatagtcctttcccacaatggagcaagcttcttggaggtgtattcttcagtttttgggtgttatctcatctctatccattcgcgaaaggactaatggggaaaaggggaaaggttcccaccattgtcttcttatggtctgctctcatctgcattgtcatctcattgctcgcggtttacgtatatcctccttcaggacaccaagatttctcaagttttcagtttcct

SEQ ID NO: 1951 - DNA, 899 bp, Solanum phureja
cactaattaacttaattatcattcattacatatttttttattttttgtacctctagtgttgtgtacctatggctagtgaacctgaaaaggttgttcccccagtagaagctccagtggcggagccagaaaaggcggctccgccaccgagtacaactcggcccaccgactactttgcggtggccgatgtggtgttaaggttgttagtgtttgcttcggcgcttgtttctgtggtggtcatgtcaactagtaaggaaactgaaatgctcccaaaccctcgtcctgctaagttcactcaatcaccagcactcatctattttgtagtagcactctctgtggctggtttcttcagcctaattactacactaggctcattgtactccctcatcaagcctggttgctgtgcaaagatcatttcccacttcattgtcattgatgtgcttttgctaggaatagtggcatcagcaaccggagcagcaggatcggtgacttacataggactaaaaggcaacacttatgtggggtggcgagagatttgcacactgtatggcaagttctgcagatatcttggagcttctataggagtctcattgttcgcgagtgttatgcttgtgctgcttgttctcctctctgtatactccctttctaagaagataccaaagtgactagacagctattgaaaagtgaattcttgatgtatagcagaacatcccttggtaaatgtcagtatgtgaaagtgtgtttgtatgtattgttcaaatttgggttctctgtatgtttggccattttcttgtgcagttggtgaaagtagacattgcaccagttcttgtatatgaattcattcatgtaattgtattgatgttgaacagaaagttcccgacttacattctctatcttcgatc

SEQ ID NO: 1952 - DNA, 843 bp, Solanum tuberosum
aattttttgtacctctagtgttgtgtacctatggctagtgaacctgaaaaggttgttcccccagtagaagctccggaggcggagccagaaaaggcggctccgccaccgagtacgactcggcccaccgactattttgcggtggccgatgtggtgttaaggttgttagtgtttgcttcggcgcttgtgtctgtggtggtcatgtcaactagtaaggaaactgaaatgctcccataccctcgtcctgctaagttcactcaatcaccagcactcatctattttgtagcagcactctctgtggctggtttcttcagcctaattactacactaggctcattgtactccctcatcaagcctggttgctgtgcaaagatcatttcccacttcattgtcattgatgtgcttttgctaggaatagtggcatcagcaaccggagcagcaggatcggtgacttacataggactaaaaggcaacacttatgtggggtggcgagagatttgcacactgtatggcaagttctgcagatatcttggagcttctataggagtctcattgttcgcgagtgttatgcttgtgctgcttgttctcctctctgtatactccctttctaagaagataccaaagtgactagacagctattgaaaagtgaattcttgatgtatagcagaacatcccttggtaaatgtcagtatgtgaaagtgtgtttgtatgtattgttcaaatttgggttctctgtatgtttggccattttcttgtgcagttggtgaaagtagacattgcaccagttcttgtatttgaattcattcatgtaattgtattgatgttgaacagaaagttcccgactta

SEQ ID NO: 1953 - DNA, 839 bp, Solanum melongena
acacacacttgtagtcattaattaacttaattatcattgacagtacgactatggctagtgaacccgaaaaggctattccgccagcagaagcttcagtggcagagccagaaaaagtgactctgccaccaagtactactcggccgaccgactactttgcggtggccgatgtggtgttaagatttctagtgtttgcgtcggcacttgtttctgttgtggtcatgtcaactagtaaggaaactgaaatggtcccaacacctcgttctgctaagttcaattattcaccagcactcatctattttgtagcagctctctctgtggctggtttcttcagcttaattactactctaggctcattgtactccgtcattaagcctggttgctatgcaaaaatcatttcctacttcattgtcattgatgtacttttgctaggaatagtggcatcagcaactggagcagcagcatcggtgatttacataggactaaaaggcaacactcatgtggggtggataaagatttgcacattctatggcaagttctgcagataccttggagcttctgcaggagtctcattattcgcaaccattatactcgtgctacttgttctcctctctgtatactccctttctaagaagatccctaagtgactagacagctcggaaaagtgaattctagatgtatagcagaacagtccttggtaaatctcagtgtgtaatttatatgttttgttcaaatttaggttctctgtatgtttggccattttattgttgatttgcaccagttcttgtatatgaattcagtcatgtactcgtattgatgttaaacagaaagttccccacacg

SEQ ID NO: 1954 - DNA, 714 bp, Capsicum annuum
gcacgagggagacactaaccacattaattatcattcaatacataattttggttcatctagtgtcgtgcacctatggctactgaacccgaaaaggttgctccaccaacagaagctccagtggcagagccagaaaaagcggctcctccaccaacagctcggcccaccgactactttgaggtggctgatgtggtgttaaggttgttagtgtttgcttcggcactcgtttctgtggtgctcatgtcaactagtaagcaaaccgaaatagtcccaatacctattccaccttaccaagcacctcgctctgctaagttcaatcattcaccagctctaatctattttgtagcagcacactctgtggctggtttcttcagcataattactacactaggctcattgtattccctcattaagcctggttgctctgcaaagatcatttcccatttcattgtcattgatgtacttttgctgggaatagtggcatcagcaaccggagcagcagcatcagtgacttacataggactaaaaggcaacactcattcggggtggggaaaaatttgcagtttgtatgacaagttctgcagataccttggagcttctgtaggagtctcattgttcgcaaccattatgcttgttcttcttgttctcctctctgtgtattccctttctaagaagatcccaaagtgacaagacaactatgggaaacttgaattctgc

SEQ ID NO: 1955 - DNA, 891 bp, Nicotiana tabacum
  misc_feature (433)..(433): n is a, c, g, or t
cacttcttagagtcactaacttaattatcattcaaaacaatttggcacctctagtagaactgtagtgcacccatggctactgaacccgaaaaggttgttgcacctgcagaggcatcggtggcagagccagaaaaggcggctctgccaccgacgacggctcccaccgactactttgcggtggcggatgtggtgttgaggttgttagtatttgcttcggcattagtttctgtggtggtcatgtcaactagtaagcaaacggaaatggtcccaacaccatttccaccttaccgagctcctctccctgctaagttcaatcattcaccagcacttatctattttatagcagcactctctgtggctggttttttcagcatacttactacacttggctccttgtactccctcactaagcctggttgctctgcaaagatcntttcccatttcattatcattgatgttattttgctaggtatagttgcatcagcaaccggagcagcagcagcagtggcatacataggactaaaaggcaacactcatgtggggtggggaaaagtttgcaacatgtatggcaagttctgcagataccttggagcttccattggagtctcattgtttgcgaccgttatgcttctacttcttgttcttctctctgtatactccctttctaagaagatcccaaagtaaacaagctagctatgaaaagtcaattcttgatgtatagtagaaaacgccttgttaaatgtcagcatgtgagtctgtaattaagtactgttcaagtttctgttctttgtgtatgtttgtctcttttctcgtacagcctgtgtttatctagacattgcaccagtgtttgtatatgaattcaatcatctctacctgttttgggattaccgt

SEQ ID NO: 1956 - DNA, 4454 bp, Solanum phureja
gtgactgttttggttggggagactggatccggaaagagtacacaactagtgcaattccttgctgattcaggaataactggcactggttctatagtttgcactcagcctcgaaaacttgctgccaattctttagcaagtagagttagagaggaaagccaggagtgctatgatgattgctcgatctcctgtaatccaccacattcatcctgtcagcagtttgattcaaaggtgatttttatgacagatcactgcctattacagcactatatgggcgacaagactttgtccaacatttcatgcatcatagtcgatgaggcacatgaaagaagccttaacaccgatcttcttttagcgttgattaagaaactacttcatcagaggtttgatctgaggcttattattatgtctgccacagttgatgcaaaccagcttgcaggctacttctttggttgtggaactttccatgtggcgggtaggacttttccggttgatataaagtatgttccctgtgaagatgatgcccatcatgctgtaggtgcaattgcctcttatgtccacgatgttatcaagatggtgactgagatcgatagaactgagggagcgggagctattttagccttcttgacatctcagagtgaagttgagtgggcttgtgagcagtttaaagcaccactggccattgctttacctttgcatggcaagttatcctatgatgaccaaaaccgagtgtttctctcctatccagggaagagaaaggttatattcaccaccaatctagctgagacatcactgacaatccctggtgtcaaatatgttgttgattctggcatggttaaagaaagcaggtttgaacctggctctggcatgaatgttctcaggatatgcagtgtgagccaaagttctgctaaccaaagagccggtcgtgcagggagaactgaacctggaaagtgtttcaggctgtactctcaaagtgattttgaggatatgcctcgtcatcaggaacctgaaattcggaaagttcatcttggtgttgcagtgctgaggattcttgctttaggtatcaagaatgtgcaggattttgattttgttgatgcaccgaaacccaaagctattgagatggccacccgaaatctggttcaactaggagctgttacacaaagagatgatgcttcatatgaattaactgcagaaggactaaaactggtgaagttgggtattgaacctcggttgggaaaaatgatcctcagttgctttgatcaacgtttgggtaaagaaggtgttgcgcttgctgccgttatggcaaattccagcagcattttctgtagggttggttctgaaggagacaaactaaaatctgattgccgcaaggtgcaattttgccatccaagtggggacctctttactttactatctgtttacagggaatgggagattgtgcctagggaaaagaagaatagctggtgttgggataatagtatcaatgccaaatccatgagaagatgccatgagacagtgctggaaatggaagcctgccttcagaatgagctaaatatgatcttagccagttactggcgctggcatcctcaagtgcataacaagtgtgacgaagtattgcaaagtataattctttcttcacttgcggaaaatgttgctgtgtactcaggttatgatcagcttggttatgaggttgcgctatctgggaagtgtgtccaactacatccttcctgttcgcttttgaatttcggccaacgaccacgttgggtagtctttggggatgtccttgcatcagctaacgagtatctggtctgtgttactgcatttgagtttagttctcttgttagcctcactcctgctcctttgtttgattttctgaagatggatgcactaaagttagaaaagaaggttttgacaggctttggagtcgtgctactcaaaagattttgtggaaaatctaacagtagcattaacaatcttgtctcgcgcattagaacttcttataaggatgaaaggataggcattcaagttaatgttgatgagaatgaggttcttttatatgcttcttcgagagacatggagagtgttacattccaggtaaatgatgctctagagtatgaaagtaagctgttgcggaacgaatgcttagagaaatgtctattcaatggaggatcagcagcttcggcctctgttgctctcttcggagctggtgctgtgataaagcatttggagcttgagaagagatgtttgactgtggacatatttccgtcaaatggaaatgccattgatgacaaggaattgctgatgtgtttggagagagccacatctggtaatatttgtatggtgcacaagtactctggaatgggccaggacaaagaggagaacaagtggggcacagtaaaatttcttacccctgatgctgcagaacaggctacattcttaaataaagtggaatttaatggtggctttctgaaaatggttccatccaggagcatacacagtagtgatcaaaagatgtttcgctcagttctcaaagctaaagtttcttggcctcgtaggtacagtaaaggagtaggctttctgagatgcgaccctatggatgttcctttaattttagatgacatctctgatctcatgattggtggaaatgtcatccgttgtgaggcaagcgataagaaccctgacaacatagtcattgctagacttgatagggacattgctgagacagagatacttgaggtgttaagggcaacaacaaataggagaattctggatttcttcttggtgagaggagattctgtagaaaatcctcccatagctacttgtgaagaagcacttcggaaagaaatatctcccttcatgcctaaaaaggttccgtttgttaactctgttcgtgtccaggtcttccagccgaaactaactgagtatttcgcaaaagcagctataatatttgatggatctcttcatcttgaagcagccaaggccttggagcaaatcgacggcatggttttgcctggatgccttccctggcagaaaataagatgtgagcgactgtttcacagctctgtttcctgtcctgcagcagtttatcatgtcatcaggaaccagttggattctttacttgctagcctccgccgaagaaaggttgggaaatgcgagctacagagaaatgataacggttcctgtacagttaggatatctgccactgccaccaaagttgtggcagatttgagaagaccactggagcaacttatgaaaggcaagattgtagatcatgtggatattactccgaaggttgttcaacttctgttctctcgagaaggaagcaacattatgaggacaattcaacgggagacaggaacctatatttattttgacaagcatagcttgcttgttagtatctttggttctttagacaatgttgatagggctcaacagagatttattggttcccttctggcgctacatgaaaataaacaacttgaggtgcatcttcgtggaggacttttacctcatgacctgatgaaaagagttgttcagacatttggaccagaccttagtgcacttaaagaaaaggtgcctggggcagagttctctctgaacacaaagcgccattgcatctatatcaatggtactaaagatatgaagcaaagcgttgaggacataatctctgaaatcgctcaaagaagttttccaattcaaacgacaggagatgatgctgactgtcctgtttgcttgtgtgaactggaggatccttataaacttgaagcttgctgccatgtattctgtcggacatgcttgctagagcagtgtgagtctgcaatcaaaagccgggaaggtttccccatgtgctgtcttcatcaaggttgtgcggaacccatcttgcttgctgatttgaagtctctattgtcaattgagaagttggaagaacttttcagggcttctttgggggcttttgtggcagccaatggtagtacctaccgcttttgcccctcaccagattgcccttcagtttatcgcattgcagatcccgatatggttggtgcaccttttgcctgtggtgcatgctatgtggagacatgtacgagttgccacctggagtatcatccttacctctcctgtgagacgtaccagaaggttaaagacgacccagattgctctctagaggaatggtccaaggggaaagacaatgtaaagaaatgtcccgtttgcagatttacaattgagaaggtggatggctgcaatcatatcgagtgtaagtgtgggaaacatgtttgctgggtttgcttgctcttctttgacaccagtgataattgctatgatcatttgaggtctgttcaccggtccattacatgagaaatagggaaccatagtttatgtaagcgtgttcatgtaaaaaaattgcaccgagtatgtaaccaagagctttttatgtctatacatatctatgtttgtgtctt

SEQ ID NO: 1957 - DNA, 640 bp, Brassica juncea
gggagcgagaatgtcagctacagcagccggaagttacgctatggctctcgcagatgttgcgaagaggaacgatactcttgaacttacgagtgcagacgtagaaaagctagagaaggtcttctcagatccacaggtactcaatttcttcgccaatcccaccgtcgaggtcgagaagaagcgtctcgtgatcgacgatatcgtgaaatcttcgtctctccagagccacacctcgaatttcctcaacatcttggtcgatgcgaatcggatcaacatagtgagggacatcgtaaaggagttcgagatggtgtacaacaagataactgatacgcaattggcggaggttagatcggtggtgaaactggagccgccgcaaactagctcagatcgccaacaggttcagaagttaacgggagcgaagaacgtgagggttaagacgattcttgatcccagccttgtcgctgggttcacgattcggtatggcgattccgggtcgaagcttattgatatgagtgtgaagaagcagcttgaggatatcgctgctcagctagaactcggcgagattcagttagctgcttgaagaaaatgtattgagaactgtttcttcttcttttttttcttcttctgtgcaagttaattcttt

SEQ ID NO: 1958 - DNA, 1379 bp, Arabidopsis lyrata
acacgcacatagcagagcaaatgaagaagacgaagcacactgagaattcaccggtcagagatcacgactaagtactttagttttccgattacctcgagcaaccttaaatggagcttccgctactctcgtatgctagctccgcgtcgttttcgcggacaggcttttactcttcttcttcctcaactagtatctgtgagttcccggagagaagacggagcttcagaatgagattcaatggtggagaaaggtcacgaagcgttatagcttccgctgaacggagcagcgaagggatcgagaagacagacggcggaggaggatttgctggtactgccatggaggtgacaacacttgatcgtggattcgctaactccaccaccgttgattttccgatctgggacaaaattggcgccgtcgttagacttacttacggaatcggaatatatggagcaatggctgtagctggaagattcatatggttcggtgactggaattgattcatctggtggatttgatccttctcttgacgcacttctcgccggacttggctatgcaacaccaccaatcatggctcttctcttcatactcgatgatgaagttgtgaagctatcaccgcacgctcgggccattagagatgtggaagatgaggagctcagaagctttttcttcggaatgtccccatggcagtttatactcattgtcgcggctagttcaataggagaagagctcttttaccgtgttgctgtacagggtgctctgtctgatatattcttgaaaggaacacagttgatgacagattctagaggcatggcatctctgaccggagtgtttcctccatttgtcccatttgctcaagcctttgcagctgtaatcactgccactctcacaggctctctctactttcttgctgcttctccaaaggacccgacatacattgttgccccggttttaaggtcacgccgagatgattttaagaagcttttgtcagcttggtacgagaagagacagatgaagaagatttactctcccctactcgaaggactcttagccctctatctcggtattgaatgggttcagaccgataatattttagcaccgatgatgacgcatggtatatactcagcagtcatattaggacatgggctgtggaaaattcatgatcaccggagaagattacgccggagaatcgaacgcattagatcggaggctaccgataagttgatttaaatcaactctagatggttaattggttgggggtggatttgtgtgtattttttggtatggggtcgtatagtaattagggaaattagctaggacctcttccaattaattagagagctgtatacagtagaaaattacatatatacgtacatatataatat

SEQ ID NO: 1959 - DNA, 692 bp, Brassica oleracea
cggccagttccataggagaagagctcttttaccgtgttgctgtacagggtgctctgtctgatatattcttgaaaggaacacaactgatgacagattctagaggcatggcatctctgaccggaatcttgcctccatttgtcccatttgctcaagcatttgcagccgtgatcaccgccactctcacaggctccctttactttcttgctgcttctccaaaagacccgacatacattgttgccccggttctaaggtcacgccgcgatgattttaagaagcttttgtctgcatggtacgagaagagacagatgaagaagatttactctcccctcctggaaggagtcttagcgttctacctcggtattgaatgggttcagacggacaatatcttagcaccgatgatgacacatggtatatactcgacggtaatattagggcatgggctgtggaaaatacatgatcaccgtagaaggttacgtcggaggatcgaacggcttagatcggagaccgctgatgaatgaacggttttaaaatcatctatagattgtaactggttgggggtggatttgtgtgtaattttttgggtatgggggatgggggggtcgtatggtagtaataactagagaaattaggtctccataaaatttagaacagctgcatatatatacataacataaacttgtatttgttcctac

SEQ ID NO: 1960 - DNA, 974 bp, Cleome spinosa
ctgtagatttgcccgtatgggacaaaatcggcgccatcgttcgcctcgcctacggaatcggaatatatggagcaatggctctaacggggaggttcttatgttcgatgaccggaatcgactcttccggcggttttgatccttctctagacgcggttctctctggacttggctacgcagcaccacctatcatggccctactgttcatactcgatgatgaagttgtgaaattgtcgcctcatgctcgggccatcagagatgtggaagacgaggaactgaggagcttcttctgcgggatgtcgccatggcagtttatgttcattgttgcggccagttcagtaggagaagagctcttctaccgtgccgctgtccagggcgctctggctgatatgttcttgagaggaacacagatgatatcagattctcgaggcattgcatctctgactggagtcctgcctccattcgtcccatttgctcaagcgtttgctgctgtaatcaccgccactcttacgggatctctgtactacatcgccgcttcccccaaagacccaacatacattgtggcacctgtgttaagatctcggtctggtcgtggcgagttgaagaaacttttgtcagcttggtacgagaagagacagatgaagaagatttactctcccctcctcgaaggtctcctcggcctctacctcggcctcgaatggattcagacggataatattttagcaccgatcatgacgcacggcatatactcagcagtcatattgggtcacggcctctggaaaattcatgataaccggagaaggctgcgtcggagaatccaacggttaaaatccgacataacctaaaccctagggtcgatttgtaattttcgtttttgtagggccatacacttaggaagtgaggtgggagacaagagagtaatctctctcccgtaaatcccgacacttacaatgttttatagaattgtgttaagtctt

SEQ ID NO: 1961 - DNA, 3443 bp, Eutrema parvulum
atgtgacaaagcaaaaaagaaaactttagtcaatgagtcgaatagtcaatagtcaatacaacaatccaaattggcttttgttttgttttatctaatctatttaattaagcccaaaatatttttcgtcacaccaaaatctcaaggaagaagcaaatattaaatatggacgccaaagctttaattttcgcagttctcttcgttgttctctctctcagattcttgatcgaaagaatcaagcgaaagcccaatctccctccgagtccggcatggtcgttaccggtgctcggtcacctccgcctactcagaccgccgatccatcgcactttcctttccatctctcaatctctaggcgatgctccgatcttctccctccgctttggaaaacgacttgttttcgtgaacacatcacactcgattgccgaggagtgcttcaccaagaacgacgtcgttctcgctaaccgaccaaacttcatcctcgccaagcacgtcgcgtacgattacacaaccatgatcgcagcttcgtacggagaccactggcggaacctccgccgcatcggctccgtcgaaatattctcgaatcaccggctcaatagctttttgtctatccgtcaggacgagatccgacggcttatattacgtctctccaggaacttttcacaggaatttgcaaaggtggagatgaaatcaatgttatctgacctaacattcaacaacatcatcagaatggtggccggaaaacgttactacggagacggtgcagaggacgatccggaggctaaacgagtcaggcagcttattgcggatgtggtggctctagctggtgctggaaacgctgttgattatttaccagtcttgggttgggtttcaaattacgagacacgggtcaagaagttggcgagtaggctggacgagttcttgcagggattggtcgatgagaaacgagaacctaaggagaagggcaacacgatgatcgatcacttgctttctctgcaagaatcgcaaccggattacttcacagatcgcatcatcaaaggaaacatgcttgccctgatactagccgggactgatacatcagcggtcacgttggaatgggcattgtctaacctattgaaccatcctgaagtattgaacaaggcgagagacgaaatcgatagaaaggtcggtttgaacaggcttttagaggaatcagacatctcaaatctgccatatctccaaaacattgtgtctgaaacgttacgcatgtaccctgcggtccccatgctgcttcctcacgtcgcctcggaagattgtaaagtagcgggatacgatatgcctcgtggctcgatactattgaccaatgcgtgggctatacacagagatcctcagctatgggatgatcccacgagcttcaagccagagaggttcgagaaagaaggagaagctaataagctaatgtcgtttgggttaggaagaagggcgtgtcctggttccggactggctcatcggctgataaacctgactcttggatcattgattcagtgtttggaatgggagaggattggagaagaagaagtggatatgagtgaaagcaaaggaggcacactgcctaaagccaagcctctggaagccatgtgcagagcacgtgcctctgttggtaaactcttccacgaggccgcttgattttaggactttatgtaatcccctcgaaacaataaaccgactgtaaatttccgacaacgttgataattgtttgtgttacggtctgttgaatataatattgagtttgtgatgttttcgaaaccccacgtctaccgattagtcatacaagaatttgagccacatcttcttcctctgttataatcccaaatcccagaggaaggaagaagcaaaattaaaaacatggaagctcaaacactaactttcacattcatcttcattgttcttactctaacattcttcatcggaaaaaacagaatcaagcgaaagcccaaccaccctccgagcccacctttcgcgcttccaatcatcggtcacctcagcctactcaagccgccgctccaccgcgttttcctctccgtctctcaatccttaggcagtgctcccatcttctccctccgtctcgggaaccgactcgttttcgttgtctcttcacactcaatcgcagaggaatgcttcacgaagaacgacgtcgtactcgcaaacaggccaaacaccatcgcttccaaacacgtctcatacggacacacaaccatggtctcagctccgtacggagaacactggagaaacctccgccgcatcggcgccgtcgagatattctcagctcaccggctcaacagatttcagtctatccgccgggacgagatccggcggcttttagttcgtctctcacggaactcttcacatgtaatttgccaaggtggagatcaactcaatgttatctgacttaacattcaataatatcatccgaatggtggccgggaaacgttactacggagatggtgcagaggaagactcgaaggccaaactcgtaaggccgcttatcgcggaggtgatgagttgttttggtgccggaaatgttgttgaatatttacctgtcctgcgttgggtcacgggtttcgagaaacggatcaagaagttagcgtgtaggatggatgagttcttgcaaggattggtcaatgaaaaacgagcaacgaaagagaagggaaacacgatgatcgatcacttgctttctctgcaagaatcccaacctgagtactacacggaccgcaccatcaaaggaaccatcctctctttgattctggcggggactgatacatcagcggtaacattggaatgggcattgtcgagcttgttgaaccatccagaggtattgaacaaggcgagagacgaaatcgataacaaaattggtttagaaaggcttgtggaggaatcagacatttcaaatcttccttatcttcagaacattgtgtctgaaacattgcgtctataccctgcgggacctttgatggtccctcacgtcgcatcagaagactgtaaagtagaggggtacgatatgccacgtggcacgatgttgttggtgaacctgtgggctatacacagagaccctcatctgtgggatgatcccgcgactttcaagccagagaggttcgagaaagaaggggaggctcataagcttatggcgttcgggctaggacgaagggcgtgtcccggatccggactggctcaaaggctggtgagcttgactctcgggtctttgattcaatgctttgaatgggagaggactggagaagaagaggtggatatgactgaaactggaggagtcacaatgcctaaagctagaccattggtagccatgtgtcgagcacgtgcctctgttggtaaaatcctctacgagtccacttgatttttcttcttttttctttccagtaatgtctgaatgttggacattcattcacaacttgatt

SEQ ID NO: 1962 - DNA, 1755 bp, Eutrema halophilum
aagagattcagaaccacatcagttaaatctataaattgtatattatataaacactcaaatcccaaatccaatcaggaataagcagcaagaaacaaacatggaggaagctcaaatcctaattttgacattcctcttcctctccctcacattcttcttcatcggaagaatcaagcgaaagcaaaacctccctccgtctccgcccttcgcgcttccgatcatcggtcacctccgcctcctcaagccgccgctccaccgcgctttcctctccgtctctcaatccctcggcgatgctccggtcttctccctccgtctcggcaatcgactcgttttcgtcgtctcttcgcactcaatcgccgaagaatgcttcaccaagaacgacgtcgtcgtactcgcgaaccggccacactccgtcgcttcgaaacacatctcgtacgactacacaaccatggcctcagcgtcatacagcgaacactggagaaacctccgtcgcatcggcgccgtcgagatattctcggctcaccggctcaatctcttttcttctatccgccgtaacgagatccggcggtttatagctcgtctctcacggaattcgtcacacgaatgaatttgccaaggtggagatgagatcaatgttttccgacttaacattcaacaacataatcagaatgttggccggaaaacgttactacggagacggcgcagaggacgatccggaggctaaacgcgtaaggcagcttatcgcggaggcgatgagtagttttggcgcaggaaacgctgttgattatgtaccggtcctgcgttgggtcacagatttcgagaaacggattaagaagcttgccgataggctagatgagttcttgcaaggcttggtcgatgaaaaacgagctgagaaagagaaggggaacacgatgatcgatcacttgctttctctgcaagaaacacagccagagtactacacggaccgcaccatcaaaggaatcatactctctctgatactggcggggacggatacatcagcggtaacactggaatgggcatgtcgagcttgttgaaccatccagaggtaatgaacaaggcgagagacgaaatcgacaagaaagttggcttcgacaggcttgtggaggaatcagacttcacaaaacttccttatcttcagaacattgtgtctgaaacgctgcgcttgtatcctgcggggccactgctggtccctcacgtcgcatcggaagactgtaacgtcggaggttacgatatgccacgtgggacgatgttattggtgaacttgtgggctatacaccgagatcctcagctatgggatgatccggaggctttcaacccagagaggttcgataaagaaggagaggctcgtaagctgatggcgttttgggttaggaagaagggcgtgtcctgggtccggattggctcaacggctagtgagcttgactctagggtctttgattcaatgttttgagtgggaaaggatcggagaagaagaggtggatatgactgaagctggaggagtcacaatgcctaaagctagaccgttgatagccatgtgtagggctcgtgcctctgttggtgaaatcctccatgagtcaaactgagtattttaagacctatttaggaaacgagaaataagtgtgtgtgtgtgtatatatattgaagtgtgttttttttaagttgttactattgtaaatcaaggtacaagtaaaattaacatataatgtgatccccacatatattacatacgatgttgat

SEQ ID NO: 1963 - DNA, 1527 bp, Arabidopsis lyrata
aagaaaatcaaatcaacaacaatggaagaagaatctcaaaccctaattctcacaatcctaatcctaatcctcactctcacaattctcctcatcaaaaaactcaaaccaaaaccaaatcttcctccatctccactgttctcacttccaatcatcggccacctccgccttctcaaaccaccgctccaccgtatcttcctcaccatctctaaatccctaaacaattctccgatcttctccctccgtctcggaaacaaactcgttttcgtcgtctcttcaaactcaatcgtcgaagaatgcttcaccaaaaacgacgtcgttctcgcgaatcgtccaaagtcaattgcttctaaacacatctcgtacaattactcatctatggtctcagctccgtatagtgaacattggagaaatctccgccgtatcggcgccgtcgagattttctccagtcaccggcttaatagcttttcctctatccgccgggacgaggcccggcgacttatagttcgtctctctcagaactcttcactcgaattcgcaaaggttgagatgaattcaatgttatctaatttagcattcaacaacattattagaatggtgactggaaaatgttactatggagatggtgcagaggatgatgcggaggctaaacgcgtgcggcagcttatcgcggaggcgatgagttgttttggtgccggacacgcggcagatcatttaccggtcttgagatggattacaggtttcgagaggcgggtaaagaagattgctggtaggcttgatgagttcttccaggaattggttgatgagaaacgagcggcaaaggagacggagaatacgatgattgatcacttgctttctttgcaagaatcccaacctgagtactatacagaccacaccattaaaggaactatgctctctcttatacttgcggggactgatacatcagcggtaacattggagtgggcattgtcgagcctgttgaaccatcccgaagtactaaaaaaggcgagagatgaaatcgacaataaaattggcttaaacaggcttttggaagaatcagacgttccaaatcttccttatcttcagaacatcgtctctgaaacgttgcgcttgtaccccgcagggcccttgtccgtcccgcacgtcgcatcagaagtttgtaaagtaggaggttacgatatgccgcgtggcacgatgttgttggtgaatgtgtgggctatacatagagatcctaagctatgggatgatccagcgagtttcaagccagagaggttcgagaaagaaggagagacgcataagctactagcgttcgggttaggaagaagagcttgtcctgggtccggactggctcaacggctagtgagtttgagtctcgggtctttgattcaatgttttgaatgggagaggattggcgaagaagaggtggatatgactgaaggtggaggactcactatgcctagagctaatccgttggtagccatgtgcagagcacgtgcctttgttggtaaaatcctacacgagtccgcttga

SEQ ID NO: 1964 - DNA, 815 bp, Euphorbia peplus
atgttccttctcaagacttggagatcaactgcttttggtgtctatggttacctcaattttaccaagtccggtttcctggagcattccaaaaatttcaaaccagaagatatgcaaattagaatagaagggaagaattgcgtggtgaccggagctaattcaggcattggttatgcaactgctgagggtcttgcttctcgtggagctaatgtatatatggtatgccggaacaaggagaggggagaagatgccctttctaagattcagaataaaacagggaatcaaaatgttcacttggaggtttgtgatctttcatccgttagtgagataaagtcgtttgcatcaagattcgtttcaaaagatgttccagttcatgttctggttaacaatgctggtctgcttgaaaatgaaagagttacaacaccagaaggtttggagttgaattttgctgtaaatgtgttgggaacttatgcaatgacagaactaatggtgcctttgttggagaaagcttctcctaatgccaaagttattacagtttcatctggtggaatgtacacaactccactcactacagacctacagttttccgatggaaaattcaacggggtggaacaatatgctcgtaataagcgagttcaggtggcattaaccgaaaaatgggcagaaacatacaaggatagagggatttcattctactcaatgcacccaggttgtcaggaaagctaagaacaagtgaggaaggtgcagacacagttatatggctagctttacagcccaaagaaaaactagtttcgggtgcattttacttcgatagagct

SEQ ID NO: 1965 - DNA, 856 bp, Euphorbia esula
  misc_feature (26)..(26): n is a, c, g, or t
  misc_feature (491)..(491): n is a, c, g, or t
  misc_feature (606)..(606): n is a, c, g, or t
  misc_feature (614)..(614): n is a, c, g, or t
  misc_feature (695)..(695): n is a, c, g, or t
  misc_feature (705)..(707): n is a, c, g, or t
  misc_feature (746)..(746): n is a, c, g, or t
  misc_feature (752)..(752): n is a, c, g, or t
tgcgatttcaaattccaatcatctcnattttcgcccttccaatgttccttctcaagacttggagatcaactgcttttggtgtctatggttacctcaattttaccaagtccggtttcctggagcattccaaaaatttcaaaccagaagatatgcaaattagaatagaagggaagaattgcgtggtgaccggagctaattcaggcattggttatgcaactgctgagggtcttgcttctcgtggagctaatgtatatatggtatgccggaacaaggagaggggagaagatgccctttctaagattcagaataaaacagggaatcaaaatgttcacttggaggtttgtgatctttcatccgttagtgagataaagtcgtttgcatcaagattcgtttcaaaagatgttccagttcatgttctggttaacaatgctggtctgcttgaaaatgaaagagttacaacaccagaaggtttggagttgaattttgctgtnaatgtgttgggaacttatgcaatgacagaactaatggtgcctttgttggagaaagcttctcctaatgccaaagttattacagtttcatctggtggaatgtacacaactccactcnctacaganctacagttttccgatggaaaattcaacggggtggaacaatatgctcgtaataagcgagttcaggtggcattaaccgaaaantgggcagaannntacaaggatagagggatttcattctactcaatgcacccnggttgncaggaaagctaagaacaagtgaggaaggtgcagacacagttatatggctagctttacagcccaaagaaaaactagtttcgggtgcattttacttcgatagagct

SEQ ID NO: 1966 - DNA, 1294 bp, Fagus grandifolia
tgaaaacactgcaaactcaacttaacattaacattatacctctcacaatgttccttctcaagacatggagatcaacggctttcggtatatatggatacctgaatttcaccaaatctggtttcattgaacattcaaagaagttcaaaccagaggatgtgcagacaagaatagatgggaagaattgcatagttacaggagcaaattctggccttggttatgcaacagctgagggcctagcttcacgtggggcaactgtttatatgatctgtcgtaataaggagagaggagaagctgcactttcgaaaattcagtctacgacaggcaaccaaaatgttcatttggaggtctgtgatctttcatctgtcagtgagatcaagtcattcacttccagattttcttccaaggatgtgccaattcatgtactggtaaacaatgccggcttgcttgagcataaacgagttaccacatcagaggggttcgagttgaatttttccgtgaatgtattaggcacctatgccataacagaaatgatgctgccactactggagaaaactgcacctgatgctcgtgttatcacagtgtcctctggtggaatgtacacggctcctttgacaacggatctacagtttagtgacagcaactttaatggggtagatcagtatgctcgaaataagcgagttcaggtagcactgacagaaaaatgggctgaaacattcaagaataaagggattggattctattcgatgcacccaggttgggctgagacacctggggttgctaagagtttgcccagtctttctaaaaggcttcctggaaatcttcgaacaagtgaggaaggtgctgacacggtcatttggttggctctacaaccaaaagaaaattggtatcaggtgcattttattttgatagggctgaagcgcctaaacaccttatgttttcagctactggtggctctcatgtgttaattgattctgttgttgacagtctccgttccttgtctactctctcttcttaaagttgaagaagatacttacattacattgtacttagcctcacaataggaggagatcgattatggtctaaatgacgtctttctcatatccttttgtaattgtttctttgttgtacacttttgtaaatttctcattatcaataaaggctgacttgaagtgcgttttagcaaaaatatattgattttggagatgatattaaatgttcagcttcagaattgagctaattttattggagaagacttaagctatgaccaaggaaaagtttgactgagatgtaattt

SEQ ID NO: 1967 - DNA, 1155 bp, Carica papaya
gctgggcgaagtcctagccaagatgcagaggcttgaacttgaaattaaaatcaacatctcaattatatcactcgccatgttcctcctaaagacatggagaacaacagcttttggcgtttatggctaccttaatttcaccaaaaacggtttcctggaacactccaaaaatttcaaagaaaaagaaatgcaggtgaaaattgatcgaaagaattgcattgttactggagctaattctggcattggttatgctgctgccgagggccttgcttcatgtggggcaactgtctatttgatatgccggaacaaagagaggggagaagccgctctatctaaaattcagtctgcaacgggaaatacaaatgtgcatttggaggtattagatctctcatcccaaagcgagataaagtcttttgtatccagatttgcttctaaggatatcccagttcatgttctggttaataatgctggcctccttgaaactaaacgggtcaccacgtccgagggatttgagatgaattttgctgtaaatgttttaggaacttatactatgacagagttaatgttgcccttgctggaaaaagcggcacctgatgctaaagtcatcactgtttcttcaggtggaatgtacacagttcctttaaccacagatctgcagtatagtgatgaaaaatttgatggggtagtgcaatatgctcgaaacaagcgagttcaggtggcacttacagaaaagtgggctgaaatgtacacgaacaaaggaattggattctattctatgcacccaggttgggccgagacacctggaatagctaagagcttacctggtttcaataaatcgttttcgggaaagcttaggacgagtgcagaaggtgcagatacaattatctggttggcattgcagccaaaagaaaatttggtacctggtgcattgtattttgacagagctgaagctcctaagcacttgaagcttgcagctacagctcagtctcatgcagtaattgactcaattattgacaatctgcgctctatggctgcacttcctcaataaaaatataaaataagcccttcggatttgattcttctgtttacagtttcgacattttacttctttggtctcagatattatgtttcagatttgaacaaggatgttgtaatagc

SEQ ID NO: 1968 - DNA, 1068 bp, Prunus persica
aacccaatggaagagtttccgccccaaaagacacaaaaactgcaggagacttcagtgtctgtcagacttgaacttcacttatccgttggagctcttacaatgtttcttctcaaggcatggagacaaacagcttttgggatttatgggtatctgaatttcaccaagtctggtttcatagaacattcaaagcaattcaagccagaggatacgcaaactcggatagaagggaaaaattgcattgtaacaggagccaattctggcattggttttgcgactgccgagggacttgcatcacgtggggcaaatgtatatatggtatgtcgaaataaggagaggggtgaagctgcacaatctaaaattcagtctaacacaggaaaccaaaatgttcatttggaggtctgtgatctctcatctgtttctgatatcaagtcatttgcgtcgcagttttcctcaaaggatgttccagtgcacatattggtgaataatgctggtctgcttgagcataataggattaccacctcagaagggtttgagttgaactttgctgttaatgtattgggtacgtatgcaatgacggaattgatgttgccattgctggagaaagctgcacctgatgcacgggttattactgtttcttctggtggaatgtacaccacacccttgaccaaggatttacagttcagtgaagaaaactttaatggggtgcagcagtattctcggaacaagagagttcaggtggcattaactgagaaatgggctgaaataaacaaaaacaaggggattggattctattcaatgcacccaggttgggctgagacaccaggggttgccacgagtttgccaagtttctctaaagctctttcgggaaagcttagaacaaacgaggaaggtgcagacaccataatttggttggctttacagccaaaagaaaaggtggtatcaggatcgttttatttcgatagagcagaagcacctaaacacctgatgtttgcggccaccagtggctctcatgccttaatcgactccatttttgagagtctcaagagtttgtctagtatctccgcatag

SEQ ID NO: 1969 - DNA, 1102 bp, Brassica rapa
  misc_feature (376)..(376): n is a, c, g, or t
  misc_feature (396)..(396): n is a, c, g, or t
  misc_feature (402)..(402): n is a, c, g, or t
  misc_feature (414)..(414): n is a, c, g, or t
  misc_feature (462)..(462): n is a, c, g, or t
  misc_feature (495)..(495): n is a, c, g, or t
  misc_feature (540)..(540): n is a, c, g, or t
  misc_feature (624)..(624): n is a, c, g, or t
  misc_feature (627)..(627): n is a, c, g, or t
  misc_feature (683)..(683): n is a, c, g, or t
  misc_feature (703)..(703): n is a, c, g, or t
cccacgcgtccgccacgtctggtctcaaatcagctatagagtcgttaactctctacagattcagcagatcttcagtcagcgacttcgaacttcagcgaggagaacaagatcaaaggctcggtgtataaggcaacgatcaacggagacgacgcggctgtgaaggtgatcaaaggagacgtgtcttcctcagagatcagcctcttgaagaagctgaaccattccaacatcatccgtctctctggcttctgcatccgcgaaggagcctcgtaccttgtctacgagtactcggagaacggttcggttagcgattggcttcactcgtctaacaagaagaagagtctgacatggagacagcgagttgagatctgtcgggacntagctgaggcgttggactanttgcanaactacgtgacnccgcctcatatccacaagaacttggaatccaacaacgtgcttcttgantccaacttcaaagccaagatttcgaatttcggngtagcgaggattcttgacgaaggtgatctcgatcttcagttgacnagacatgttgaaggaacacaaggctacttagctccggagtatgtagaaaacggagtcataactccgaagctagacgtgtttgcnttnggagttgtggttcttgagcttctttcggggaaagaagcggtgacgacggtggatanggaggagaaggaagagatgntgttgtgtagagagataaacaatgtgcttggaggagagaatgtgagagagaagctgaaggagtttatggattcatctctaggagatgagtatcctttggagctggctttcaccatggcacagcttgctaagagctgtgtggcacctgatattaactcgcgaccgtctattgctcaggttctaaccacgctcttgatgatcgtctcgtcatctattgattgggagccttctcatgaccttcttcatgattcgggatctcttggcaactagttattctattttcttttgttttgtttgtcaataattgagtatttagattttagattttgtgtaatatataagataaggaccatatggctataaaatctactgtaactgagcaaaataagtaccacagtgt

SEQ ID NO: 1970 - DNA, 2494 bp, Brassica napus
caagctcaaacacgtcatcaagcctccatccttaaccctgcgcctaaaagcagagcccgtgctagtcgccttagaagactcccacgtgctgaggaccgtgctgcactcccacctcctcgcgcgacctaagtaccctgtagtcgcttagacctaccgaccgactaagaagcctttaaacacccgaaacagctcaaatcctggtccaaagacctccccgtagtctccaaacgcatcccctacacagaccttttaaccctaaagtcccaaggcaagctcaaacacgtcatcaagcctccatccttaaccctgcgcctaaaagcagagcccgtgctagtcgtcttagaagactcccacgtgctgaggaccgtgctgccgtcaatagacggtaacaaacggttttgggaacaatgggacgagttaaagctcgattcagtttgtgtaaacgcttactctcctcccgttaagaagccacctgtcccatctccttacttagggttcctatggagagtcccgtcttacatgctgacgctggccaagcccaagaaggagtctaaacgggccgcggagctgaaacggatgagagaggatttcaagaggcagaggaaggaggagatggagaggatgaacgaggagagcgaggcgatggagaaggcgatcaaggcgcagaagaagatgcaagagaggaagaagaggaaggcggttaggaagaagaagtacgaagagtctttactcgaggcgaggaggaactaccgcgacatgggccttatgtgggccagactggccgaggattcgaacgtcgcgactgctctcggactggtcttcttctacatcttctaccgcgtggttgtgctcaactacaggaagcagaagaaggattacgacgataggttgaagatcgagaaggcggaggcggaggagaggaagaagatgagggagttggagagggagatggaagggattgagttggatgatgaggaggaggagagtggcgagaagaatccttacctgcagatggcgaagcagttcatgaagtcaggggcgcgcgtgaggagagcgtcttcgaataggaggatgcctgagtatcttgagaggggtgttgatgtgaagttcacggacgttgcggggcttgggaagattcgtcttgagttggaggagattgttaagtttttcactcatggtgagatgtatcggaggagaggtgtcaagatcccaggtggtattctattatgtgggccacctggggtgggaaagacattactggctaaagctgtagctggggaagctggagtgaacttcttctctatatctgcttctcagtttgttgagatatacgttggtgttggtgcgtctcgtgtacgagctttgtatcaggaagctagagacaatgctccatctgtggttttcattgatgagttggatgctgttggaagagagcgtggtttgataaagggatctggaggacaagaaagggatgccactcttaatcagctccttgtgtctttagatggttttgaaggaagaggagaggtgattaccatcgcttccacgaatagaccggacattctagatcctgcgcttgtgaggcctggaaggttcgaccgcaaaatcttcattcctaagcctggtcttatcggacggatggagattctacaggttcatgctcgtaagaagccgatggctgaagatttggactatatggcagttgctagcatgacagatggcatggttggagcagagcttgctaatatcgttgagatcgcggctatcaatatgatgcgtgatggaagaactgagttaacaacagatgatttgcttcaagctgcacaaatagaagaaagaggaatgttagatagaaaagataggagctctgagacgtggagacaagttgctaataaacgaagctgctatggctgttgtcgcagtgaacttccctgatctcaagaatatcgaatttctgacaatcaaccctagagctggtagagaattgggttatgtccgtgtgaagatggatcacatcaaattcaaagaaggcatgcttagccgacaatctctcttggatcacataactgttcagctagcacctcgtgctgcagatgaagtatggtacggtgaggatcagttaagtaccatatgggctgaaacatcggataacgcaaggtcagctgctagatcacttgttcttggtggtctctctgagaagcatcatggcttgaataacttctggatggctgatcgaattaacgatattgacgtggaggcgttgcggataatgaacatgtgttacgaccgtgctaaagagattctccaaaagaaccggacgctcatggacgaagtggtagagaaactggttcaaaagaaaagtctttcgaaacaagagttcttcactcttgttgagctctatggctccattaaaccaatgccaccaagcattcttgaactcaggaaaatcaaacggctccagctccaagagaacgtgatgaaactggacatgact

SEQ ID NO: 1971 - DNA, 3321 bp, Arabidopsis thaliana
atggcgaaagcagcagagcagaaacaaaacccgaccgttgcgagtgcagaagcgaagcttgatatccgcgacgtggtcaacacagccatcacttacggcgaagataaccgtcacggcggcgggaaacgcaatgacgtggccatgtttgtgctaagagccatgtgcatggccgtatcaacggtggctgttacgttaatggtaacagcacgcgagactagcatgaccactctctatggcttcgagtttcagctccacgccgtttggtctctctcagattctcttatatatctagttgtggtttcatcggcaacggttctttactcgttgattcaactgattataagtggaacaagactaatgagaaaatctccggtgattccgacaagaacacaagcatggttttgcttcgttgcagatcagataataggatacgcaatgaagcctttttatattacgattgttctgtgttctgtttcttctatccctttagcctgggaaatgatgaagctcattgctacgttttaatggcgatcactctatctcgactagcttggtttattgcaattcacttcttcatagactacccagaaattacccttcaatctcatgccaaaacaattcagctacgaacgttgtccatgaagatggtgatgataacgacaaagccaagacaaaccaagtcaatcttctcgcaataccaatcacactcactataatctccgcttctctagccaaaccgtcgttcgcggctgcgaaggtaacggagagaaagagaactcagaagaaacctcaggaggctttgacacttgaacagcttaaagcttggtccaaagatttacctgtagtttcgaatcgtataccttatactgacattttgagcttaaaagctgaaggtaagcttaagcatgtgataaagcctcctaatttaagtttgcggcaaaaggcagagcctgtgttagtagttttggaggattctagagtattaaggactgtgttgccttctttagagggtaataagaggttttgggaacaatgggatgagttagggattgatgtacaatgtgttaatgcttatactcctccggttaagagacctcctgtgccgtctccttatttaggatttttgtggaaagttcctgcttatatgttaacatgggttaagccaaagaaggagtctaaacgtgctgctgagttgaagagaatgagggaggatttcaagaggcagaggaaggaggagattgagacgatgaaagaggaaagagtgatgatggaaaagacaatgaaggcgcagaagaaacaacaggagaggaagaaaaggaaggctgttaggaagaagaaatacgaggagtctctgcgtgaggcgaggaaaaattatcgagatatggcggatatgtgggcaagattggctcaggatcctaatgtggctactgctcttggattggtattcttttatatattttaccgtgtggtggttctcaactataggaagcaaaagaaggattatgaagacaggttgaagattgagaaggcggaagcagatgagaggaagaaaatgagggagttggaaagggagatggagggaattgaggaagaggatgaggaggttgaggaaggtacaggtgagaaaaatccttacttacagatggcgatgcagttcatgaagtcaggtgcacgtgtgagacgagcatcaaataagaggttacctgagtatcttgagagaggtgtggatgtcaaatttacagatgttgctggacttgggaagattcgtcttgaacttgaggaaatcgttaagttttttactcatggagagatgtaccgcaggagaggggtcaagattccaggtggtattcttttatgtgggcctcctggggtcggaaaaactttactggcaaaagctgtagctggtgaagcaggagtcaatttcttctctatctctgcttctcagtttgtggaaatatatgttggtgttggtgcatctcgtgtccgagcattataccaagaagctagagaaaatgctccatctgtggtcttcattgatgaattggatgctgttggaagggagcgtgggttaataaagggttctggaggacaagaaagggatgccactcttaatcagctacttgtttctttagatggttttgaaggaaggggagaggtcatcaccattgcttccacaaacagaccagacattctcgatcctgcgcttgtgaggcctggacggttcgaccgcaaaatctttatccctaaacctggtcttattggacggatggaaattctgcaggttcatgctcgtaagaagccgatggctgaagatttagactatatggcagttgctagcatgacagatggcatggttggagcagagcttgctaatattgttgagatcgcggcaattaatatgatgcgtgatggaagaacagagttaacaacagatgatttgcttcaagctgcacaaatagaagaaagaggaatgttagatagaaaagacaggagcttggagacatggcgacaagttgcgatcaatgaagctgcaatggctgttgtagcagtgaactttcctgatatgaagaatatagaatttctgacaatcaaccctagagctggtagagaattgggttatgtccgggtgaagatggatcatatcaaatttaaggaaggcatgcttagtcgacaatccatcttggatcacatcactgttcagttagcaccccgtgctgcagatgaactatggtacggtgaggatcagttaagcacgatatgggctgaaacatcggataacgcaagatcagctgctcgatcattggttcttggtggtctttctgataagcatcatggcttgaataacttctgggtagctgatcgaattaacgatattgatgtggaggcattgcggatattgaacatgtgttacgagcgtgctaaagagattcttggaagaaacaggacgctcatggacgaggtggtagagaaactggttcaaaagaaaagtctaacgaaacaagaattcttcactcttgttgagctctatgggtccagtaaaccaatgccaccgagtatccttgaacttaggaagatcaaacggcttgagctagaagagatggtgctgaaactggacatgactaccgcaagaaacagttcataagatgattgtaatttggagaaaagagacagttcgtgacaatcgtagggaataaacatcaaaaacccattatagagacaatgaggttgatcctttatctatatttcctctgtaatctttgtaatagtacatgttagataattctttgagcttcaatatagtataacacttctttttatcca

SEQ ID NO: 1972 - DNA, 1474 bp, Raphanus sativus
  misc_feature (411)..(411): n is a, c, g, or t
  misc_feature (426)..(426): n is a, c, g, or t
  misc_feature (441)..(441): n is a, c, g, or t
  misc_feature (453)..(453): n is a, c, g, or t
  misc_feature (474)..(474): n is a, c, g, or t
  misc_feature (498)..(498): n is a, c, g, or t
  misc_feature (501)..(501): n is a, c, g, or t
  misc_feature (619)..(619): n is a, c, g, or t
gagattcgtcttgagctggaggagattgttaagttcttcactcatggagagatgtacaggaggagaggtgtcaagattccaggtggcattctgttgtgtgggccacctggcgtggggaagacgttactgtcgaaagctgtggctggtgaagcgggagtgaacttcttctctatctctgcttctcagtttgttgagatttatgttggtgttggtgcatctcgtgtccgagcactgtaccaggaagctagagacaatgcgccatctgtggctttcattgatgaattggatgctgtgggaagggagcgtgggttgataaagggctctggaggacaagaaagggatgccactcttaatcagcttcttgtttctttagatggttttgaaggaagaggagaggtgattaccatcgcntccacaaatagaccngacattctagatccngcgcttgtgagncctggaaggttcgaccgcaanatcttcattccaaagcctggtctnatnggacggatggaaattctgcaggttcatgctcgtaagaagccgatggctgaagatttggactatatggcagttgctagcatgacagatggcatggttggagcagagcttgctaatatcnttgagatagcggctatcaatatgatgcgtgatggcagaactgagttaacaacagatgatctgcttcaagctgcacaaatagaagaaagaggaatgttagataggaaagataggagctctgagacgtggagacaagttgctataaacgaagctgctatggctgttgtggctgtcaactttcctgatctcaagaatattgaatttctgacaatcaatcctagagctggtagagaattgggttatgtccgtgtgaagatggatcacatcaaattcaatgaaggcatgcttagccgacaatccctcttggatcacataactgttcaactagcacctcgtgctgcagatgaactatggtacggtgaggatcagttaagtaccatatgggctgaaacatcggataatgcaaggtcagctgctagatcactggttcttggtggtctctctgagaaacatcatggcttgaataacttctggatgactgatcgaatcaacgatattgatgtggaggcattgcggatactgaacatgtgttacgaccgtgccaaagagattctccaaaagaaccggacgctcatggacgaggtggtagagaaactggttcagaagaaaagtctttcgaaacaagagttcttcactcttgttgagatatatggctccattgaacctatgccaccaagcattcttgaactcaggaaaatcaaacggctccagctccaagaggctgtgatgaaacaggacatgactactgcaagaaacagttcataagatgtttgtggcatacctagacaatgttgtaatcttagacacgtgtgaaaattctttgagcttcaataaaaaaagttatcagttttgaagg

SEQ ID NO: 1973 - DNA, 3141 bp, Theobroma cacao
gagtcgtttagcttaaacgttagattacctggcttcctttcccctcgaaattggaccagcacatttttagctgcaggggtttaaacagaaagaagaagaagatgctttgtcttaggcttcattgtcgactaaatcgaaagctcagtaaccttaaattcactctctcagtttcatttcacaatgtaagtctctctctttcaatcttttagaaactgaaagtcttttttcttttttttcttgtcatttaaaattttcttcacctcttttttttcatggcttgccatttctcttttggttcttcattgtacccagaactcccatctttaaaactcaaatcccaaaacccatttttctccaccacttacccttcaatttcttgtcaaatttatagctttaagagtaataattctgatgatgatgataaaaccaagaaatcccaattcaattttcttgctttacctattactcttactataatctccacttcatttccacaaaaaagctctcttgcagcagttaaagtatctgatagaaagaaaactcagaaaaaaacccaagaagcactaaccccagagcagctaaaacaatggtcaaaagatcttcctattgtaaaaagcaggattccgtatactgaaattttgagtttaaagcttgagggaaagcttaaacatttaattaagccgcctagtgtgagtttgaagcaaagagcggagccagttttagtagttttagaggattctagagtgttaagaactgttttgccttcaatagatagtgataggaagttttgggattcatgggacgagttaaagattgaatctttgtgtgttaatgcgtatacacctccaattaagaggcctgaggtgcctgccccatatttgggatttttggggagggtgcctgcctctatgttgtcatggtttaagccaaagaaggagtctaaaagggctgcggagataaggagagcgagagaggagtttaagaggcaaagaaaggaggagttggcaaggatgagggaagagagagagatgattgaaaaggcaataaaggtgcagaagaaggaggaggtgaggagaaagaagcaagagattaggaagaggaagtatgaggagtcattgcgtgatgctaggaggaattatcagagtatggcaaatgtgtgggcaagtttagcacaggattcaaatgtggcaactgctcttggattggtgttttttgtgatattttataggacagtggtgcttagttacagaagacagaagaaggattatgaggacaggttgaagattgagaaggcagaggctgaggagagaagaaagatgagggagttggagagggaaatggaaggaattgagggtgaggacgatgaggctgagcaagtgggaggtgaacagaatccatatttgaagatggctatgcagttcatgaaatcaggtgcacgtgttcgaagggcacataataagagattaccacagtatttggagagaggtgtggatgtgaagttctcggatgttgctggacttggcaaaatcaggcttgagcttgaggagattgtgaagtttttcacacatggggagatgtaccggagaagaggagtgcgaataccaggtgggatacttctttgtggcccccctggggtggggaaaactttactagcaaaagccgtggctggtgaagcaggtgtaaacttcttctccatctctgcctctcaatttgtggaaatatatgttggagttggtgcatcccgtgtccgagcactttatcaggaagcaagggaaaatgccccatcagttgtatttattgatgagttggatgctgttggaagggagcgtggtttgatcaaaggttctggtggacaagaacgtgatgctaccctgaatcagcttcttgtatgcttggatggttttgaaggaagagggaatgtcatcactattgcttccacaaatagaccagacattctagatcctgcacttgtgagacctggacggtttgatcgaaaaatctttatccctaaacctggacttataggtcgcatggaaattctgcaggttcatgcacgaaagaagccaatggctgaggatgtggactacatggctgttgccagtatgaccgatggaatggttggtgccgagctggctaacatagttgaggttgctgctattaatatgatccgtgatggaaggactgagattacgaccgatgatttgctccaagctgcacaaatagaagaaaggggtatgctagatagaaaggagagaggccccgagacatggaaacaagtagctattaatgaagcggcaatggctgttgtagctgtgaactttcctgatctcagaaacattgaatttgttacaattgctcctagagcaggtagggaattgggttatgttcgtatgaaaatggatcatatcaaatttaaggaaggaatgctaagtcggcagtcccttctcgatcacataactgttcaattagcaccccgtgcagcagatgaactatggtatggtgagggtcagttgagtacgatatgggctgaaacggcagacaatgctaggtctgcagccaggacgtttgttcttggtggcctctcggagaaacatcatgggttgtctaacttctgggttgcagatcgaattaatgaagtagatttggaggcattacggattgtgaacatgtgttatgaacgcgcaaaagagatcttacagcagaaccgaaagctcatggatgcagtggttgatgaacttgtccagaaaaagagtttgacaaagcaagaattctttggtcttgttgaattgcatggctcacttaagccaatgccacccagtatacttgatgttaggcttgccaagcgagctcagttccaagaaatgatgatgaatcagaaagtagaagttgcagggagcagttcataaacaaagagcctaatcttatttgtgatatgctcggtagcctatgggcagagacgtttagggcatcggggacagctgctgctagcacgaaaatataaaaaaaaaaaaaaggaaaagattcttatagtattatgtaactactactgtttaggagacgtttcaattttgctttccaactaaatgtgggattggagtaaataatacataattagccaactcctcaaggaatttttagttt

SEQ ID NO: 1974 - DNA, 3278 bp, Populus trichocarpa
gcatgaaaggagaaacaaggccagttcagatgaggttaggtctctctatcttgtaaaacagaaacagaggcacacctgaagacagcaaaatcatctctgtttcgaattcaattcaatcaagcacaaccatggctcattgtctcacaatcaacaatttttgatggcctgtcatttcccttcgagctcttcactacaccccaaaaccaccataaaaccccaccaaatcccactaagaaccatcacttacccttccattagatgcaagaaacaagacccaattcttgagaatgataacaaaactgaaaataccaataaaaaaacccatttcagttttctctctttacccataactctcactattatctccacctctctcactccacaccctgcctttgctgccacaccaacacccaaaacttaccataaaaagaaaaccttaaaaaagacacaacaagaagccttgacaccggaccagcttaaacaatggtctcagaatcttccagttgtatccaatagaataccatatactcaagttttgattttaaaagagaacaacaagcttaagcatgtaattaaagcgcctaatgcctctttaaaacaacgtccggaggctgttttagtggttttagatgataatcaagtgttcaggactgtcttgccctcgttagagagtaataggaggttttgggattcatgggatgagttcaagattgatgctttatgtgtgaatgcatattcccctccggttaagagacctgagcttcctaagccatatttaggatttttgtggaaagttccagagtttatgctgtcgaggttaaagcctaagaaggagtccaagagagctatggagttgaggatggccagagaggagtttaagaggcaaagaaaggaggagctgaagaaaatgagagaggaaagagaaataatcgagaaggcaatcaagatgcaaaagaaagacgaggacaggaggagaaagagggagactaggacaaagaagtatgaagagtcattgcgtgatgctcggaagaattatacaagaatggcaagtatgtgggcaaatttagcacaggactcaaatgtgacaactttgttagggttggtgttttttgtaatattttatcgtacagtggtgcttagttatcggaagcagaagaaggactatgatgatcggctcaagattgagaaggcagatgctgaagagagaaagaagatgagggagttagagagggagttgatgggtattgaagaagaggaagaagatgagagcgtgcctgggaaagcggagcagaatccatatttgaagatggctatgcagttcatgaagtcaggagcacgtgttaggcgtgcacataataagagattgcctcagtacttggaaaggggtgtggatgtgaagttctctgatgttgcaggacttgggaaaatacgtcttgaactcgaggagattgtgaaattttttacacatggagagatgtaccgcaggagaggagtgaagatcccaggtggcatacttctttgtggtccccctggggtggggaaaactttactggcaaaagctgtggccggtgaggcaggtgtaaacttcttctccatctctgcatctcaatttgtggaaatatatgttggagttggtgcttctcgagttcgagcactttatcaagaagcaaaggaaaacgctccatctgttgttttcattgatgaactggatgctgttggaagggagcgtggtttgattaaaggttctggcggacaagaacgtgatgccactcttaatcagctccttgtatccttggatgggtttgaaggtagaggggaagtgatcactattgcttccacaaatagaccagacattctagacccagcacttgtgaggcctgggcggtttgatcgaaaaatatttatacctaaacctggcctcataggccgcatggaaattctgaaggttcatgctcgtaagaaacccatggctgatgatgtggactatatggctgttgcaagcatgacagatggaatggttggtgcagagctcgccaacataattgaggttgctgcaattaatatgatgcgtgatggaaggactgagattacaactgatgacttattacaagctgcacaaatagaggaaagaggaatgctggatagaaaggaaaggagccctgaaacatggaagcaagtagctattaatgaagcagccatggctgttgtggctgtgaactttcctgatctcagaaatatcgagtttgtaacaattgctcccagagctggcagggaacttggttatgttcggatgaaaatggatcatgtcaaatttaaggaaggaatgcttagtcggcaatcccttctggaccatatcactgttcaactggcaccacgtgcagctgatgagctttggtatggtgagggtcagttgagtacaatatgggctgaaacagcagacaatgctaggtcagcagcacggagctatgttcttggtggcctttctgagaaacatcatggtctatccaacttctgggctgcagatcgaattaatgaaattgatttggaggcactacgggttatgaacttttgttatgatggtgcaaaagagattctgcagcagaaccgaaaactgatggatgctgttgttgatgaacttgtccgaaagaaaagtttgaccaaacaagaattttttaacttagttgagttgcatggtgtgatcaaacctatgccaccaagtatactctacatcagggttgccaagcgtgcacagtttcaagaaatgttggtgcaccagaatgaaacaactataacaagcaatgcaagagcaacatgccaagagagctcaatttagcatggaactcgatctttgtttatgctgcaacattagccaaggaaattagccatgggaagcagctgttaccttgattgcatggtaaaaatgaacggctagttgtgaaccgtgcaaattatcaccttgatctatcacggatgagctgatacaataggcacacagaagtccaagttacgtgcggggagaaattttgacggtgcttcatccttttaccttttttctgaactcccatatattctgcaatcattttctgttttgcttcacatattatgatttgttttttgtcgaataggctttagttagcttgtatttgcttcttactaactggttgtgccctcaaaggccaagccattcctatctctgtgctgagttttactgaattgctaatgaaatttttttctcatcctgtgcattctattgtaatggtcagatgtgcgattctctc

SEQ ID NO: 1975 - DNA, 3109 bp, Malus domestica
aagctccatggactgccattcccttctgggctcatcttcttccctatccccataccccaaaccaatacccctcaccaaaacccagccaaaacccctccctccctccaccgtctcctcctcctcctcctcccacctctcacccgccgacgatgacgatgaaaacgataaaacccacaaacccaatttcgatttcctcaagctctctgtaactctcaccgtaatctccacctccctcccccgaatccccaccgccgtcgccgccgtcaaggagaaaaaacgcgcgcccaagaagtccacccccaaaaagtccgaagctttatctccccaagaactcgagtcatggtcccagggactccccgtcgtctccaatcgaattccgtacacccagctgttggcgctcagtcaggaaggtaagctgaagcatgtcatcaagccgccgggaattgaattgcagaaaagggcagagcctgttctggttgttctcgaagattctcgtgttctacgcaccgttttgccatcggtggatagcgacaggaggttctgggagcaatgggaggagttgaaaattgagtctttctgtgttaatgcttacactccgccgcttaaacggccggaggtgccgacgccgtacttgggcttcgtggcgaaatggccccggtttctgtcgtcgttctccgggaagccgaagaaggagagcaagagagctatggagttgagaagggcgagggaggagttcaagatgcagaggaaggaggagttggataggatgaggaaggagagagagatgattgacaaggcaatgaaggctcagaagaaagaggaggagaggagagtgaggagagaaatgaggaagaagaagcacgacgattcgttgcgtgaggcacggaggaattaccaggagatggctaatgtatgggccaatttggctcaggacaccaatgtggctactgctcttgggttggtgttcttctacatattttataggactgtggtgcttagttataggaggcagaagaaggactatgaggataggttgaagatcgaaaaggcggaggcagaggagaggaagaaaatgagggagttggagagggagatggaggggattgagggtgatgaggaggatgagattgagccagggaagggtgagcagaatccttatttgaaaatggcaatgcagttcatgaagtctggtgctcgtgtccgacgagctcataataagaggctgcctcagtatttggagagaggcgtggatgtcaagtttacagatgtggcagggctcgggaagattaggcttgagcttgaggagattgtcaagttcttcactcatggtgaaatgtataggagaagaggagttaaaataccaggtgggatactgctttgtggccctcctggagtgggtaagacattgcttgcaaaagctgttgctggtgaagcaggcgtgaacttcttttccatttcggcctctcagttcgtggagatatatgttggtgttggtgcttctcgtgtccgagcactttatcaggaggcaagggaaaatgctccatcagttgtcttcattgatgagttggatgccgttggaagagagcgtggtttgatcaagggttctggtggacaggaacgtgatgctactcttaatcagctccttgtttgcttggatgggtttgaaggaagaggggaagtgatcactattgcttccacaaatagaccagatattctagatccagcccttgtcagacctggacggtttgaccggaagatatttatccctaagcctggtcttataggtcgcattgaaattttgaaggtccatgcacgcaagaagcctatggctgaagatgtcgactatatggctattgctagtatgactgatggaatggttggtgcagagctagctaacataattgaggttgctgcaatcaacatgatgcgtgatggaaggactgagattactactgatgacctattacaagctgcacaaatggaagaaagaggaatgctagataggaaggagagaagtttagatacatggaagcaagtagctattaatgaggctgcaatggctgttgttgctgtgaactttcctgatcttagaaatattgagtttgtcacaattgctcctagagctggtcgagaattgggttatgttagaatgaaaatggatcctatcaagttcagagaaggaatgcttactcggcagtcgctcctcgatcatatcactgttcaactggcaccacgtgcagctgatgaactttggtttggtaaggatcagttaagtacaatatgggctgaaacagcagacaatgctaggtcagcagcacgaacgtatgttcttggtggcctttcagagaagcatcacgggttatctaatttctgggttgcagatcgactcaatgacctcgatgtggaggcattgcaaatcgtcaacatgtgttatgaacgtgcaaaggagattttgcagaaaaaccgaacgctcatggatgcagtggtcgatgaacttgtcgagaagaagagcttaaccaagcaagaattctttagcttagttgagttacatggtaccctcaaacctatgccgcctagcatactcgacatccgagctgccaaacggaagcagttccaagaaatgatgatgaaccagaaggaagcagctttaggtagcaacttacgagcaaaaatgtgaagagaatcatatggtagataattaatcattgatttggaggcaacacacaagtcggggttggtaaattaagcagcgagtgatatcgtaagtatcctccccgacgtatgatgtttgacatgcctggctgctcgggcaatcacattgtggaagtgtattcgttgatcggaaacatttatacgggggaggtcatgcagagcaacatctatctgagggagaagcccccatcaatattcgtttgtacgattcgatttgtaattttcgaaaatttccatatgtttcagttcattaattttacttggctaattgaacaaaatggttcttagcagttcaaggagaccaaatttttgttaatagagatacttcagtagaaactaccaagtgcgagttctggtaaaactaatgcataaatgttctgattaaattttaacttca

SEQ ID NO: 1976 - DNA, 5387 bp, Ricinus communis
tttattaattttaagaaaaaaaaaggaataaattatcacattaaactataaaaactcacttagaaaaaagaatcttatgtggtctcccttaaaaataaaactttgctcaattacgtaattaaggagcatatcccctcaattatgctattttttgagattatttaagtgtaatgatttcattattgtttggttaatttctttttaaagtttaaaataatttatcaataattaaaatgaaaaagatgagattcgcatgattctcatttttaattatttatcaattcagctaattcttttttattcaacaaggagaaaaatattatgttgttgctacaaaacaattatacaaataaatagctcggatagagctaaagtactaaacctcttgtcctataaaatcctagcactccttgaccagagaaacacaaagaaatagaaaagaaagaaaaagaaaaagaagggtttctttttcttaataagtaagtatatataacaagaatcaatatcaagaaagatcaagaaagtgaagagaagatatgatgacgaatggtcaaaaaatagaggtggcagtgcagctaccggagtcaaaggtggcagcaacagagaacaatgaaacaatgagtgggccactggtggtgggtggtggagtagcaaagccttttggccggaaagctgatgtcatgcacgtaatacttaggctgttatgcacaataacctctgtaacggcagtttctttcatggtcacagctcatcagtctagcactgtctcgatttatggttttatgcttcccgttcgctctaagtggtctttctctcactcttttgagtatttagttggagtatcagctgctgttgctgcacactccttgctgcaactgttaattagcatgtcaagattgctcaggaaatctccagtgattccatcaagaagtcatgcatggcttattttcgcaggagatcaggtttttgcatatgcaatgattagtgctggggccgctgcatccggggtcaccaacctgaaccgcacaggaattcaacacacagctttgccaaatttctgcaagcctttaaattacttttgtaaccatgttgcggtctctatagccttcgctttcatcagttgcttgttgctcgctgcgttagctgttcaggaggtcatctggctctccaagtccaagtattgaagtttgttttgcctcccatactatggatgcttactgggtttgtacacctgtaggaaaatactgctggctctatttagttctggtgatcttctagttcttcagtggaaattttgtagtctatcatatttacagttgcctttgtaaagagcaagatgggtgtaacttttactcgcaccatatccaagttcagcgacctatgatcggattgttcaatctttatctgctaatgggactagtatatatatatatatatatatatatatatatgttcaatgtagtaattggttctagcaagcccctggtttttgattgctcaaatctcaattattaacagtaataattggtaaaaggcctcggaattatattcatatcaattagttgaatgactaatctttctacccatgtctttgccattttaatagcattagcactcttcaacttctttggaccagcttctttgacattcatttgtagagttaaatttaagaaatgctgccgtgctttgtgaagaataattgaattggaagatagctggatggcatggcataatcattgagtttgttgttggcaatctcaacatgctaaaataatattggcttgtcttttcttttctcaaccatttgtctaaaagacttgtcgtttgacatcctccactttttgtcttctcaaatgggactgctcgaggaagcatagcgtaaataacttgttactttaaatcaaacccgtttgcctgcttgaattctccagctatcaaacgacgtatcgttcttcaaccacgagtcgtcaagctagttgaagccgattgtcgttcaatccaatttgcggaacgatgcgttttaagctgcgcctccatttcttctgtaaacaaacacaaccggctctctctgtctctatctctatctgcaagctccaaaaacaataatctttctccgaaattacaatttgattcaattcgataaatgcaagagctattctcctactgctatcatacttgcaccctctccacaatgtaagtttctcttttttatactgtctctttaaattcttttaactcatctttattacattttcattatcatggccagccattttccttttagctcttcactttatccgaaaacctacaatcataatccccgtaagtttctgctgaggcacccaactttcccttccatttcatgtcaaaaacaaaacccaattcttgaaaacgacaatgaaaccactaaaacatatgcagatagtaggaaaacccatttcaattttctgactttacccataactctcactgtaatctccacttctttcacagcacaacctgctcttgctgctgtttcaacagcgaaaacaacccgtaaaaagaaaacccagaagaaagcaccccaagaaacattaacacctgatcagcttaaacaatggtctaaagatctcccaattgtagcaaatagaataccgtatactgaagttttgaagtttaaagaaactaataagcttaaacatgtaattaaagctcctaaggcttgtctgaaacaacaagctgaagctgtattagttgttttggatggtaatcaagtttttaggactgtcttgccttcttttgtgagtaataagaggttctgggattcatgggatgagttaaagattgatgcattgtgcattaatgcttatactcctccggttaaaaaaccagagatgcctaagccgtatttagggttcttatggaaagtcccagagtttttgttgtctaagtttaagcgtaagaaggagtcaaggagagctatggagttgagaagagcaagagaagagtttaagaggcaaagaaaagaggagttagcaagaatgagggaagagcgggaaatgattgaaaaggcaataaaaatgcaaaagaaggaggagcagaggagaataaagaaggagattaggaaaaagaaatatgaggagtcactgcgtgatgcagagagaaattacacacgaatggcaaatatgtgggctgatttagcacaggactcaaatgtggctacatttttaggactggtattttttgtgatattttatcgcacggtggtgcttagttatcgaaaacagaagaaggattatgaagatcgcctgaagattgagaaggcagaggcagaggagaggaagaaaatgagggagctggagagggagatgatgggaattgaggatgaggaagaagacgagagtgagcaagggaaaggtgagaaaaatgcttatttgaagatggctatgcagttcatgaggtcaggtgctcgtgttaggcgtgcccataataggagattacctcagtacttggagaggggtgtggatgtgaagttctcggatgttgcaggacttgggaaaatccgacttgagcttgaggaaattgtgaagtttttcacacatggggagatgtatcggaggagaggagtgaaaataccaggtggcatacttctatgcgggcctcctggggtggggaaaaccttgctggcaaaagctgtggctggtgaggcaggtgtgaacttcttctccatttctgcatctcaatttgtggaaatatatgttggagttggtgcttctcgtgtccgatcgctttaccaagaagcaaaggaaaatgccccatccgttgtctttattgatgagctggatgctgttggaagggagcgtggtttgattaaaggttctggtggacaagaacgtgatgctacacttaatcagcttcttgtatgcttggatggatttgaaggaagaggggaagtgattactattgcttccaccaatcgaccagacattctagatccggcacttgtgagacctgggcgctttgatcgaaaaatttatatccccaaacctggccttataggacgtatggaaatcctaaaggttcatgctcgtaaaaagcctatggctgatgatgtggactacatggctgttgctagtatgacagatgggatggttggtgctgagttggccaacataattgaggttgctgcaattaatatgatgcgcgatggaaggaccgagatgacaacagatgacttattacaagctgcacaaatagaagagagaggaatgctggataggaaggaaagaagccctgggacttggaagcaagtggctattaatgaagcagccatggcagttgtagctgtgaactttccagatcttaaaaatatcgagtttgtcacaatttctcctcgagctggaagggaactaggctatgttcggatgaaaatggatcacgtcaaatttaaggagggaatgcttagtcgtcaatccctcctggatcatattactgttcagatggcaccacgtgcagctgatgagctttggtatggcgagggtcagttgagtacaatatgggcagaaactgcagacaatgcgaggtcagcagcaagaacctatgtcctcggtggcctttctgagaaacattatggccagtttgacttctgggttgcagatcgaattaatgaaattgatttagaagcactacggattctcaacttgtgttacgaacaagctaaagagatactgcagagaaaccataagctgatggatgctgttgtagatgaacttgttcaaaagaaaagtttaacaaaacaagaattttttcatctagttgagttgtatggctctatcaaacctatgccgctaagtatacttgatctcagggctgccaaacgtgaagagtttcaaaaaatgatgatgaaccagaaggaaaaaaccgcgagcaatttataagcgagataccaagagaactctggtaacgaactcgatcattgtttttgggatggcaacgcggagattagccaaggaaagttacctgtcgccttcgattgatgatgcaaattgcagaatagctatggccgtattctgcagttccgactttggatcagaagtgtgatcgaatgctgaattgctctgaccacggcggaagtgttctgatgactcagaagaactgggttcaattcagctgtaatccaattgaagtgttttcttctcttttctattcatatgttccttactaaaagattaactaaattgcgggcaactcatttttcctatttttcgttttgcctcgtcatgtacataaaatctgaccttattattattattaggccaaatgtatatttggatattttatattttctaaataacattgaagcttattctttttaaaaagaataatattgaaacactttttatcatgtg

SEQ ID NO: 1977 - DNA, 2926 bp, Prunus persica
ctttcacaaaccaaaactccatggcctgccaatgccttctgggctcttactcatcttcttctctatccccaaaccccaaacccaaaaccctcaataaaaacccaccaaaacctctcgctccatcctccatttcctcccacctctcaaccacggatgataatgatgaaaacgataaaacccacaaacccaatttcgatttcctcaagctttctgtaactctcactgtaatctccaccgctctcccccaaatcccaaccggcatagccgccgtcaaagagaaaaagcgagtgcccaagaagtccacgctcaaaaaatccgaagctttatctcatcaagagctccagtcttggtcccaaggcctccccgtcgtctccaatcgaattccgtacacccagctcttgatattgaaccaggaaggtaagctcaaacatgttatcaagcctcctggtgttgaattgcaaaaaagggtagagcccgtattggttgttctcgaagataatcgggttctacgcaccgttttgccttcggtggatagcgataggaggttttgggaacaatgggaagagttgaaaatcgagtctttgtgcgtcaatgcctatacgccgccgcttaaacggccggaggttccgtcaccgtacttgggttttgtggcgaaatggccggcgtttttgtcgtcatttgtgaagccgaagaaggagagcaagagagctatggagaattatctggagatggccaatgtatgggccaatttggctcaggactccaatgttgccactgcgcttggactggtgttcttctatattttttacaggaccgtagtgtttagttataggaggcagaagaaggactatgaggataggttgaagattgaaaaggcggaggcggaggagaggaagaaaatgagggaattggagagggagatggaggggattgagggtgaggaggaggaggagattgagcaagggaagggtgagcaaaacccttatttgaaaatggctatgcagttcatgaagtctggggctcgggtgcgacgagctcataataagaggctgcctcagtatttggagagaggcgtggatgttaagttttcggatgtagctggccttgggaagatccggcttgagcttgaggagattgtcaagttcttcactcatggtgaaatgtataggagaagaggagttaaaataccaggtgggatacttctttgtggccctcctggagtgggtaagaccttgcttgcaaaagctgtagctggtgaggcaggcgtcaacttcttttccatttcggcctctcagtttgtggagatatatgttggggttggtgcatctcgtgtccgagcactttatcaggaagcaagggaaaacgctccatcggttgtcttcattgatgagttggatgctgttggaagggagcgtggtttgatcaagggttctggtgggcaagaacgtgatgctactcttaatcagctccttgtttctttggatgggtttgaaggaagaggtgaagtgatcactattgcttccacaaatagaccagacattctagatccagctcttgtcagacctggacggtttgatcgaaagatatatatccctaagcctggtcttataggtcgcattgaaattttgaaggtccatgcacgcaagaagcctatggctgaagacgtggactatatggctattgctagtatgactgatggaatggttggtgcagagctagctaacatagttgaggttgccgcaatcaacatgatgcgtgatggaaggactgagattactactgatgacctattacaagctgcacaaatggaagaaagaggaatgctggataggaaggagagaagtttagatacatggaagcaagtagctattaatgaggccgctatggctgttgttgctgtgaactatcctgaccttaaaaatattgagttcgtcacaattgctcctagagctggcagggagttgggttatgtgagaatgaaaatggatcctatcaagttcaaagaaggaatgcttactcggcaatcactcctggatcatatcactgttcaactggcaccacgtgcagctgatgaactttggttcggtgaggatcagttaagtactatatgggctgaaacggcagacaatgctaggtcagccgcacgaacgtatgttcttggtggcctttcagagaaacatcacgggctatctaatttctgggttgcagatcgactcaatgaccttgatacggaagcattgcaaattgtcaacatgtgttatgaacgtgcaaaagagattctgcggaaaaatcgaaagctcatggatgcggtggtggatgaacttgtccagaagaagagtttaaccaaacaagaattctgtagcctagttgagttacatggttcaatcaaacctatgccacctagcatacttgacatcagggctgccaaacggaagcagttccaagatatgatgatgaaccaaaaggaaccagctttggggagcaacttatgaataagatgtggagatatggtagattcttaattatcttcgatgtggacgaagcaaaacatatgagtcaggcgtgtcatttaaagcggtgattgatttcgcgagcatcttgtccaatgattgatatttatcatgctcggcagcccgggtgagcaggttgtggaaccctatctgtttatcataaaagaaatattggggaagtcatgcgaagaaacgttaatctgagggagaagcagccttcagtattcttttgttcgatttgtaatttacaagtgttctgtctcatttgcatcctaccccgtctttattcgatttacttggctacttggacggaatggttctagtagctcaattcggtcaaattttttttgtatggatgcttaggtataaactagtctctctgcatttattttgctcctgcaagaggtttttttaaa

SEQ ID NO: 1978 - DNA, 3186 bp, Gossypium raimondii
gtcgtttaacactaaggttgaatattcttgttggtcggagacgcagttttttatccgggagaggttttgaagagaaggaagaaaagaataaaatgctgtgtcttaggcttcgtattcgactaaatcgaatgttcaataaccttaactacaatgtctcagtttcgtttcactacgtaagtctatctctttcgatctcttaacatagtgaaattcttttctgttcattttcactcataattctcttcactttttttttcttcattattttttcatggcttatcatttctcttttggttcttcattgtacccaaagcttccatctttaaaacccaaacttcaaaacccatttttcttcagctcttacccttcaatttcttgtcaaatttatagctctaagagcaatagttccgatgatgatgataaagccaagaaaacccatttcaattttgttgctttacccattactcttactataatctctacttcatttccacaacaaagttctcttgctgcagttaaagtatctgataggaaaaaaactcagaaaaaaacccaagaagctttgacccctgagcagataaaacaatggtcgaaaaatctccctattgtaaccaaccggattccatatactgaaattctcagtttgaaacatgagggaaagcttaaacatttaattaagccgcctagtgctagtttgaagcaaagggcagagccagttttagtagttttagaagattctagggtgttaagaactgttttgccttcaatagatagtgataggaagttttgggattcatgggatgagttaaagattgaatctttctgtgttaatgcatatacacctccaattaagaggcctgaggtgccttctccttatttgggatttttatggagggtgcctgcatttatgttgtcgtggtttaagccgaagaaggagtccaaaagggcgctggaaattaggagacaaagagaggagtttaagaggcaaaaaacggaggagttggcgagaatgagggaagagagagagatgattgaaaagatgatgaaggcgcagaagaaggaggatgagaggagaaagaagcgagagattaggaagaggaagtatgaggagtcattgcgtgatgctagaaggaattatcaaagtatggcaaatatgtgggccagtttagctcaggattcaaatgttgcaactgcgcttggattggtgttctttgtgatattttataggacagtggtgcttagttacagaaagcagaagaaggattacgaggataggttgaagattgagaaggcagaggcagaagagagaaaaaagatgagggagttggagagggaaatggaaggaattgagggggaggatgatgaggctgagcaagggggaggtgagcagaatccttatttgaaaatggctatgcaattcatgaagtcaggagcacgtgtgcggagagcacaaaataagagactgccacagtatttggagagaggagtggatgtcaagttctcagacgttgcaggtcttggcaaaatccggcttgagcttgaggaaatagttaagtttttcacacatggggagatgtaccgaagaagaggagtaagaataccaggtggaatacttctttgtggccctcctggggttgggaaaactttactagcaaaagctgtggctggtgaagcaggtgtaaacttcttctccatatctgcttctcagtttgtggaaatatatgttggggttggtgcatcccgtgtccgagcactttatcaggaagcaaaggaaaatgccccttcagtcgtatttattgatgagttggatgctgttggaagagagcgtggtttaatcaaaggttctggtggacaagaacgtgatgcaaccttaaatcagcttctggtatgcttggatggttttgaaggaagaggaaatgttatcactattgcttccacaaacagaccagacattctagatcctgcacttgtgagacctggacggtttgaccgaaaaatctttatccccaaacctggactcataggtcgcatggaaattcttcaggttcatgctcgtaagaagccaatggctgaggatgtggactatatggctgttgcaagtatgactgatggaatggttggtgctgagctggcaaacatagttgaggttgctgctattaatatgatccgtgatggaaggactgagattacaactgatgatttgctccaagcagcacaaatagaagaaaggggtatgctagataggaaggagagaagtccagagacatggaaacaagtggctataaatgaagcggcaatggctgttgtagctgtgaactttcctgatctcagaaatatcgaattcgtaacaattgctcctagagcaggtagggaattaggttatgttcggatgaaaatggatcatatcaaatttacggaaggaatgctaagtcgacaatccctccttgatcacataactgtgcaattagcaccccgtgcagcagatgaactttggtttggtgagggtcagttgagtacaatatggtctgaaacagcagacaatgctaggtcagcagcaaggatgtttgttcttggtggcctttctgagaaacatcatggattgtccaacttctgggttgcagatcgaattaatgagatagattcggaggcattgcagatagtgaacatatgctacgagcgagccaaagagatcttacagcagaaccgaaagctgatggatgcagtggttgatgaactggttgagaaaaagagtttaacaaaacaagaattctttggacttgtggaattgcatgggtcacttcagccaatgccacccagtatagttgacattagggttgccaagcgaactcagttccaagaaatgatgatgaaccccaatgtgaaggttacagggagtagttcttcataaaccaccacctatctacttcctattcacatgtataactttgcatcaatcacttccaggtcataccatcaggtttgattatttgtgcttgaagtttttcattactaattaactaataatatatacagattaaagagaaaaatcaaagggttcaatgagttaataggaaatgtaaaatactgatggtctatttggacactattgactagtgggatgaaagtgcaattattagattaatgaattttaattctattggcatattatttttaatgtcgtataaa

SEQ ID NO: 1979 - DNA, 3160 bp, Manihot esculenta
gcataattctctctccctccatcccgctctgaaatttcaatctcatgcaatcaaagcgagctccttttctaacatgctaacagcttctacaatgtgagttctactttatcttcactttgtttcattgaattcatctatatactttccattttcatggccagcaatttcctctttagctcttcgcccttccccaatgttcaaaagcctcgcaaatttctactaagaccacgcgattacccttccatttcttgccaaaaacaagacccgaatcctgaaaatcataatgaaacgagtaaaacgcataaagctaataaaacccatttcagttttcttgctgtacctataaccctcaccataatctcctcctctctctccccgcaacctgtccttgccgcagcagctaagacaggtcacaaaaagaaaacccagaaaaaaacacaagaatctttaaccttggacgagcttaaacaatggtctaaggatctcccaattgtatcaaatcgaattccatatactgaaatattgagtttcaaagaaagcaataagcttaagcatgtaattaaagcgcccaaagcatgttttagagaacgggcagaggctgttttagtggtttcggatgataataaagtttttaggactgttttgccttctctagagagtaataagaggttttgggatgcatgggatgagttaaagatcgatacaatgtgtgttaatgcatatactcctccggttaagaaaccggagctgcctaaaccatatttagggtttttgtggaaagttccagagttcatgttatctaagtttaagcctaagaaggagtcaaagagagctatggagttgaggaaaatgagagaggagattaagaggcaaaggaaagaggaattggcaagaatgagggaggagcgtgaaatgattgaaatgataataaaaattcaaaagaaagaggagcagagaaggataaagaggaagattaggaaaaagaagaataaggagtcattgctttatgcacaaatgaattctataaggatggccaatatgtgggctcagttggcacgtgacagaaatgtgtccacactgttaggggtggtgttttttgtgatattttaccggactgtggtgcttagttataaaaagcagaagaaggactatgaagataggctgaagattgagaaggcagaggcagaggagaggaagaaaatgagggagttggagatggagatgatggggattgaggaagaggaagagggtgagggtgaaggtgagcaagggaaaggggagcagaatgcgtacttgaagatggctacgcagttcatgaagtcgggtgcaagagttagacgtgcacataatagaagattacctcagtatttggagaggggtgtggatgtaaagttttcagatgttgcgggacttgggaagatacggcttgaacttgaggagattgtgaagtttttcacacatggggagatgtatcgaaggagaggagtgaggataccaggtggcatacttctatgtggacctcctggagtgggcaaaactttactggcaaaagctgtggctggggaggcaggtgtgaacttcttctccatttctgcatctcagtttgtggaaatatatgttggagttggtgcttctcgtgtccgatcactttaccaggaagcaagggaaaatgctccatctgttgtttttattgatgaattggatgctgttggaagggagcgtgggttgataaaaggttctggtgggcaagaacgtgatgctactcttaatcagcttcttgtatgcttggatgggtttgaaggaagaggggaagtgataactattgcttccaccaataggccagacattcttgatccagcactagtgagacctggacggtttgatagaaaaatttttataccgaaacctggccttataggccgcattgaaattttgaaggttcatgcccgtaaaaaacctatggctgatgatgtggactacatggctgttgctagtataactgatggaatggttggtgctgagctggccaacataattgaggttgctgcaattaatatgatgcgtgatggaaggactgagattacaactgatgacttgctacaagctgcacaaatagaagagagaggaatgctagataggaaggaaagaagccctgaaacatggaagcaagtagctattaatgaagcagccacggcagttgtggctgtgaactttcctgatcttagaaatattgagtttgtcactattgctcctagagctggcagggaacttggttatgttagaatgaaaatggatcatgtcaaattcaaggggggaatgcttagtcgtcaatcccttttggatcatatcactgttctactggcacctcgtgcagctgatgagctttggcatggtgagggtcagttgagtacgatatgggcagaaacagcagaccatgctaggtcggcagctcggacttatgttcttggtgggctttctgaaaaacattatggcctgtttgacttctgggttgcagatcgtatcaatgaaattgatctagaggcacttcggattctaaactcgtgttacgagcgtgctaaagagattctgcagcagaatcgagagctgatggatgctgttgttgatctactagttcagaacaaaagtttgtccaaacaagaattctttcatctggttgagttgcatggttctattaaacctatgccaccaagtataattgatctcagggatgccaagcgtgtagagttccaagaaacaatgatgaaccaaaaggaaaccactgtaagcaacttataagcgagatgccaagagaacccatctgaaaatgcccctgattccttggatctgcaatgatgggaatttgaggaagcagttgttgccttgtgtgacagttcaaattgcagagtagaaactacatttctgcaaaaaagctgaaagtgatgaaactagtaaactggtatgtaggggcatgcctagaggtcggcattgcacaagggatttttgacatttctataacctcagtggatttttttttacgacatcacaccattgtttcgggttgaattatactcgttcataaagtgcaaatttgatgttcttgatcattcatttaaatattttatcacttgatatagtgatagtttatcagtgtttatggagt

SEQ ID NO: 1980 - DNA, 3467 bp, Eucalyptus grandis
gtgatgagggaagaaaaattgttgccccggttctcttcccctatctatctccaagaactccgacgtctgttcatcttcttctactcagcgagcgcgcaagctgctctgctgctctgctgctcggcccagtacattgcggaatcgccctgaaggttgaaggaagcggttctcgtttcgcttcccccaggttgtccgatatacgtttcttcagcccggaatctttatatatgcacgtacttttcttgacgatgtagcgcttgcacgctgcgcataaaaagctatcaattcatggccttccattgcgatcttggttcttcgaccctcccctttcgcgcaattcgcaaacccaatttgaataaacccaaaaactcgtctttaatccccactcgccctccaattcgttgccggattcgtgccccggaaaatgggaacgaggggcaccatcctgaggacgaaacgaagagaccccagttcaatttcctgtcgatccctgcgactctgaccatcatctacgcctccctccctcagcccgccgcggcggctaccaaggtttcggagaagaagaggtcagccaagaaagcccccgaagcgttgaccccggagcagctgaaatcttggtccaaagggcttcctttagttactgatagaattccctatactgacattgtagaactaaagaaacagggcaagcttaagcatgtcataaagccacccgggattagtttaaggcaaagggtagagcctgttctggtagttttggaggattctagagtgttgaggactgtgttgccttctatagatgggaataggaaattttgggatatgtgggatcagttgagtattgattctgcttgtgttaatgcgtacacacctccggttaagaagccggatgtgcctgcaccgtatttggggttcatgtggagtgtgccgggatttatgttgaagctaatgcagcccaagaaggagtcgaagcgggcgatggagttgaggcagatgagggaggaattcaagaggcagaagaaggaggagttggctcggatgagggaggagagagagatgatcgagaaggcaatgaaaaagcagaagagagaggaggagaggcaaagtaagaaggagattaggaagaggaagtatgaggagtctttgcgcgaagctaggaagaattatcggcagatggcaattgtgtgggcggatttggcaggggacacaaatgtagcaaccgcactcggtctggtgtttttcgtgatcttctatcgaaccgtggtgttaagctataggaggcaaaaaaaggattatgaggacagattgaagattgagaaggcggaggcagaggagaggaagaaaatgagggagttggagagagaattggaaggaatagagggtgatgatgaggagattgagggaggagaaggaggagaacagaatccttatatgaagatggcaatgcagttcatgaagtcaggtgccagagttcggagggcacataataaaagactcccccagtatctcgagagaggcgtggatgtaaagtttactgatgttgcaggtcttgggaagataaggcttgagcttgaggagattgttaagtttttcacacatggtgagatgtatcggagaagaggagtgaaaataccaggtggtatacttctttgtggtccccctggtgttgggaagactttgctagccaaagctgtggctggtgaggctggtgtaaacttcttctccatttccgcttctcaatttgtggagatatatgttggtgttggtgcttctcgtgtccgtgccctttaccaggaagcgagagaaaatgctccatctgttgtcttcattgatgagctggatgctgtcggaagggaacgtggattgatcaagggatctggcggacaagaacgtgatgctactctaaatcagctccttgtatgcttagatgggtttgaaggaagaggggaagttattacaattgcctctacaaataggcccgacatacttgatcctgcactagtgagacctggaaggttcgatcggaagatctatatcccgaaacctggcttgataggtcgtgtggaaattcttaaggtccatgctcggaaaaaggcgatggctgaggatgtggactatcttgctgttgctagcatgaccgatggaatggtcggtgcagagcttgctaacattgtggaggttgctgctataaatatgatgcgtgatggaagaactgagatcactactgatgacttgctacaagctgcacaaattgaagaaagagggatgttagacaggaaagagaggagccctgagacatggaagcaagtggctattaatgaagcagctatggctgtcgtggcagtcaacttccctgatctaagaaatatcgagtttgtcactatcgctcctagagctggtagggaattgggttatgtgaggatgaaaatggatcatatgaagtttaaagaaggaatgctgagtcggcagtcacttctagatcatatcaccgttcaactagctccacgtgctgctgatgaactttggtatggcgagggtcagttgagcaccatatgggcagaaacagcggataatgctaggtcagcagcaaggacttatgttcttggtggtctctctgagaaacattatggagtcaccaatttgtgggtcgcagatcatattaacgaaattgatctggaggctctacggattgtgaatgaatgttacaatcgtgcaaaggagatccttcagctgaaccggaagcttatggatgctgtggttgacgaactggttcagaagaaaagcttaacaaaacaagagtttttccaactagtcgagctgcatggctcgctcaaaccaatgccacctagcatactcgacatcagggctgctaaacgagagaagtttcaggagatgatgatgatgaatcagaaggaagctgtcgtgggaaagcatgtgtgagcaacatggcgtggtttttttgttgatactgaaccattcgcatccccaaaagaatcgctctccagacaccatagtgggctcgaccatagcgcggaatggtcaaatcagtcaccacagccatcaccatcgactaacgaattggaagtaccgcttcggctcattggcaggttttaatactgagtccacttccattgccatttgaacgaactgatgggggaacgttttgagcttctccggcgtaggccaatttgtctgtcgtgcagcttgggaagaacaaaacggcatactcctgtatctcgtcgtccatccttttcctccgtagtgttttgtagtcggcgacatggaaatgcctctctcgaattcgctgtgttctctctatcagctaattgtgatggaatggcatgatgacaggaacaagttttggcgatcacgtttctgttcctccattcgttgatgaataagatagattgatacctacttcgaactggtgaagatttatgcagtcccagcgcgcatctctatttccc

SEQ ID NO: 1981 - DNA, 3214 bp, Vinca minor
gaattcactggaactccttctctgatacagatataacctacgtaattctactctgatccttcgttatttctttcattcatggcttgtcattttattctcagttcttcaattttatcgccctctattttacccgcgaaatcaatcaaaatgttattcaataaatcatagaatagtcccaagaactctacttttttgcttaaaaaacagtagaaattctgaaacccaactagaagaagaagattcagcaaaatctagaaggacccaatttgataatgtactcaaattctcagtaactttaactgtaatctctgcttcacttccccaaaaaccctcattagcagctaaattatctgaaaaaaggcgggcagctaaaaagtctgaagctttaaccccggagaattaaagaaatggtcacaaggtcttcctactgtgacccataggctgccctatactgaaattctggatttgaaaagggaaataggctaaagcggataattaagcagcctagcgctgcgtttaagaagcggccagaggtggttttggctgttttggaggagggttctaaggttgttaggatagtgttgccttcggttgaagctgacccgaagttttgggctcaatgggatgagttgaaacttgatcaagcttgtgtgaatgcttatagtccgccgttgaagaaacccgagattcctaaaccttatttggggatcttggggaagatcccgatgtggttgttttcgtttgttaagcctaagcctcagtcgaagaaagcattagagttgaagaggatgagggaggagtttaagaagaagcagaatgcagaattggggaagatgagagaagatatggaaatgatggagaaggcgtcgaaaatgcaaaagaaaatggaagagaggcagaggaggaaggagttgaagatgattaaggctgaggaatcatttcgaaaagcacagaagaattctgaggacatgtctaggttgtgggcaaatttagcgagtgattcaaatgttacgttggctcttgggtttgtcttcttcttcatattctatcaaactgttgttcttagttataggaaacagaaaagggattatgaggataggttgaaaatagagaaagcagaggcggaggagaaaaagaaaatgagggacctagagaaggaaatggcagggattgagggtgacgatgacgaagaggaaggcggaaaaggggagcagaatccctatatgaagacagcaatgcagttcatgaagtctggtgctcgtgtcagaagagcacatagcaagagacttcctcaatatttggaaagaggcgttgatgtgaagttctcagatgttgccggacttgggaaaattcgggaagaacttgaggagatagtaaagttttttacccacggggagatgtaccgcaggagaggaattaaaataccaggaggcattcttctttgtggtccacccggagtggggaaaactttgttagcaaaagctgttgctggtgaggcaggcgtgaacttcttttccatttctgcatctcaatttgtagaaatatatgttggtgtaggggcttctcgtgttcgtgcactttaccaagaagcacgggaaaacgccccttccgttgtattcattgatgagttggatgctgttggaagggaacgtggtttgattaaaggttctggtggacaagaacgtgatgctactctgaatcagcttcttgtgtcgttggatgggtttgaaggcagaggtgaagtgatcactattgcttccacaaatagaccagacattctggatccagcacttgtgagacccgggcggtttgatcggaagatatatattcctaagcctgggttgataggtcgaattgaaattctcaaggtacatgctcgtaagaagccaatggcgccagatgtagactatatggctgttgctagtatgactgatggaatggttggtgctgaattagccaacattgttgaggttgctgctattaatatgatgcgtgatgaaagaactgagataacaactgatgatttgttacaagctgcacaaatggaagaaagaggaatgctagatcgaaaagagaggagcctagaaacatggaagcaagtagctattaatgaagcagccatggccgttgtggctgtgaactttcctgaccttagaaatatagagtttcttacaattgctccacgagctggtagggaactgggttatgtgcgtatgaaaatggatcatgttaaatttaagtcaggaatgctgagtcggcaatccctcctagatcatattaccgtccaattagcaccacgagcagccgatgagctatggtatggtgagggccagttgagcacaatatgggcagagacagcagataacgcgaggtcagctgctcgtactttagttcttggtggtctttcagaaaaatactatggtttgaacaacttctggactgctgaccgcataaatgatattgattctgaggcattaaggatcataaatatgtgttatgaacgtgcaaaagagatactccagagaaaccgaggtctcatggatgttgtggttgatgaacttgtcgagaagaaaagccttacaaagcaagaatttttcagcttggttcagttgcacgggtctgttcagccaatgccgccaagcattattgatatcagggcagctaagcggttagagttgcagaacgtgttgagggaccagaacgaagcatctcaaaagagcgtatgagtcataacgaacgatctatcattcttatctgagatcctttagatttctaaagaagactagagccacttccgctgatgtttatagagaacctatcccaatatcctcggagccatagatagtcagttcgtgtttgaagtccgagcaagctttgtgtttcctctcggcaaaattgcaaggatgagtggggggcggtttctcggaggaggatagctcataatttgaagcccaggattctgaaggacttgagtgcagaagacttggcttctttctatgttcttagggtggttgattggttgttgtttcatatagtaagtatatccttaaatcaaccatttttaaggtaatgcctaaatagacaacttttgttataaaatcctcggttctaaccgcgcacacatgatctagtcggaaattttagaacgagacattcaattttggatattccagtaagataaatgagacgttcactcttggcccggcccaattta

SEQ ID NO: 1982 - DNA, 2641 bp, Gossypium hirsutum
aaaacccatttttcttcagctcttacccttcaatttcttgtcaaatttatagctctaagagcaatagttccgatgatgatgataaagccaagaaaacccatttcaattttgttgctttacccattactcttactataatctctacttcatttccacaacaaagttctcttgctgcagttaaagtatctgataggaaaaaaactcagaaaaaaacccaagaagctttgacccctgagcagataaaacaatggtcgaaaaatctccctattgtaaccaaccggattccatatactgaaattctcagtttgaaacatgagggaaagcttaaacatttaattaagccgcctagtgctagtttgaagcaaagggcagagccagttttagtagttttagaagattctagggtgttaagaactgttttgccttcaatagatagtgataggaagttttgggattcatgggatgagttaaagattgaatctttctgtgttaatgcatatacacctccaattaagaggcctgaggtgccttctccttatttgggatttttatggagggtgcctgcatttatgttgtcgtggtttaagccgaagaaggagtccaaaagggcgctggaaattaggagacaaagagaggagtttaagaggcaaaaaaaggaggagttggcgagaatgagggaagagagagagatgattgaaaagattatgaaggcgcagaagaaggaggatgagaggagaaagaagcgagagattaggaagaggaagtatgaggagtcattgcgtgatgctagaaggaattatcaaagtatggcaaatatgtgggccagtttagctcaggattcaaatgttgcaactgcgcttggattggtgttctttgtgatattttataggacagtggtgcttagttacagaaagcagaagaaggattacgaggataggttgaagattgagaaggcagaggcagaagagagaaaaaagatgagggagttggagagggaaatggaaggaattgagggggaggatgatgaggctgagcaagggggaggtgagcagaatccttatttgaaaatggctatgcaattcatgaagtcaggagcacgtgtgcggagagcacaaaataagagactgccacagtatttggagagaggagtggatgtcaagttctcagacgttgcaggtcttggcaaaatccggcttgagcttgaggaaatagttaagtttttcacacatggggagatgtaccgaagaagaggagtaagaataccaggtggaatacttctttgtggccctcctggggttgggaaaactttactagcaaaagctgtggctggtgaagcaggtgtaaacttcttctccatatctgcttctcagtttgtggaaatatatgttggggttggtgcatcccgtgtccgagcactttatcaggaagcaaaggaaaatgccccttcagttgtatttattgatgagttggatgctgttggaagagagcgtggtttaatcaaaggttctggtggacaagaacgtgatgcaaccttaaatcagcttctggtatgcttggatggttttgaaggaagaggaaatgttatcactattgcttccacaaacagaccagacattctagatcctgcacttgtgagacctggacggtttgaccgaaaaatctttatccccaaacctggactcataggtcgcatggaaattcttcaggttcatgctcgtaagaagccaatggctgaggatgtggactatatggctgttgcaagtatgactgatggaatggttggtgctgagctggcaaacatagttgaggttgctgctattaatatgatccgtgatggaaggactgagattacaactgatgatttgctccaagcagcacaaatagaagaaaggggtatgctagataggaaggagagaagtccagagacatggaaacaagtggctataaatgaagcggcaatggctgttgtagctgtgaactttcctgatctcagaaatatcgaatttgtaacaattgctcctagagcaggtagggaattaggttatgttcggatgaaaatggatcatatcaaatttacggaaggaatgctaagtcgacaatccctccttgatcacataactgtgcaattagcaccccgtgcagcagatgaactttggtttggtgagggtcagttgagtacaatatggtctgaaacagcagacaatgctaggtcagcagcaaggatgtttgttcttggtggcctttctgagaaacatcatggattgtccaacttctgggttgcagatcgaattaatgagatagattcggaggcattgcagatagtgaacatatgctacgagcgagccaaagagatcttacagcagaaccgaaagctgatggatgcagtggttaatgaactggttgagaaaaagagtttaacaaaacaagaattctttggacttgtggaattgcatgggtcacttcagccaatgccacccagtatagttgacattagggttgccaagcgaactcagttccaagaaatgatgatgaaccccaatgtgaaggttacagggagtagttcttcataaaccaccacctatctacttcctattcacatgtataactttgcatcaatcacttccaggtcataccatcaggt

SEQ ID NO: 1983 - DNA, 3183 bp, Vitis vinifera
atgcattcaccgaaaggctactgtcaagtaactgagtctgggacgggcttggactgtcccctaccaaactaccctctccactccatctgtgataaaaccctttggaatttcaaagccctaattctcaaatccacatcccaccgaagctttctgctactccaatggcgcttccaccaattcttcatcactctcactttcattaaacttctccacagcggtcccatggccagtcactgtattctcaattctccgcattttccctgtctcccatttctctcccgccccaaaatcagaaccaaaacaaaaaatttagctattcgtccaccaattatctcataccacttctccacttctcaaccccaagaatatgaagataacgacaaggaaagcaaaaaggcgaagcaaaacccttgcaatttcctcaacctctccataactctcaccatcatttccgcctctctcccccaaccctccctcgcagccgctgccgccggaaaatcagcagggaaaaagcgttcctcgagaaaaccagaagcgctgacaccccaagaactgaaatcgtggacagaaggacttcccgttgtgacggaccgtgttccgtatacggacattttggatttgaaacgagagggaaagcttaagcatgtaattaagccgcccggtggacctggggtcgggctgaggcagagggcggaggccgttttggtggttttagaagattctagggttttgaggacggtggtgccctctgtagagaaggataggaggttttgggaaatgtgggatgagttgaagattgatagcgtttgtgtgaatgcgtatagtccgccagtgaaggggccggagctcccagtcccttatttagggttcttgtccaggataccggcatatatgttttcatttgtgaaaccgaagcctgaatcaacgcgtgatgcaaggaggaaatatgaacgtatggcaaatttttgggccaatttggcggcggactcaaatgtggcaactgcacttgggtttgtgttcttttacatattttataggacggttgtcttaagctataggaagcagaagaaagattatgaggatagattgaaaattgagaaagcagaggcagaggagaagaagaaaatgagggaactagagagacagttggagggaattgagggtggggaagatgagagtgagattgtgggaggtgagcagaatccttacatgaagatggctatgcagttcatgaagtccggagctcgtgttcgcagggcacataataagagactccctcaatatttagagagaggtgtggatgtgaagtttactgatgttgctggacttgggaagataaggcttgagcttgaggagattgtgaaattttttacacatggtgaaatgtatcgtaggcgaggagtgaaaataccagggggcatacttctttgtggccctccaggggtggggaagactttgctcgcaaaagctgtggcaggtgaagcaggtgtgaacttcttctccatctctgcttctcagtttgtggaaatatatgttggggttggtgcttctcgtgtacgggcactttaccaagaagcaaaggaaaatgctccatctgttgtcttcattgatgagctggatgctgttggcagggagcgtggtttgatcaagggatctggcggacaagaacgtgatgctactcttaatcagcttcttgtttgtttggatggatttgaagggagaggaaacgtgattactattgcctccacaaatagaccggatattttggatccagcacttgtgagaccaggacggtttgatcgaaaaatttatattcctaagcctggcataataggacgcattgaaattctgaaggttcatgctagaaagaagccaatggctgaggatgtggactatatggcagttggtagtatgactgatggaatggtcggtgcagagctagccaacattattgagattgctgccattaacatgatgcgtgatggaaggagtgagattacaaccgatgacttattacaagcggcacaaatagaagaaagaggaatgctggatagaaaggagagaagccctgagatgtggaagcgagtagctattaatgaagcagcaatggctgtagtagctgtgaactttcctgatctaaaaaatattgagtttgtcacaatttctcccagagctggcagggaattgggttacgttcggatgaaaatggatcacatcaagtttaaggaaggaatgcttagtcggcaatccctcctggatcatatcactgttcaactagcaccgcgtgctgctgatgagatttggtatggtgaagatcagttgagtaccatatgggctgaaacagcagataatgctagatcagcagcaaggacctttgttcttggtggcctttctgagaaacatcaagggttatctagcttctgggtcgcagatcgaattaatgatattgatttggaggcattgcggatcttagaagtttgttatgaacgtgcaaaagagatcctgaagcagaatcgaaaactcatggatgctgtggttgatgaacttgtccagaagaaaagtctgaccaagcaagaattttttcgcctagttgaggtgcatggctctcttaaacctatgccacctaatattcttgatatcagggctgccaagcgtatacaattccaagaaaggatgatgagccagagagaggcagcagtagggaagaacatttgagcacagtaccaagagaactatctgacagcatggttagcaccataaactgagacctggtgtttttcgcacaaagcagagtcaacatgttaaacaagacctggcaaattaattcagttctgaaggaagaatacagcttgatactgaggaagccgggccatcgctgccaaataaaactcattcacagtgtgggcataagttggtggtcatctaaatgcgatttgattcagaattcaattctgctctgccctaatcataacaattgggcactgagattttgttgttatattacacagtttcaattgatttcatatgaggaacacgggttatatgtggtatgttgtttcaatcttcacatgatatgccaattttgaactgattgggtttccttagcttcttgaatggaatggtgaaaacaaattaggtcattatgatatgtttatgcttcaattaaaccctcggagatgagag

SEQ ID NO: 1984 - DNA, 3106 bp, Gossypium hirsutum
ttgtcttaggcttcgtattcgactaaatcgaatgttcaataaccttaactacgatgtctcagtttcgtttcactacgtaagtctatctctttcgatctcttaacatagtgaaattcttttctgttcattttcactaataattctcttcactttttttttcttcattattttttcatggcttatcatttctctttggttcttcattgtacccaaagcttccatctttaaaacccaaacttcaaaacccatttttcttcagctcttacccttcaatttcttgtcaaatttatagctctaagagcaatagttccgatgatgatgataaagccaagaaaacccatttcaattttgttgctttacccattactcttactataatctctacttcatttccacaacaaagttctcttgctgcagttaaagtatctgataggaaaaaaactacaaaaaaaaacccaagaagctttgacccctgagcagataaaacaatggtcgaaaaatctcccaattgtaaccaaccggattccatatactgaaattctcagtttgaaacatgagggaaagcttaaacatttaattaagccgcctagtgctagtttgaagcaaagggcagagccagttttagtagttttagaagattctagggtgttaagaactgttttgccttcaatagatagtgataggaagttttgggattcatgggatgagttaaagattgaatctttgtgtgttaatgcatatacacctccaattaagaggcctgaggtgccttctccttatttgggatttttatggagggtgcctgcatttatgttgtcgtggtttaagccgaagaaggagtccaaaagggcgctggaaattaggagacaaagagaggagtttaagaggcaaaaaggaggagttggcgagaatgagggaagagagagagatgattgaaaagatgatgaaggcgcagaagaaggaggatgagaggagaaagaagcgagagattaggaagaggaagtatgaggagtcattgcgtgatgctagaaggaattatcaagtatggcaaatatgtgggccagtttagctcaggattcaaatgttgcaactgcgcttggattggtgttctttgtgatattttataggacagtggtgcttagttacagaaagcagaagaaggattacgaggataggttgaagattgagaaggcagaggcagaagagagaaaaaagatgagggagttggagagggaaatggaaggaattgagggggaggatgatgaggctgagcaagggggaggtgagcagaatccttatttgaaaatggctatgcaattcatgaagtcaggagcacgcgtgcggagagcacaaaataagagactgccacagtatttggagagagtagtggatgtcaagttctcagacgttgcaggtcttggcaaaatccggcttgagcttgaggaaatagtcaaatttttcacacatggggagatgtaccgaagaagaggagtaagaataccaggtggaatacttctttgtggccctcctggggttgggaaaactttactagcaaaagctgtagctggtgaagcaggtgtaaacttcttctccatatctgcttctcagtttgtggaaatatatgttggggttggtgcatcccgtgtccgagcactttatcaggaagcaaaggaaaatgccccttcagtcgtatttattgatgagttggatgctgttggaagagagcgtggtttaatcaaaggttctggtggacaagaacgtgatgcaaccttaaatcagcttctggtatgcttggatggttttgaaggaagaggaaatgttatcactattgcttccacaaatagaccagacattctagatcctgcacttgtgagacctggacggtttgaccgaaaaatctttatccccaaacctggactcataggtcgcatggaaattcttcaggttcatgctcgtaagaagccaatggctgaggatgtggactatatggctgttgcaagtatgacagatggaatggttggtgctgagctggcaaacatagttgaggttgctgcaattaatatgatccgtgatggaaggactgagattacaactgatgatttgctccaagcagcacaaatagaagaaaggggtatgctagataggaaggagagaagtccagagacatggaaacaagtggctataaatgaagcggcaatggctgttgtagctgtgaactttcctgatctcagaaatatcgaattcgtaacaattgctcctagagcaggtagggaattaggttatgttcggatgaaaatggatcatatcaaatttacggaaggaatgctaagtcgacaatccctccttgatcacataactgtgcaattagcaccccgtgcagcagatgaactttggtttggtgagggtcagttgagtacaatatggtctgaaacagcagacaatgctaggtcagcagcaaggatgtttgttcttggtggcctttctgagaaacatcatggattgtccaacttctgggttgcagatcgaattaatgagatagattcggaggcattgcggatagtgaacatatgctacgagcgagccaaagtgatcttacagcagaaccgaaagctgatggatgcagtggttaatgaactggttgagaaaaagagtttaacaaaacaagaattctttggacttgtggaattgcatgggtcacttcagccaatgccacccagtatagttgacattagggttgccaagcgaactcagttccaagaaatgatgatgaaccccaatgtgaaggttacagggaggagttcttcataaaccaccacctatctacttcctattcacatgtataactttgcatcaatcacttccaggtcatacgatcaggtttgattatttgtgcttgaagtttttcattactaattaactaataatatatacagattaaagagaaaaatcaaagggttcaatgagttaataggaaatgtaaaatactgatggtctatttggacactattgactagtgggatgaaagtgcaattattagattaatgaattttaattctattggcatattagttttaatgtcgtaaaaaagaaaaaagtaccgactgcg

SEQ ID NO: 1985 - DNA, 2926 bp, Cajanus cajan
ggtcttcgtcaccaatggctgcaccaacaaacccatagccgagaatgtaacagcagcattccatggcctcacattgcttccttcgttatccttcccctaaccccaaattcaaaacccttcccaaacccccttaccacccttccgtctcctcgcgaattcaaaccccacaacccgacaacgacaacgacaacgacgccaccaatccccaaaacgacaaccgctttgacttcctcaaactcaccgtaaccctcaccatcatctccgcctccctcccccaacccgccgccgctgctgccgccaccaggggaaagaaacggccgccgcgaaaacaatcctccaaaaaactcgaagctctctcgccggaggagctccggacatggactcagggcctccccgtggtctccgatcgccttccctacagcgaaatcctggacttgagaaaaaacgggaagctgaagcacataattaagcctagttccgcgaacttgaggctaaggggtgaagcagttctcgtggttttggacgattcgagagtgttgaggacagtgctgccttcgtttgagagccatagcatgttttgggattcatgggatgagttgaagattgattcattgtgtgtgaatgcgtacacgccacccattaagaggccagagtggcccccttctcttttgtccatgatttgggtgcccccttttgtgaagaatttctttgttaacatttttgaagatagggagagaaagcccaagaaggagtccaggaagatcgcagagtataggcaaatgaggatggatttgaagagggagaaggaagaagagatgaggaggttgagggaagagagggagaccatggagaggaacatgaggattcagaagaaggaggaggagaggaaaaggaagaaggagatgaggaagcggaagtaccaggaatcgttgcgccaggcgagtgagcgttacgagagaatggcgtatttttggtcggatttggccaacaatagcaatgtggctaatgcacttggggtgcttttcttctacattttttataggactgtggtgcttagttataggaagcagaagaaggactacgaggataggctcaagattgagagggctgaggctgaagagaggaggaagatgagggagttggagagggagatggaggggattgaaggtgatgatgaggagagtgagcaggggaaaggggaggagaatgcttatttgaaaatggcaaagcagtttatgaaatcgggagcgcgtgtgaggagagcgcagaacaaaaggcttcctcagtatctagagagaggagtggatgtcaagtttagtgatgttgctgggctgggtaaaattcgacttgaactcgaggagattgtcaagttctttactcatggagagatgtaccgaaggaggggagtgaaaattccaggtggcatacttctttgtggcccccctggagtgggaaagacattgctggcaaaagcagtggctggcgaggcaggggttaatttcttctctatttctgcttcacagtttgtggagatatatgtcggtgttggggcttctcgtgttcgagcactttaccaagaagccagggaaaatgctccatctgttgtcttcattgatgagctggatgctgtgggaagggagcgtggcttgattaaaggttcaggtggacaggaacgtgatgctactcttaatcagctcctggtgtgcttagatgggtttgaaggaaggggagaggtgatcactattgcatccactaaccgaccagacattctggatcctgcactagtgagacctggcaggtttgatcggaaaatatatattcccaaacctggcctcattggccgcatagaaattctaaaggtccatgctcgtaaaaagccaatggctgaagatgttgattacatggctgtagctagtatgactgatggaatggttggtgcagagttagccaacatagttgaggttgctgcaatcaatatgatgcgtgactcaaggaccgagattactactgatgacttattgcaagctgcacaaatggaagaaagaggaatgctagatagaaaggagagaagcagagagacatggaagcaagtcgccataaatgaagctgcaatggctgttgtggctgtgaactttcctgatcttaaaaatatagagtttgtcacaattgcccctagagctggtagggaattgggttatgttcgagtgaagatggattcagtaaaatttaatgaaggaatgctcactcgacaatcccttcttgatcatattactgttcaactagctccccgtgcggctgatgaactttggtttgggagtgatcagttgagtacaatatgggctgaaactgcagacaatgctagatctgcagcaaggacatttgttcttggtgggctttccgagaagtatcatggaatatccaatttctgggtgtcagaccgaattaatgacattgattcggaagcaatgaggattgtcaactcgtgttatgaacgtgcaaaagagatcctggagcaaaacagaacgctgatggatgctgtggtgaatgaacttgttgagaagaaaagcttaaccaagcaagaattcttccgtctagtagagttgcatggctccctaaaaccaatgcctccaagcatacttgacttacgagttgccaagtgtagcgaattccaaaaattgattaatagtgaaaaggaaacaagtttgaggagccatgcatgagaaattgcaggggcaaatgccccatcaattttgaggaataattctactataggcatatttactgcaccttattgatgtattatgttatattctttaccgcaactctgatggacgctgttccttgtttttcttcgttttggtggaaggccatgttagaacctgaattataaaaaaaaaaaaaaatgatgcattggaatgctcgactt

SEQ ID NO: 1986 - DNA, 3291 bp, Citrus clementina
cacttgggtcttcttctatccacacgctgtcacagaacgctgaagcttgattcctcttcgatgtcgattcaaccgaagctcaattgttttatttgctagctcgtcactcttatttcacaatgtaagtctttaaattcatttcattcccttcaatcatctcataaaaaaaaatactgtttttcacatttttattaaattaaagtatttacatttcatggcttgtaacttctcttttccttcttcactatcacttgatatttttcccacaaaacccaaatccaaaaaccctaagaacacacaaaagtttcaattttgcactccattttcatgcaaaaatcaaatctttaatcctgagaatgaggatagaaataaaaaccaaaattcaaagagaccgcatttgggtcttttaacaatacctgtaacgcttactataatctccacctcacttgcacaaaagcctgcttttgctgctacaaaagtggcctcaggtaaaaagaaaaaatctcagaaaaaaactcaagaagcattaacccctgaacagctgaaaaaatggtcaaaagacttgcctattgtgtcagataggattgcgtatactgaaatttttagcttgaaagacgagggtaagcttaaacatgtgattaaatcacctagtggtagtttaaggcaaaaagcagagcctgttttggtagttttggaggattctagagttttaagaactgttttaccatcattggatagtaataggaagttttgggaatcttgggatgagttaaagattgattctctgtgtgttaatgcgtatacgccgccgcttaagaaaccagaggtgcctaatccgtatttgggttttctgtggagagtgcctgcttctatgttgtcgacttttaggcctaagaaagagtcgaaaagggctgcggagattaggagagcaagggaagagcttaagaggcaaaggaaggaagaattggagaaaatgagagaagagagtgaaatgatggagaaggctatggacatgcaaaagaaagaggaggagaggaggaggaagaaggagattaggttgcaaaagtatgaggagtcactgcaagatgcaagggacaattatcggtatatggcaaatgtatgggagaatttagcaaaagattctactgtggcaactggactagggattgtgttttttgtgattttttatcgaacagttgtgcttaattataggaggcagaagaaggattacgaagataggttgaagattgaaaaggcagagagagaagagaggaagaaattgaggcagttggagagggagttggaggggctggagggtgctgatgatgagattgagcaaggagaagctgagcagaacccacatttgaaaatggctatgcagttcatgaagtcaggggcgcgtgttcgacgtgcatatggtaaggggctgccacagtatttggagagaggcgtggatgtgaagttctcagatgttgctgggctagggaagatacgtcttgagcttgaggagattgtcaagtttttcacccatggggagatgtatcggaggagaggagtgagaataccaggaggcatacttctctgtggtcctcctggtgtggggaagacactacttgcaaaagctgtggctggtgaggcaggtgtgaatttcttctccatttctgcctctcagtttgtggaaatatatgttggggttggtgcttctcgtgttcgctcactttaccaggaggccaaggacaatgccccatcagttgtattcattgatgagttggatgctgttggaagggagcgtggtttaatcaagggttcaggtggacaagagcgtgatgctactcttaatcagcttcttgtctgcttggatgggtttgaaggaagagggaatgtgatcactatagcttccacaaatagacctgatattctagatccagcccttgtgagacctggacggtttgaccgtaaaattttcatccctaaacctggccttattggtcgtatggaaattctgaaggtccatgctcgtaagaagccaatggctgatgatgtagactatctggctgttgctagtatgactgatggaatggttggtgcagaactagctaatatagttgaagttgctgctattaacatgatgcgtgatggaaggactgagattacaacggatgacttgcttcaagctgcacaaatagaagagaggggaatgctagatagaaaggagaggagccctgagacatggagacaagtcgcaatcaatgaagcagcaatggctgttgtagctgtgaacttccctgaccttaaaaatattgagtttgtaacgattgctcctcgagctggtagggagttgggttatgttcgtatgaaaatggaccacatgaaatttaaggaaggtatgctaagtcgacaatccttgttggatcatatcaccgttcaactagcaccacgtgcagctgatgagctttggtgtggcgagggccagctgagtacaatatgggcagaaacagcagacaatgctaggtcagcagcacggacctttgttcttggtggactttctgacaagcattttgggttatctaacttctgggtggcagatcgaattaacgaaattgatactgaggcattgcggattctgaacttatgttatgaacgtgcaaaagagatcctgcagcgaaaccgaaaccttctggatgctgtggtcaatgaacttgttgagaagaaaagtttgacaaaacaagaattctttcatctggttgagttgcatggttccctagaacccatgccgcctagtatagttgacatcagagctgccaagcgttcggagattcaagaaattatgaccacccagaatgtaacatccataggaagcaatgcatgagctaacgcagagataaatcatatgaccattacctgatctagagagaagccggagcatttgacttgggtattggctgtttgaagagcagtagtaatatattgttgaacggccaagaattctgtcagtggccgtgatgagcaagtgcaatagtcatggtaaaaagccatgggcatggatagatttccgaagcaattttgaagatacggcaacctctgtaaaaataatttgtattttccattttgtaatttgcagttgcaacttattcgttgaattctattaagattaatgatgcaagccaccaacatttgttgtaccaacacgcttgtacaaactgagttgacttatatggcaggtagggatgtaatcaacgtaaaactttattggattatttttattcaatgacatactttgacaaatggttc

SEQ ID NO: 1987 - DNA, 3290 bp, Citrus sinensis
cacttgggtcttcttctatccacacgctgccacagaacgctgaagctttattcctcttcgatgtcgattcaaccgaagctcaattgttttatttgctagctcgtcactcttatttcacaatgtaagtctttaaattcatttcattcccttcaatcatctcataaaaaaaaaaatactgtttttcacatttttattaaattaaagtatttgcacttcatggcttgtaacttctcttttccttcttcactatcacttgatatttttcccacaaaacccaaatccaaaaaccctaagaacacacaaaagtttcaattttgcactccattttcatgcaaaaatcaaaactttaatcctcagaatgaggatagaaataaaaaccaaaattcaaagagaccgcatttgggtcttttaacaatacctgtaacgcttactataatctccacctcacttgcacaaaagcctgcttttgctgctacaaaagtggcctcaggtaaaaagaaaaaatctcagaaaaaaactcaagaagcattaacccctgaacagctgaaaaaatggtcaaaagacttgcctattgtgtcagataggattgcgtatactgaaatttttagcttgaaagacgagggtaagcttaaacatgtgattaaatcacctagtggtagtttaaggcaaaaagcagagcctgttttggtagttttggaggattctagagttttaagaactgttttaccatcattggatagtaataggaagttttgggaatcttgggatgagttaaagattgattctctgtgtgttaatgcgtatacgccgccgcttaagaaaccagaggtgcctaatccgtatttgggttttctgtggagagtgcctgcctctatgttgtcgacttttaggcctaagaaagagtcgaaaagggctgcggagattaggagagcaagggaagagcttaagaggcaaaggaaggaagaattggagaaaatgagagaagagagtgaaatgatggagaaggctatggacatgcaaaagaaagaggaggagaggaggaggaagaaggagattaggttgcaaaagtatgaggagtcactgcaagatgcaagggacaattatcggtatatggcaaatgtatgggagaatttagcaaaagattctactgtggcaactggactagggattgtgttttttgtgattttttatcgaacagttgtgcttaattataggaggcagaagaaggattacgaagataggttgaagattgaaaaggcagagagagaagagaggaagaaattgaggcagttggagagggagttggaggggctggagggtgctgatgatgagattgagcaaggagaagctgagcagaacccacatttgaaaatggctatgcagttcatgaagtcaggggcgcgtgttcgacgtgcatatggtaaggggctgccacagtatttggagagaggcgtggatgtgaagttctcagatgttgctgggctagggaagatacgtcttgagcttgaggagattgtcaagtttttcacccatggggagatgtatcggaggagaggagtgagaataccaggaggcatacttctctgtggccctcctggtgtggggaagacactacttgcaaaagctgtggctggtgaggcaggtgtgaatttcttctccatttctgcctctcagtttgtggaaatatatgttggggttggtgcttctcgtgttcgctcactttaccaggaggccaaggacaatgccccatcagttgtattcattgatgagttggatgctgttggaagggagcgtggtttaatcaagggttcaggtggacaagagcgtgatgctactcttaatcagcttcttgtctgcttggatgggtttgaaggaagagggaatgtgatcactatagcttccacaaatagacctgatattctagatccagcccttgtgagacctggacggtttgaccgtaaaattttcatccctaaacctggccttattggtcgtatggaaattctgaaggtccatgctcgtaagaagccaatggctgatgatgtagactatctggctgttgctagtatgactgatggaatggttggtgcagaactagctaatatagttgaagttgctgctattaacatgatgcgtgatggaaggactgagattacaacggatgacttgcttcaagctgcacaaatagaagagaggggaatgctagatagaaaggagaggagctctgagacatggagacaagtcgcaatcaatgaagcagcaatggctgttgtagctgtgaacttccctgaccttaaaaatattgagtttgtaacgattgctcctcgagctggtagggagttgggttatgttcgtatgaaaatggaccacatgaaatttaaggaaggtatgctaagtcgacaatccttgttggatcatatcaccgttcaactagcaccacgtgcagctgatgagctttggtgtggcgagggccagctgagtacaatatgggcagaaacagcagacaatgctaggtcagcagcacggacctttgttcttggtggactttctgacaagcattttgggttatctaacttctgggtggcagatcgaattaacgaaattgatactgaggcattgcggattctgaacttatgttatgaacgtgcaaaagagatcctgcagcgaaaccgaaaccttctggatgctgtggtcaatgaacttgttgagaagaaaagtttgacaaaacaagaattctttcatctggttgagttgcatggctccctagaacccatgccgcctagtatagttgacatcagagctgccaagcattcggagattcaagaaattatgaccaaccagaatgtaacatccatagggagcaatgcatgagctaacgcagagataaatcatatgaccattacttgatctagagagaagccggagcatttgacttgggtattggctgtttgaagagcagtaatatattgttgaacggccaagaattctgtcagtggctgtgatgagcaagtgcaatagtcatggtaaaaagccatgggcatggatagatttccgaagcaattttgaagatatggcaacctctgtaaaaataatttgtattttccattttgtaatttgcagttgcaacttattcgttgaattctattaagattaatgatgcaagccaccaacatttgttgtaccaacacgcttgtacaaactgagttgacttatatggcaggtagggatgtaatcaacataaaactttattggattatttttattcaatgacatactttgacaaatggttc

SEQ ID NO: 1988 - DNA, 2023 bp, Cajanus cajan
aagaaggagatgaggaagcggaagtaccaggaatcgttgcgccaggcgagtgagcgttacgagagaatggcgtatttttggtcggatttggccaacaatagcaatgtggctaattcacttggggtgcttttcttctacattttttataggactgtggtgcttagttataggaagcagaagaaggactacgaggataggctcaagattgagagggctgaggctgaagagaggaggaagatgagggagttggagagggagatggaggggattgaaggtgatgatgaggagagtgagcaggggaaaggggaggagaatgcttatttgaaaatggcaaagcagtttatgaaatcgggagcgcgtgtgaggagagcgcagaacaaaaggcttcctcagtatctagagagaggagtggatgtcaagtttagtgatgttgctgggctgggtaaaattcgacttgaactcgaggagattgtcaagttctttactcatggagagatgtaccgaaggaggggagtgaaaattccaggtggcatacttctttgtggcccccctggagtgggaaagacattgctggcaaaagcagtggctggcgaggcaggggttaatttcttctctatttctgcttcacagtttgtggagatatatgtcggtgttggggcttctcgtgttcgagcactttaccaagaagccagggaaaatgctccatctgttgtcttcattgatgagctggatgctgtgggaagggagcgtggcttgattaaaggttcaggtggacaggaacgtgatgctactcttaatcagctcctggtgtgcttagatgggtttgaaggaaggggagaggtgatcactattgcatccactaaccgaccagacattctggatcctgcactagtgagacctggcaggtttgatcggaaaatatatattcccaaacctggcctcattggccgcatagaaattctaaaggtccatgctcgtaaaaagccaatggctgaagatgttgattacatggctgtagctagtatgactgatggaatggttggtgcagagttagccaacatagttgaggttgctgcaatcaatatgatgcgtgactcaaggaccgagattactactgatgacttattgcaagctgcacaaatggaagaaagaggaatgctagatagaaaggagagaagcagagagacatggaagcaagtcgccataaatgaagctgcaatggctgttgtggctgtgaactttcctgatcttaaaaatatagagtttgtcacaattgcccctagagctggtagggaattgggttatgttcgagtgaagatggattcagtaaaatttaatgaaggaatgctcactcgacaatcccttcttgatcatattactgttcaactagctccccgtgcggctgatgaactttggtttgggagtgatcagttgagtacaatatgggctgaaactgcagacaatgctagatctgcagcaaggacatttgttcttggtgggctttccgagaagtatcatggaatatccaatttctgggtgtcagaccgaattaatgacattgattcggaagcaatgaggattgtcaactcgtgttatgaacgtgcaaaagagatcctggagcaaaacagaacgctgatggatgctgtggtgaatgaacttgttgagaagaaaagcttaaccaagcaagaattcttccgtctagtagagttgcatggctccctaaaaccaatgcctccaagcatacttgacttacgagttgccaagtgtagcgaattccaaaaattgattaatagtgaaaaggaaacaagtttgaggagccatgcatgagaaattgcaggggcaaatgccccatcaattttgaggaataattctactataggcatatttactgcaccttattgatgtattatgttatattctttaccgcaactctgatggacgctgttccttgtttttcttcgttttggtggaaggccatgttagaacctgaattataaaaaaaatagatgcattggaatgaacc

SEQ ID NO: 1989 - DNA, 2627 bp, Prunus persica
ctttcacaaaccaaaactccatggcctgccaatgccttctgggctcttactcatcttcttctctatccccaaaccccaaacccaaaaccctcaataaaaacccaccaaaacctctcgctccatcctccatttcctctcacctctcaaccacggaagataatgatgaaaacgataaaacccagaaacccaatttcgatttcctcaagctttctgtaactctcactgtaatctccaccgctctcccccaaatcccaaccggcatagccgccgtcaaagagaaaaagcgagtgcccaagaagtctacgctcaaaaaatccgaagctttatctcatcaagagctccagtcttggtcccaaggcctccccgtcgaaggtaagctcaaacatgttatcaagcctcctggtgttgaattgcaaaaaagggtagagcccgtattggttgttctcgaagataatcgggttctacgcaccgttttgccttcggtggatagcgacaggaggttttgggaacaatgggaagagttgaaaatcgagtctttgtgcgtcaatgcctatacgccgccgcttaaacggccggaggttccgtcaccgtacttgggttttgtggcgaaatggccggcgtttttgtcgttatttgtgaagccgaagaaggagagcaagagagctatggagttgaggagagcgagggaggagtttaagacgcagaggaaggaggagcttgagagaatgaggaaggaacgagatatgatcgataaggccatgaaggcccagaagaaagaggaggagaggagagtgaggagagagatgaggaaaaagaaacacgatgagtcattgcgtcaggcacgtaggaattatctggagatggccaatgtatgggccaatttggctcaggactccaatgttgccactgcgcttggactggtgttcttctatattttttacaggaccgtagtgtttagttataggaggcagaagaaggactatgaggataggttgaagattgaaaaggcggaggcggaggagaggaagaaaatgagggaattggagagggagatggaggggattgagggtgaggaggaggaggagattgagcaagggaagggtgagcaaaacccttatttgaaaatggctatgcagttcatgaagtctggggctcggctgcgacgagctcataataagaggctgcctcagtatttggagaggggcgtggatgtcaagttttcggatgtagctggccttgggaagatccggcttgagcttgaggagattgccaagttcttcactcatggtgaaatgtataggagaagaggagttaaaataccaggtgggatacttctttgtggccctcctggagtgggtaagaccttgcttgcaaaagctgtagctggtgaggcaggcgtcaacttcttttccatttcggcctctcagtttgtggagatatatgttggggttggtgcatctcgtgtccgagcactttatcaggaagcaagggaaaacgctccatcggttgtcttcattgatgagttggatgctgttggaagggagcgtggtttgatcaagggttctggtgggcaagaacgtgatgctactcttaatcagctccttgtttctttggatgggtttgaaggaagaggtgaagtgatcactattgcttccacaaatagaccagacattctagatccagctcttgttagacctggacggtttgtcgaaagatatatatccctaagcctggtcttataggtcgcattgaaattttgaaggtccatgcacgcaagaagcctatggctgaagacgtggactatatggctattgctagtatgactgatggaatggttggtgcagagctagctaacatagttgaggttgccgcaatcaacatgatgcgtgatggaaggactgagattactactgatgacctattacaagctgcacaaatggaagaaagaggaatgctggataggaaggagagaagtttagatacatggaagcaagtagctattaatgaggccgctatggctgttgttgctgtgaactatcctgaccttaaaaatattgagttcgtcacaattgctcctggagctggtagggagttgggttatgtgagaatgaaaatggatcctatcaagttcaaagaaggaatgcttactcggcaatcactcctggatcatatcactgttcaactggcaccacgtgcagctgatgaactttggttcggtgaggatcagttaagtactatatgggctgaaacggcagacaatgctaggtcagccgcacgaacgtatgttcttgctggcctttcagagaaacatcacgggctatctaatttctgggttgcagatcgactcaatgaccttgatacggaagcattgcaaattgtcaacatgtgttatgaacgtgcaaaagagattctgcggaaaaatcgaaagcttatggatgcggtggtggatgaacttgtccagaagaagagtttaaccaaacaagaattctgtagcctagttgagttacatggttcaatcaaacctatgccacctagcatacttgacatcaaggctgccaaacggaagcagttccaagatatgatgatgaaccaaaaggaaccagctttggggagcaacttatgaataa

SEQ ID NO: 1990 - DNA, 2972 bp, Tripterygium wilfordii
agtttatggcctctcaattacttcttggctcttcactactcccctctttccgttccataaacctcaaacccagaacccaaaatccttcaaaaatcttctgcatttcatgccagcaggaatcaccccaaaatcttgataatgatgataaaatctacaaaacccagttggattttctcgctatacccataaccctatttgtagtctcaacctcgctcccccaaccggctcttgctgctgtgaaaacagagaaaaagagggcacagaaaaaatcccaagaagccttaacgccagagcagcttaaatcgtggtctcaaaacctcccaattgtgtcaaaccgtattccttactctgacatattgagcttaaaagaggagggtaggcttaagcacgtcgttaaaccccctggtgcgtgtttaagagagagggcggaggctgttttagtagttgtggatgacgacaaaaaagttctaaggactgtattgccatctattgagagtgataagaggttttgggatttgtgggatgggtcaaaaattgacgcaatttgtgtcaatgcttatacgcctccacttaagaggccggaggtgccaaagccttatctgggatttttgtggaaagtgccagagtttatgttatcatggtttaagcctaagaaagagtcgaagcgagtgctagagatcaggaaaatgcgagaagattttaggagggaaagaaaggaggaattggagaaatgaggaaagagagggaaatgatggagaaagcttttaagtttcaaaagaaacaagaggagaggagaataaagagagagatgagaaggaggaagtctgaggagtcgctgagtaatgcccagaggaattatacacgcatggggaacatgtgggcagatatggctcaggattcaacagttgtaacggcattaggattagctttttttgtgattttttacaggacggtggtgcttagttataggaagcaaaagaaggactatgaggacagactgaagattgagaaggcagaggcagaggagaggaagaagatgagagagctggagggtgatatgctagggcttgaggatgaagaggatgagagtgagcaagagaaaggtgagaagaatccttatatgaagatggctatgcagttcatgaagtcaggagcacgcgttagacgtgcacataataagaggctccctcagtatttggagaggggtgtggatgtgaagttctctgatgtggcagggctgggtaaaatacggcttgagctagaggaaattgttaagtttttcactcatggagagatgtaccgcaggcgaggagtaagaataccaggtggcatactcctttgtgggccccctggtgttgggaagactttactagcaaaagctgtcgctggtgaggcaggtgtaaacttcttctccatttctgcctcacagtttgttgaaatatatgttggggttggtgcttctcgtgttcgagcactttaccaagaagcgagggaaaatgctccatctgttgtcttcattgatgaactggatgctgttggaagggagcgtggtttaattaagggttctggtggacaagaacgtgatgctacccttaatcagctgcttgtaagcttagacggttttgaaggacgaggagaagttatcactattgcttccacaaataggcctgatattctagatcctgcgcttgtgagacctggacggtttgatcgtaaaatttttatcccaaagcctggtatcattgggcggatggaaattctgcaggtccatgctcgcaagaagccaatggctgatgatgtggactatttggctgttgctactatgaccgatggaatggttggtgcagagttggcaaatattgttgaggttgctgctattaatatgatgcgggatggaagaactgagatcacaactgatgacttgctacaagctgcacaaatggaagaaagaggaatgttagatagaaaggaaaggagccctgagatgtggaagcaagttgctattaatgaagcagcgatggccattgttgctgtgaactttcctgatcttaagaatattgagttcgttacgattgctcccagagctggtagagaattgggttatgttcggatgaaaatggatcacctcaaattcaaggaaggaatgcttagtcggcagtcgctcctggatcatattactgttcaactcgcgtctcgtgctgctgatgagatttggtatggtgaggataagctgagtacaatatgggctgaaacagcagataatgctaggtcagcagcacggacatttgtccttggcggcctttctgaaaaatatcatggatcatccaacttctggattgctgatcgaataaatgatattgattcagaggcgttgcggattttgaatttgtgttatgaccgtgccaaagagattttgctgcaaaatcgaacgctcctggatgctgtagttgaggaacttgttcagaagaaaagtctgacaaagcaacaattctctgacctagtcgagttgcatggcaacctcaaaccaatgccgccaagtattattgacatcagggcctctaaacgtgctcagtttcaagaaattatgcagaaccagaaggaaacagttgtggaaaccaacgtgtgaggaagccgatcagagaaccatccatcaccgttagtttctggataggagaacagcaaatgagatggagttcacatccctacgaaggaacaaccattttttttaaccccagtgaagtgattctgcaatcttcccggcggtgattgtggcgctggcggtgattgtggcgctagcgatgactttatatgatacaaaagagatcaaaaaagagactcacattgagaaagtccatcactccaaccgttcatgttgtttacttcttatttacttaatacaatattttgcttgtaacttgcatatatgaatcatctacctaataaatccatttgggatttgagttcttgtcggg

SEQ ID NO: 1991 - DNA, 2538 bp, Quercus alba
gaagaggcagaataaggaggagttggaggagatgaggaaggagagggagatgatggagaaggcgattcgagtgcagaagaaagaggaggcgaggaagaggaagatggaggagaggaagaggagacacgtcgcgtcgttgcaagaggcgaggaggaattacgaggacatggcggatatgtgggcgaggttggctcaggattcgaatgtggccacagcgttaggactcgtcttcttcgtgatattttaccagacggtggtgcttaattataggaagcagaagaaggattatgaggataggttgaagattgagaaagcggaggcggaggagaggaagaaaatgagggaattggagagggaaatggaggggattgagggcgaagacgaggaggatgaggagagtgggcaagggagaggtgagcagaatccgtatttgaaaatggcaatgcagtttatgaagtcaggggctcgtgttaggcgagcgcataataagaggctgccacagtatttggagagaggtgtggatgtgaagttcacggatgttgcggggcttgggaagattcggctcgagcttgaggagattgtgaagtttttcacacacggggaaatgtataggagaagaggagtgaagataccaggtgggatacttctttgtggaccacctggtgtggggaagactttactggcaaaagctgtggctggtgaggcaggtgtcaacttcttctcaatttcagcctctcagtttgtggaaatatatgttggtgttggtgcatctcgtgtccgagcactataccaagaagcaagagaaaatgctccatctgttgtcttcattgatgagctggatgctgttggaagggagcgtggtttgattaagggttctggtggacaagaacgtgatgctacccttaatcagctcctcgtctgcttggatggatttgaaggaagaggagaagtgatcaccattgcttcaacgaatagaccagatattctagatccagcacttgtcagacctggacggtttgatcgaaagatatatatccctaagcctggtcttataggtcgcatagaaattttgaaggttcatgctcgtaaaaaatctatggctgaagatgtggactatatggctgttgctagtatgactgatgggtgcagagctagccaacatagttgaggttgctgctataaatatgatgcgtgatggaaggactgagattaccactgatgacttgttgcaagctgcacaaatggaagaaagaggaatgctagatagaaaggagagaagccctgagacatggaagcaagtagccataaatgaagcagccatggctgttgtagctgtgaactttcctgatcttaagaatattgagtttgtcacaattgctcctagagctggtagggaattgggctatgttcgaatgaaaatggatcctataaaatttaatgaaggaatgcttactagacaatccctcctggaccacatcactgttcaactagctccacgtgcagccgatgagatttggtatggggaaggtcagttgagtacgatatgggcagaaacggcagacaatgctaggtcagcagcacggacctttgttcttggtggtctctctgagaaaaatcatggattatctgaattctgggttgcagatcggattaacgaaattgatgttgaggcattgcggattgtcaacgtgtgttatgaacgtgcaaaagagattctgaagcagaaccaaaagcttatggatgctgtggtcgatgaacttgttcaaaagaaaagtttaaccaaacaagaattctcacacctagtggagtcgcatggttccctcaagccgatgccacctagtatacttgatatccggactgcaagacgaacgcagttccaggaaatgatgatgaaacaaaatgaagtaattgtagaaagcaaagtatgagcaaggtgccaatgagaatatatgttaggtctttgatctcggagcaacatgcaagtcagattggtagctgttagattgaagaacagtcattaaagcactatctgtctgttggttgtcttgtgcatccattgatcataaacaaagtactcaggcatgcgaggattaaatctgagagaattttgataccacattaccacacgaacgccataatcttttttcttttccaaccatttgcaatgtacattatcttcccagttctatatttgaatcttgtccatctgaatctgtagaacagaaaggttagagcttcggtgcaatcattttgtaattttatattttttttttcttatcagaaatttcttgtatttgattgatgttgaggagaagcatttacaattattatatattcttatgataccagccccaaggacacttcaccaataggatattctggaagtgtccagaatagcgaaaattatctgtatcttaactcttaagagactgacattagaatttttcctaaggatgaaattaacatttccatagtagatttcgatttgaaattcaacttaaattatgacctgccctatctgaataagaagaaacaaaa

SEQ ID NO: 1992 - DNA, 3178 bp, Citrullus lanatus
attccacttccttcccgcccttctcttccaacaatgtagcattctcttaggttttcacttccatcgatttccccgctggaacgcaatcgatggcctgcgaacggtttctcactctttcttccccatttcccaattccaggctcgggatcctcaagccacgaacatggcgtcgcccatatccctcaatatcatctcaaatttcaactccatacaattttcaaagggacgaagataacgattcgaagaagaacaacctgaatttactcgaaatccctgtaactctcgttatactttcaacctctcttcctatatccagcgcccttgctgctaccgcctccaaagaagtgaaggaaagaagacgtggacctaagaaatcttccgccaaaaaagttgaagctctttcgcctcaggagctgcttttgtggtcgcaggggcttccatctgtctcaaaccggattccctatactgaagtcctggatttgaaaagggagggaaaagttaagcatgtgattaaagttcctaatgggtttttgagggtgaggtcggaaccagtaatggtggttctggaggattccagagtgttgaggacggtgttgccgtctgtggagagtaatcgaagattttgggagctttgggatgagttgggaatcgattctgtttgtgttaatgcatatacacctcctataaagcctcctgatgtgccaactccgtatttggggttcttggcgagagtaccggaatttatgtattcttttgttaaacctaagaaggagtccaagagagctgtagagcttaggcgtgtgagggaggagttaaagatggagaagactgttgaattggcgaaaatgaggcaagaaagagagatgatcgaaaaggcaatgaagatgcagaagaaagaggaggagaggaggattaagagagagaaaaggagaaagaagcaggaggaatcattacgtgaagctagaaaaaactaccaacatatggcaattgtgtgggcaaatttagcccgggattcaaatgtggcaacagcccttggtttggtattttttgttattttttaccgaactgtggtgttcagctacaggagacaaaagaaggattatgaggatcgattaaagattgagaaggctgaagcagaggagaggaagaaaatgcgggagttagagagggagctggaaggtgtagaaggtgaggatgatgatattgagcaaggaaaaggtgaacaaaatccttatttgaagatggctatgcaatttatgaagtcgggtgctcgagttcgtcgggctcatggcaataggctacctcagtatttagagagaggagtgaatgtgaagtttgaggatgtcgctgggcttggcaaaataaggctcgagcttgaggaaattgtgaagtttttcacacaaggagagatgtacaggagaaggggtgtaaagataccaggtgggatactgctttgcggtcctcctggagtggggaaaaccttacttgcaaaagctgttgctggggaggcaggcgttaactttttctccatatctgcttctcaatttgtggaaatatatgttggggttggtgcttcgcgtgttcgagccctatatcaagaagcaaaggaaaatgctccatcagttgttttcattgatgagctagatgctgttggaagggaacgtggtttgataaaaggttctggagggcaagaacgtgatgctactcttaatcagctgcttgtctgcttggatggatttgaaggcaggggtgaagtaatcactattgcttccactaatagaccagatattcttgatccagccctcgtgaggcctggacgatttgatcgaaagatatatattcctaagcctggacttattggtcgcatggaaattctcaaggttcatgcaagaaagaaacctatggctgaagatgttgattacatggctgttgctagtatgacagatggaatggttggtgctgaactagcaaacatagttgaggttgctgctttaaatatgatccgtgatggcagaactgagattacaaccgatgatttattgcaagctgctcaaatagaagaaaggggaatgctggataggaaggaaagaagcacagagacatggaagcaagtggccattaatgaagcagcaatggctgttgtagccgtgaacttccctgaccttaaaaatattgaatttgtcactattgcacctagagctggtagggaattgggttatgttcggatgaaaatgaatgccataaagtacaatgaaggaatgcttacccgccagtccctcttggatcatataactgttcaactagcaccacgtgcagcagatgagctttggtatggggaagaccagttgagtacaatctgggctgaaacagcagacaatgctagatcagctgctagaacctttgttcttggaggcctttccgagaaacatcatggtgtatcaaacttctgggttgcagatcgaatcaatgatattgatatggaagctttgcggactttgaacgtttgttatgagcgtgccaaagagattttgcaacaaaacagaaagctcatggatgcggtggttgatgatcttattcaaaagaaaagtctaacaaaacaggaattcctccaactggtcgagttgcatggctcagttaaaccaatgcctccgagcatcatcgaccttcgaatcgccaaacggaccaagtttgaggagatgatgaagaaccaaaagaaaatacccgtaggcagcaacagctcataaacaatggatctccaaagctattgctatcactcagctccaaagttttgagaacatggtttcacaaatttctagcagtgatactgtgacagcaaaagtcattgcctgagctggagaaggaacgcatattttcctattggagaccggttcttctggtcatttcccaatgaattggaccgtggagatgtgaacctagtcgatcagttggacaccagaaaggtgagtatttgttagttccttctcaattttatcccatttggtatatgtgggtttggagttggcaatgtttacacagattttcttcaccatttataggccgtgtcatttcatgttattatttctaaatattaggtgcttttttttaaatcttactctgataattagtgttactttgtaataagttgagtttctcacgtgaaatttttggtggttaaatt

SEQ ID NO: 1993 - DNA, 3006 bp, Sesamum indicum
gccaaccccaaccggccggcggtggcgctgtagctctcatcggtaatctgcatctcagaaagcaaagaaatatatatgttgttctactcgatgctctgtttttcatcgttatcacagactcatgtctgtctaagactgctgtgacattgtacaatgttatcattctgaattttgttaaggattgtcttcttttgttttgtttgaagttaaacaacttcatggcttgtaattgcattctcaattcctcattcttgccgtcgcttcctctgtatcagcatcccaacttgagaaaacccaaaaccctcttcgcaatttcgtgcaatcttgggaaaaaccactcaggaaaccgccgtgaggttaaagaagataaagaagaatcgatattcaagagagcaccattgaatttactcaaattctccgtaacactaactgtaatctcagtttcacttccacaaccctgtttagctgcagctaaagtctctgaaaagaagcgtttggggaaaaggactgaagctttgacccccgaggaattgcgaaagtggacacaagggcttcctgtagtatcggacaggcttgcttatagtgaaatcttggatttgaaaagggaaaataagcttaggcacattattaagccccccaatgtccgattaaagcagcagccggaggttgttttggctgttttggaggataacaaggttgttagagtagtgttgccttcagttcagagtgattcaaaattttgggaggaatgggatgagttgcaaattaatgggctctgtataaatgcttacagtccccctttgaaaaagccagaaatcccaaagccttatcttgggtttttgtcggagattccttcatggatgttttcattggtgaagccaaagcctcagtctaagaaggcattggagttgaagagagttagggaggagtttaggcggaggaaagatgaggaattggcgaagatgagacaagacagggtaatgatggagaaggcgatgaacatgcaaaagaaaatggcagcgaagcaaagaaggatggaaataaagaaagtgaagtatgaggagtcattgcgccaagcgcgtaggaactcagaaagcatggcatacatgtggaaccgtttagctagtgattctaatgtttccacagctcttgggtttgttttcttctatattttctatcgcacggttgttcttaactataaaaaacagaagaaggattacgaggacaggttgaagatagaaaaggcagaggctgaggagaagaagaagatgaggcagctggagagggaaatggctgggattgaggctggagatgatgaggaagaaggaggcaaggaggatgacaatccttatatgaaaatggcagagcaatttatgaggtctggtgcacgtgttcgacgggctcagaataggagacttccacagtatttggaaagaggtgtggatgtcaagttctcagatgttgcagggcttgggaaaatccgacttgagcttgaggagattgtgaagttctttacgcatggggaaatgtatcgcaggcgaggagttaaaataccaggtggtatactgctttgtggcccccctggggtggggaagacattattagcaaaagctgtggctggtgaggcaggtgtaaacttcttctccatttctgcatctcagtttgttgaaatatacgttggggttggtgcttctcgtgttcgagcactctatcaagaagcaaaggaaaatgctccatctgtggttttcattgatgagctcgatgctgttggaaggaaacgtggtttaatcaaggggtctggtgggcaagaacgtgatgctacattaaatcagcttcttgtgtgcctggatgggttcgaaggcagaggtgaagttattactattgcttccactaatcggccagacattttggacccagcacttgtaagaccagggaggtttgatcgcaaaatatacattcccaagcctggattgattggccgcgttgagattctgaaggttcatgctcggaagaagccaatggctccagatgtggactatacagctgttgctagtataactgatggaatggtaggtgcagagctggccaacatcatagaggttgcagctatcaatatgatgcgtgatggaagaaccgagattactactgatgacttgttacaagctgcacaaatagaagaacgaggaatgctagatagaaaagagaggagccctgaggtgtggaagcaagtggccataaatgaagcagcaatggctgtagtcgctgtgaacttccctgaccttaagaatattgaatttgtaacaattgctccaagagctggaagggaattggggtatgtacgaatgaaaatggaccatatcaaatttaaggaaggaatgttaagccgtcaatctctcttggatcatatcactgtccaacttgcgccacgtgcggctgatgaactgtggtatgggaaggatcagttgagtaccatttgggcagagacaacagataatgctagatcagctgcacggacttttgtacttgggggcctctctgagaagcattacggcttgaacaacttctggattgaagataggataaactatattgattcagaagcattgcggatccttgaagcttgctatgaacgtgcaaaattgatactgcagcaaaatcgagcacttatggacgctattgtcaatactcttgtcgagaagaagagtgtaacgaagcaagaattctttaacttagtcaacttgcatggatcgatccagcctatgccagccagcatactcgacatcaggtccgctaagcgactagaattacagaatactctcaaaaacaataaagaagcagcagctcttcaaggaagtagatgaggatgatcataaatgcgattaatgtttcaggtatgtttgaagtcctattttcagtaatatgataaatttagttcaaaattgtataaaaggatcatacaatttgtgacatttgtttctcctcctctaaagtctaagattatcgaac

SEQ ID NO: 1994 - DNA, 3072 bp, Fragaria vesca
aacatttcaattcccagagtagtgagctctgcaaaaacccagctcaaaaaactcaccttcattccaaaacccaccttcgcttctcaaatgtagcatacacaagctttcctaatataacaaaccctccacaatggccttgcaatgccttctgggctcttactcatcctcatccctacccccaagtcccacccccaagaccccaaaacccccacccaaatcctccatttcctcccacctcgccaccgctcccgataacgacgacgacgacgacgaaaagaccaaaaagcccaatttcgacttcctcaggctctccgtcactctaaccgtcatctccgcctccctcccccaaaccccaacctcacgcgccgccgtcaaggacaaaaagccacgcgcctccaagaaatcctccgcctccagaaaatccgaaaccttatctcctcaggagctccagtcctggtcccagggactccccgtcgtctccaaccgcatcccctacactcagctcctcgagctcagccgcgaatcgaagctcaagcacgtcatcaagccgccgggggtcgaattgcggcagaaggcccagccggtcttggttgttctagaagattcgagagtgctgcgcaccgttttgccaccggcggtggcggacaggaggttctgggaggaatgggagaagttgagcttggagtccttgtgcgtcaacgcctacacgccgccggtgaagccgccggaggtgccgctgccgtatttgagtttcctggcgaaaatgccggcggtggtagcgtggttaacgaggacgaggaagccggcgaagaaggagagcaagagggcggcggagctgaggcaggcgagggaggcgttcaagatgcagaggaaggaagagctggagaggatgaggagtgagagggaaatgattgatagggcgatgaaggcgcagaagaaggaggaagagaggaggttgaggagagaggcgaggaagaagaagcacgacgagtcgttgagggaggctcgccggaattacttggagatggccaatgtgtgggccaatttggctcaggactcgaatgtggccaccgcgcttgggttggtgttcttttacatattttacaggactgtggtgtttagttataggaggcagaagaaggattatgaggataggttgaagattgagcaggccgaggccgaggagaggaagaagatgagggatttggagaggatggaggggattgagggcggtgaggaggatgaggagggggagccggggaaaggggagcagaatccttatatgaagatggcaatgcagttcatgaggtccggggctcgtgtgagacgagcgcataataagaggatgcctcagtatttggagagaggtgtggatgttaagtttacggatgttgcggggcttgggaagatcaggcttgagcttgaggagattgtcaagttcttcacccatggggaaatgtataggagacgaggagtaaaaattccaggtgggatacttctttgtggccctcctggagtggggaagactttgcttgcaaaagctgttgctggtgaggcaggagtcaacttcttttccatttcggcctctcaatttgtggagatatatgttggtgtgggtgcttctcgtgtccgagcactttaccaggaagcaaaggataacgctccatcagttgtcttcattgatgagttggatgctgttggaagggagcgtggtttgatcaagggttctggtggacaagaacgtgatgcaactcttaaccagcttcttgtttgcttggatgggtttgaaggaagaggggaagtgatcactattgcttccacaaatagaccagacattctagatccagcccttgtcagacctggacgatttgatcggaagatatttatccctaagcctggtcttataggtcgcattgaaattttgaaggtccatgcgcgcaagaaaccaatggctgaagacgtggactatatggctattgcaagtatgagtgatggaatggttggtgcggagctagctaatatagtcgaggttgctgcaatcaacatgatgcgtgatggaagaactgagattactactgatgacctattacaagctgcacaaatggaagaaagaggaatgctagataggaaggacagaagtattgttacatggaagcaagtagcgattaatgaagcagcgatggctgttgttgctgcaaactttcctgatctaaaaaacattgagtttgtcacaattgctcctagagctggtagggaattgggttatgttaggatgaagatggatcctatcaacttcaaagagggaacgcttactcggcaatccctactggatcatattactgttcaactagcaccgcgtgcagccgatgaactttggtttggtgagggtcagttaagtacaatatgggctgaaacagcagacaatgctcggtcagctgcacggacgtatgttcttagtggcctttctgagaagaattatggtctatctaatttctgggtggcagatcgtctcaatgacctcgacgtgcaggcattgcagattgtcaacatgtgttatgaacgtgcaaaagagattctggagcaaaaccgaaagctcatggatgctgtggtcgatgaacttgttaagaagaagagtctgaccaaacaagatttctttaacctcgttgagttacatggttcgctcaaacctgtaccacctagtttacttgacatccgcgctgctaaaagaaagcagttccaggaaatgatgaagcaaaaggaattagtttcaggtagtaacttatgagctagatgtggagaaaatcgtacagcacattcttgatctttgacgtggaagcaaagtaatacatgagctgcttttggtacgtgtattggtcattgattttgagagcatgtatatcatgccctgaggatcgaatgtagatgtgtaatgcagattaggagcagatataaaacggatggtcaagtatagaaacatgacaacctcatgaggggaaacccttaaaaattctcactgttgattgtttttgtgactatttatatgcttgcaaataacaacaaagcagttgcaac

SEQ ID NO: 1995 - DNA, 3361 bp, Amsonia hubrichtii
gtgataaaatcctaatccgatgacttggctggcggaatgtgattttctttctcaggggtggaatgttaatggcggatcagtggagctcctctctgctacagtttaaacaatgtaaataactctgaacttctgttaaatttcattgattcatggcttctcattgtattctcagttcttcaatttcatcctcctctttttttcggcgaaatcaatcaaaattttcttcaaggacgcataaaatcgttccaagaactgtacctttttgcctcaacaactgtagaaactccgaaccccaagaagaagattctgaatcagagacagaatttaggagagcccaatttaatttgctcaaactatcagtaactctaacagtaatctcggcttcacttccccaaccctcattagctgctaaactatctgaaaaaaggcgttcagctaaaaagtctgaagctttaaccccacaagaattgaagaaatggtcacaagggcttcctacggttacccataggttaccttatactgaaattttggatttgaaaagagaaaataggctaaagcgtataattaaaccccctaatgtcgggtttaagcagcggcctgaggtggttttggccgttttggaagattctaaggttgttagaatagtgttgccatcagtagaagctgacccgaggttttggggacaatgggatgagttgaaacttgatgaagcttgtgtgaatgcttatactccgccattgaagaaaccagagattccttctccttatctgggagttttgggcaaaattccgttatggatgttttcatttataaagcctaagccacagtcaaagaaggcattggagttcaagaggatgagggaggaattgaagaagcgtcagaatgaggagttggtgaagtatagagaagacaatgaaatgatggagaagacaatgaaaatagcagaagaaaatggaagagaggaggaagagagggagatgaggaagattaaggctcaggaatcattaaaacaagcacagaagagttctcaggacatggctaggttgtgggcaaatttagcaagtgattccaatgtttccacggctcttggatttgttttcttcttcatattctatcagaccgttgttcttagttacaggaagcagaagaaggattatgatgataggttaaagatagagaaagcagaagctgaggagaagaagaagatgaggagctagagagggaaatggcagggcttgagggtgacgatgatgaggaggaaggaggaaaaggcgagcagaatccctatatgaaaatggcaatgcaattcatgaagtctggtgctcgtgtcagaagggcacagaataagagacttccgcaatatttggaaagaggtgtggatgtgaagttctcagatgtcgcaggacttgggaaaattcgggaagagcttgaggagattgtaaagttttttacccatggggagatgtatcgtaggagaggagttaggataccaggaggcatacttctttgtggtccacctggagtgggaaaaactttattagcaaaagctgtagctggtgaggcaggcgtgaacttcttctctatttctgcatctcaatttgtagaaatatatgttggtgtaggtgcttctcgtgttcgagcactttaccaagaagcaaaggagaatgccccttctgttgtattcatcgatgagttggatgctgttggaagggaacgtggtttgattaaaggttctggtggacaagaacgtgatgctactctgaaccagcttcttgtgtctttggatgggtttgaaggcagaggtcaagtgatcactattgcctcaacaaatagaccagacattttggatccagcacttgtcagaccagggcgatttgatcggaagatatatattcctaagcctggcttgataggtcgaattgaaattctcaaggtacatgctcgtaaaaagccaatggctccagatgtggactatatggctgttgctagtatgactgatggaatggttggcgctgaactagcaaacatcattgaggttgctgctattaatatgatgcgtgatggaagaactgagataacaaccgatgatttgttacaagctgcacaaatggaagaaagaggaatgctagatagaaaagagaggagcccagagacatggaagcaagtagctattaacgaagcagcgatggctgtggtggcagtgaacttccctgaccttaggaatattgagtttgtaacaattgctccaagagctggtagggaactgggttatgtccgcatgaaaatggatcatgttaaatttaaggaaggaatgctgagtcggcaatccctcttagatcacatcactgttcagttagcaccccgagcagctgatgagctatggtatggagagtgccaggtgagcacaatatgggcagagacggcagataatgctaggtcagctgcacgtactttagttcttggtggtctttcagaaaaatactatggtttgaacaacttctgggttgctgatcgcttaaatgatattgattcagaggcattaaaaatcacaaacatgtgttatggacgtgcaaaagagatattgcagcgaaaccgagaactcatggatgctgtggttaatgcacttgtcgagaagaaaagtctgaccaagcaagaattttttgacttggttcagttgcatgggtctgttcaaccaatgcccccaagcatagttgatatcaggtccgctaagcagttagagtttcagaacatgttgagggaccagaaggaagcctctctgaacagcatatgagcatgttaagagagcagtacttcgtcagttgtcgtgggatccccggagctttgaagaaagatggcaattgccgattctactgatgcttatggagaaccttgttgatagataaccgaacccaggatcctccgtgccaaaaatattttgtctacgaagttgaggcaaacctttgtgtgttcctctaaacaactggaaaatatgatatacccttcagaaggatagctcagattttgaactcagcaagatttcaaaggattctccatcattaatgcagaagcatcatcctctttctctgtcctggggtggctgattggtgctgttacattgtaggccagcattagaaatccacattcaggaattttatcacagaaaagagcccgattaggataaacatgcatataagccttttgtaccaacaatttttgtagtggaatacacagctttgctagcatacaattttgagcctcatgttttctttctttgtcgtgaataaggttgtattttgtactctacattgagagtaaagtacgggattgtgtatttgattatctctgaatatttttaatacat

SEQ ID NO: 1996 - DNA, 3020 bp, Mimulus guttatus
cacgcatacaaatacacaaaattgctccattttatcttcctcaatacgaatttcgtctccatcatcggaattaacggtggtggataaaaatgtatgaattctgaactttccgaccggcgaataattttttctacccccatgcgattagcttagcctaagccaatttccatggccggcaattgcattctcaattctccattctcacccgcacctcctcctccgctcctattccgccctaatttcccaaaacccaaaacccttgcccgaatttcatgtaatttgactgaaaccccagaaactatcaccacaaatgaagaagaagaaaaagaagaagaatcaaaactcaggaaggcaccattggatttagtcaaattctctgtaacactaactgtcatttcagcctcactcccgcagccctctttagctgcggcgaaagtttccgaaaagaagcgtttggggaaaaggactgaagctctaacccctgaggagctagagaagtggacaaaagggcttcctgttgtatcccacagacttggttatagtgaaatattggatatgaaaagggaaaacaagattaagcacattgttaagccgccgaacgcgggtttaaagcagcggccggaggtagttttggtggttttagaggataataaggttgttaggagcgtgctgccttcggtcgagagtgatccgaagttttggcaagagtgggatgagttgaaaatcgatggtctctgtatgactgcttacagtccatctgtgaaaaaccctgatattccgaaaccttatctcgggttcttgtccaaaatcccgttatggatgttttcattgcttaagaccaagcctcagtcgaagaaggcgttggagttgaagaggtcaatacggcaagcgcgtaggagctcagacagcatggcgatagtgtgggagagattagctagtgattcgaatgtctccactgcacttgggtttgtcttcttctatatattttaccgaactgttgtgctcaactatagaaagcagaagaaggattatgatgataggttgaaaatagaaaaagcggaggctgacgagaagaagaagatgagggatcttgaaaaggaaatggcggggattgaggatggtgatgaagagggggaggaaggaggaaaaggggaagataatccttacatgaaaacagcacagcagtttatgaagtcgggggctcgtgtgaggcgggcccaacgtaagaagcttccgcagtttttggaaaggggtgtcgatgtgaagttcacggatgttgcagggcttgggaaaatccgacttgagcttgaggaggttgtgaagttttttacacatggggaaatgtatcgaaggcgtggagttaaaataccaggtggtatacttctttgtgggccccccggtgtgggtaaaacattattagcaaaagctgtggctggtgaggcaggtgttaacttcttctccatttctgcatctcagttcgtcgaaatatatgttggtgtcggtgcttctcgtgttcgagcactttaccaagatgcaagggaaaatgctccatctgttgttttcattgatgaactggatgctgttggtagagaacgtggtttaattaaggggtccggtggacaagagcgtgatgctactttaaatcagcttcttgtgtgcctcgatgggtttgaaggcagaggtgaagtcattaccattgcctcgactaatagaccagacattttggatccagcacttgtcagacctgggaggttcgatcggaaaatatatattcccaagcctggagttataggccgcgttgagattctgaaggttcatgctcgaaagaaaccaatggccccggatgtggattatatggctgttgctagtatgaccgacggaatggtcggtgctgagctggcaaacatcatagaagttgctgccataaatatgatgcgtgatagcagaactgagattactactgatgacttgttacaagctgcacaaatagaagaaagaggaatgctagatagaaaagacagaagccctgagatgtggaagcaagtagctataaatgaagcagctatggctgtagttgctgtcaactttccggatctccgaaatattgagtttttgacaatttctccaagagctggaagggaaatgggttatgtacgactgaaaatggacaacatgaaatttaaggaaggaatgttgagccgacaatctctgttggatcacattacagtccaactcgcaccacgtgcagctgacggacttttctatggcgaacatcagctgagtactatctgggcagagacagcagataatgctcgttcagctgcacggaccttagttcttggcggcctttctgagaagcattacggcttgaacaacttctggactgcaaataggataaatgatattgattcagaggcactgcggatcctcgacatctgttacgaacgtgctaaatcgattcttgagcaaaaccgaggacttatggatgccgttgtcgacaatcttattgagaagaagagtttaaccaaacaagaattctttaacttggttgagttacatggatctattcaatctatgccacctagtatacttgatatcaggtcagcaaaattattacagctgcaaaatattattgctgacgtggaagcatctcaccgttgaagtgtatccgcatgcttctataagctttcaggcacgaagaaaattttgcaatattatggtcgtaaaagatagagacgcgcttcttattggttgatttgatttctctttggttaatttctaatcgttgagaacagaaatcgagctcgaattcgcccattaaagccggaaagacgcatgttcgggtacatagaaggtttaagagtttattttttgttgtatattatattaatctagtcttgacagaaaaatgctaagcttatttaattgtatgattaaatatttcatttttgtgaaactcaaacttgttttgtggcttcgttattgctgtattaataagtacaaaataaggagtgtctagc

SEQ ID NO: 1997 - DNA, 2966 bp, Tabernaemontana elegans
tagaatgttaatggcggatcactggagctcatctctgctacagttttaacaatgtaaatctctttgaactcgtgttctctttcattcattcatggcttgtcattgtattctcagttcttcaatttcatcttcctcttttttccgcgaaatcaatccaaatttttatcatcaagaacgcatagacttgtcccaagaactgtagttttttgcctcaacagctgtagaaactctgaaccccaagaagaaagttcggaatcattgagaagggcccaatttaatttactcaaactttcagtaacactaacagtaatctctgcttcgcttccccaaccctcattagctgctaaactatctgaaaaaaggcgttcagctaaaaaatctgaagctttaaccccgcaagaattgaagaaatggtcacaaggtcttcctacggtgactcataggctgccctatactgaaatcctggatttaaaaagggaaaataggctaaagagaataataaagccccccaatgttgggtttaagcagcggcctgaggtggttttggccgttttggaggattctaaggttgttaggatagtgttgccttcagttgaagctgacccgaagttttgggcactgtgggatgagttgaaacttgatgaagattgtgtgaatgcttatactccgccattgaagaaacctgagattcctgctccttatttgggaattttggggaaaattccgtcatggatgttttcatttgtaaagcctaagccacagtccaagaaggccttggagttgaagaggatgagggaggaacttaaaaagaggaagaatgtggagctggcgaagattagagaagacaatgaaatgatggagaagacaataaaaatgcagaagaaaatggaagagaggaagaagaggagggagatgaggaagattaaggctgcagaatcactgcgccaagcgcagaagagttctcaggacatggctagattgtgggcaaatctagcaagcgattccaatgttgccacagctcttgggtttgttttctttttcatattctatcagactgttgttcttagttaccggaggcagaagaaggattatgaggataggttgaaaatagagaaagcagaggctgaggagaagaagaagatgaaggagctagagagggaaatggcagggattgagggtgacgatgatgaggaggaaggaggaaagggggagcagaatccttatatgaggatggcgatgcaattcatgaagtctggtgctcgtgtgagaagggcacagaataagagacttccgcaatatttggaaagaggtgtggatgtgaagttctcagatgttgcaggacttggcaaaattcgggaagagcttgaggagattgtaaagttttttacccatggggaaatgtatcgcaggagaggagttagaataccaggaggcatacttctttgtggtccacctggagtgggaaaaactttattagcaaaagctgtggctggtgaggcaggcgtgaacttcttctctatttctgcatctcaatttgtagaaatatacgttggtgtaggggcttctcgtgttcgagcactttaccaagaagcaaaggagaatgcaccttctgttgtattcattgatgagttggatgctgttggaagagaacgtggtttgattaagggttctggtggacaagagcgtgatgctactctgaatcagcttcttgtgtgtttggatgggtttgaaggcagaggtcaagtgatcactattgcctccacaaatagaccagatatcttggatccagcacttgtccgaccaggacggtttgatcggaagatatatattcctaagcctggcttgataggtcgaattgaaattctcaaggtacatgctcgtaagaagccaatggccccagatgtggactatatggctgttgctagtatgactgatggaatggttggtgcagaactagccaacattgttgaggttgctgctatcaatatgatgcgtgatggaagaatggagataacaactgatgatttgttacaagctgcacaaatggaagaaagaggaatgctagatagaaaagagaggagcccagagacatggaagcaagtagctattaatgaagcagccatggctgtagtggctgtgaacttcccggatcttagaaatattgagtttgtaacaattgctccaagagctggcagggaactgggttatgtccgcatgaaaatggatcatgttaaatttaaggaaggaatgctgagtcggcaatcccttttagatcacatcactgttcaattagcaccacgagcagctgacgagctatggtatggagagagccagttgagcacaatatgggcagagacagcagataatgcaaggtcagctgcacgtactttagttcttggtggtctttcagaaaaatactatggcttgaacaacttctgggtcactgatcgcttaaatgatattgatacagaggcactaagaatcacaaatatgtgctatgaacgtgcaaaggagatacttcagcgaaaccgagtactcatggatgctgtggttagtgaacttgtgaagaagaaaagtcttactaagcaagaattttttaacctggtccagttgcatggatctgttctaccaatgcccccaagcatagttgatatcaggtctgccaagcagttagaatttcagaacatgttgagggaccagaaggaagcatctctcaaaggcgcatgagcatgttaagagggctctattttgtcagtgcgtgtgggatcctccagagttctgaagacggcaagtgccggctttgctgatgcttatagagaaccttgcaaatcgataaccaaacccacaccaaagatgattgtgtgcatgaagttggggcaagcttttagcgtttcctcttagaaattgcaacgatggcaggatataaccttcggaagattagcttgataacccacacccccactccc

SEQ ID NO: 1998 - DNA, 2061 bp, Artemisia annua
gaagaggaagatgaaggagttggagagaggaattgcggggcttgaaccgggggatgacgaggatgaagaaggaaaacagggtgaggagaatccgtatatgaaaatggctcaacagtttatgaaatctggtgcgagggttcgtcgtgcgcagaatgctagactttctcagtacttggaacgaggtgtggatgtgaagtttacagacgtggctggacttggaaaaatacgacttgaacttgaggaaattgtcaagttttttacacacggggaaatttaccgcaggcgaggtgtcaaaattccaggcggtatactgctttgtggtcccccgggagtgggaaagacgttgttggcaaaagcagttgctggtgaggcaggtgtgaactttttttcgatttctgcatcccagtttgtggaaatatatgtcggggtcggtgcatcacgtgtccgagcactctatcaagaagctagagatagtgctccatcagttgtctttattgatgaattggatgcagttggaagggaacgtggtttaataaagggttctggtggacaagaacgtgatgcaactttaaatcagctccttgtatgcttagatggatttgaaggcagaggaaacgtgatcactattgcttccactaacagaccagatatcctcgatcctgcacttgtcagaccaggacgttttgatagaaaaatctttatacctaaaccaggtctaataggacgtgtcgagattttgaaggtgcatgctcgtaagaaaccaatggctgaagatgtagactatgctgctgttgcggctatgactgacggaatggttggtgctgagctggcaaatatcgttgaggttgctgcaattaacatgatgcgtgatggaagaaccgagataagcacagatgacttgttacaagctgcacaaatagaagaacgaggaatgcttgataagaaagataggagccttgagatttggaagcaagtggctattaacgaagcggctatggctgttgtagcagtgaacttcgatgatcttagaaatatcgagtttattaatattgctcctagagctggtagggaattgggttatgtgcgggtgaaaatggatcatatcaaatttaaggaagggctactaagtcgacaatcgctattagatcatattactgttcaactagcaccacgtgcagcggatgagatttggcatggtgcgagccagttaagtacaatatgggctgagacagctgacaatgctaggtcagctgcacgagagtttgttcttggtggcctttcagacaaatattacggtgtctctaatttctgggttgcagatcgaataaatgatattgatgctgaggcattgcggattctcaacatgtgttacggacgtgcaaaagagattctagagcaaaataggagactaatggatgctgttgttgatgcacttgtcgagaaaagaagtttgaacaggcaagaatttatcaacttagttgagttgcatggcgttattaaacccagtccaccaagtatacttgatatgagggctataaaacgtgcacaaatggaaccagtgataatgaagcacaaggaagaagctaggcaagcaactatatgatggacaaaagtcaggtttcacaaaaattttgaagatgatctggcaaggcacgcatccaccggattatcagatatgttgtactgtatgtaacagaggacaccccagttaagctgccgggccctgtcacgtgatcatttgaatttaacgtcagaatgatcattagaagaggtttgagttttgtagacttttgtatttttgaggccaaggttgacagtggcgacccaagttttgtaaagtgtttatttcatagcaatgtaatgtactttgttgaaagtttctttcaaacattaccaatatataggaattagatattagtactcaaatttggagttgttttcatgaacttgaattggcattaaataattcaagagtcgatgttaacacaaagtaaacaaattctgtaaaaactgctattgttgataagcttgaaatatataaaaatacatgtcttttttgtg

SEQ ID NO: 1999 - DNA, 3004 bp, Phaseolus coccineus
gagaatgtaacactcaacattgttcgcatggcttcacattgcttccttcgttatccttcatcttcattttccctaaaccccaaattcagaaacattccaaagccaccttattacccttccatttcctcgcgaattcgaaccccaaaatccgataatgacgaaaacaatgacgacaacaacaaaaccccaaaccacaaccgcttcgacatcctcaaactctccgtaaccctcaccgtcatatctgccaccctcccccaagccgccgccgccgccgcggcggtcaccaagggcaagaaacggtcatccaggaaacagtccggcaaaaaaccagaagctctctcgccggaggagcttaaaacatggtctcgagggcttcccgtggtctccgatcgccttccctacagcgaaatcatcgaactcaagagggatgggaagctgaagcacataatcaaacccacttctgcgaaattgaggcaacgcagcgaagcggttctggttgttttggacgattcgagagtgttgaggacagtgttgccttcggttgagagtcacagctcgttttgggattcatgggatgcgttgaagattgattcagtgtgtgtgaacgcatacacaccgcccattaagagtccagagtggcctactcctctgttgtcacgcatttacgtgcccccttttgtgctgaaattccttcttgctgaagatagcgaaacaaagcccaagaaggagtcgaagaaggctgcggagtatagacaaatgagattgcagttgaagaaggagaaggatgatgacctgaggaggatgaggcaagagatggagaccgaggagaggaatattaaggctcagaagaaggaggaggagaagaggaagaggagggccatcagaaagaggaagtaccgggaatcgattcgccaggcgagtgagcggaatgagagaatggcctatttttggtctgatttggctaacaatagcaatgtggctaatgcacttggggtgctgttcttctacattttttaccggactgtggtgcttagttacaggaagcataagaaggactatgaggacaggctcaagatcgagcaggccgaggccgaggagaggaagaagctgagggagttggagagggagatggaggggattgagggtgatgatgaggagattgagcaggggaaaggggaggataatgattatttgaaaatggcaaagcagtttatgagatcaggagcgcgtgtgaggagagcacagaacagaaggcttcctcagtatctagagagaggtgtggatgtcaagtttagtgatgttgcagggctgggtaaaattcggcttgaacttgaggagattgtcaagttctttactcatggagagatgtaccgaaggaggggagtgaaaataccaggtggcatacttctttgtggcccccctggagtgggaaagacattgctggccaaggcagtagctggtgaggcgggggttaatttcttctctatttctgcttcacagttcgtggaaatatatgttggtgttggggcttctcgtgtccgtgcactttaccaagaagccagggataatgccccatctgttgttttcattgatgaactggatgctgttggaagggagcgtggcttgattaaaggttctggtggacaggaacgtgatgctactcttaatcagctcctggtgtgcttagatgggtttgaaggaaggggagaggtgatcaccattgcatccacaaaccgaccagacattcttgatcctgcacttgtgagacctggcaggtttgatcggaaaatatatatccccaagcccggcctaattggtcgcatagaaattctaaaggtccatgctcgtaaaaagccaatggctgaagatgtggattacatggctgttgctagtatgactgatggaatggttggtgcagagttagccaacataattgaggttgctgccatcaatatgatgcgtgactcgaggaccgagattactactgatgacttgttgcaagctgcacaaatggaggaaagaggaatgctagatagaaaggaaagaagcactgagacatggaaacaagtagctataaacgaagctgcaatggctgttgtggctgtgaactttcccgaccttaaaaatatagagtttgtcacaattgctcctagagctggtagggaattgggctatgttcgggtgaagatggattcagtaaaatttaataatggaatgctcactcgacaatccctccttgatcatattactgttcaactagctccgcgtgcagctgatgaactttggtttgggagcgatcagttaagtacgatatgggctgaaactgcagacaatgctagatctgcagcaaggacgtttgttcttggtgggctttctgagaagtattatggaatgtccaacttctgggtgtccgaccgaattaatgatattgattcggaggcaatgcgaattctggacttgtgttatgaacgagcaaaagagatccttgagcaaaatagaaggctgatggatgctgtggtgaatgaactggttgagaagaaaagcttaaccaaacaagagttcttccatctagtagatttgcatggctccctaaaaccaatgccacccagcgtacttgacatacgaattgccaagtgtagagaattccaaaaacagatcgatagtggaaaggaagcaagtttgagtagccaagcataacaaattgcagggacaaatgcccctgcaattttgtggaatatttcttctgtaccttgttgctgttgtatattacattctttaacacaagtccctacggagtacggtcatatttttgttgggtctttagagagttagcctttgccagaacgttttggttgaaaagccaagttacaatctcaacaattattttgcagagagacattcatgaactaattattttactgttacaacacatatcggtgtcgacacccgtaacacttattggtggagtgttcaattcaaaaaatatttgttggattttttaaaa

SEQ ID NO: 2000 - DNA, 2892 bp, Glycine max
gtaacaacactcaacattccatggcttcacattgcttccttcgttttcctccttcctctttttccttaaaccccaaatccaaaaggcttccaaaacctcgttatcacccttccattttctcgcgaattcaaaccccaaatcccgacgaagacgacaaagtcccaaatgacaaccgcatcgactttctcaaactctccgtcaccctcaccgtcatctccgcctccctccccaaacctgccgccgctgccaccactaaggtaaagaaacggtcaccgaaaaaacaatccgcgaaaaagcccgaaggtctctcgccggaggagctgaaaacatggacaagtggccttcccgtggtctccgatcgcctcccctacagcgaaatcatcgaactcaagaagagcgggaagctgaagcacgtaattaaacctaattccgcgaaattgaggcaacgcggcgaagcagttcttgtagttttggatgattcgagagtgctgaggacagtgttgccctcgcttgagagccatagcaagttttgggattcatgggatgagttgaaaattgattcagtgtgtgtgaatgcatacacgccacccattaagagtccagagttgcctacctctctgttggcaaacatttgggtgcccccttttgtgcagaaattcattgcttacgttttcgaagagaggcaaacaaagcccaagaaggagtccaagaaggccgcggagtttagggaaatgaggatgcagttgcagagggagaaggaagaggagctgaggaagtcgagggaagagagggagaccatggacaggaacatgaaggctcagaagaaggaggaggggaagaggaggaagagggagatcaggaagaggaagtataaggaatcgttgcgccaggccagtgaccgaaacaagaaaatggcgtatttctggtctgatttggcaaataatagcaatgtggccaatgcacttggggtgcttttcttctacattttttacaggactgtggtgcttagttataggaagcagaagaaggactatgaggacaggcttaagattgagagggccgaggccgaggagaggaggaagatgagggagttggagagggagatggagggaattgaaggtgatgatgaggagggtgagcaggggaaaggagaggagaatgcttatttgaaaatggcaaagcaatttatgaaatccggagcgcgtgtaaggagagcacagaacaagaggcttcctcagtatctagagagaggcgtggatgtgaagtttagtgatgttgccgggctgggtaaaattcggcttgaacttgaggagattgtcaagttctttactcatggagagatgtaccgaaggaggggagtgaaaataccaggtggcatacttctttgtggcccccctggagtgggaaagacattgctggcaaaggcagtggctggtgaggcaggggttaatttcttctctatttccgcttcacagtttgtggaaatatatgtcggtgtaggggcttctcgtgtccgagcactttaccaagaagcccgggaaaatgccccatctgttgtgttcattgatgagctggatgctgttggaagggaacgtggcttgattaaaggttcaggtggacaggaacgtgatgctactcttaatcagctcctggtgtgcttagatgggtttgaagggaggggagaggtgatcactattgcatccacaaaccgaccagacattctggatccagcacttgtgaggcctggcaggtttgatcggaaaatatatatccccaagcctggccttattggccgcatagaaattctaaaggtccatgctcgtaaaaagccaatggctgaagacgtggattacatggctgttgctagtatgactgatggaatggttggtgcagagctagccaacataattgaggttgctgccattaatatgatgcgtgattcaaggactgagattactactgatgacttattgcaagctgcacaaatggaagaacgaggaatgctagatagaaaggaaagaagcagtgagacatggaaacaagtagctataaatgaagctgcaatggctgttgtggctgtgaactttcctgatcttaaaaatatagagtttgtcacgattgctcctagagctggtagggaattgggttatgttcgggtgaagatggattcagtcaaatttaatcaaggaatgctcacacgacaatcccttcttgatcatattactgttcaactagctccccgtgcagctgatgaactttggtttgggagtggtcagttgagtacgatatgggctgaaactgcagacaatgctaggtctgcagcaaggacatttgttcttggtgggctttctgagaagtatcatggaatgtccaatttctgggtgtcagaccgaattaatgaaattgattcggaagccatgcagattgtcaactcgtgttatgaacgtgcaaaagagatcctggagcaaaatagaacgctgatggatgctttggtgaatgagcttgttgagaagaaaagcttaaccaaacaagagttcttccatctagtagagttgcacggctccctaaaaccaatgcctcccagcatacttgacatacgagttgctaagtgtagagaattccaaaaattgatcggtagtggaaaggaaacgagtttgagtagccacgcataacaaattgcaggggcaaatgccccatcaattttggagaatatttatactatatgctgatttcatgtaccttgttcctgtattatattctttaccacaactctacggagtatggacataattgtgtcgggtctaagctaggtagcctttgctagctcgtgagggggacatgtaaaccttgttttcctacgtttcggtgtaaagcctgaattaaagccaagtg

SEQ ID NO: 2001 - DNA, 3067 bp, Glycine max
gaggtcctctaagcaatggcttcagcgacgaagagaatgagaatgtaacaacactcaacattccatggcttcacattgcttccttcgttttcctccttccttaaaccctaaatacaaaagacttcccaaaccccgttattacccttccatttcctcgcgaattcaaaccccaaaacctgacaatgacgacgacaatgacaaaaccccaaacgacaaccgcttcgacttcctcaaactctccgtaaccctcactgtcatctctgcctccctccctcaacccgctgccgctgccgccgccgccaccaggaaggtaaagaaacggtcaccgaaaaaacaatcagccaaaaaagccgaaggtctttcgccggaggagctaaaaacatggacaagtggccttcccgtggtctccgatcgccttccctacagcgaaattatcgaactgaagaagagcgggaagctgaagcacataattaaacctaattccgcgaaattgaggcaacgtggcgaagcagttcttgtagttttggacgattcgagagtgttgaggacagtgttgccctcgcttgagagccatagcaagttttgggattcatgggatgagttgaagattgattcagtgtgtgtgaatgcgtacacgccacccatcaagagtccagagttgcctacctctctgttggcaaacatttgggtgcccccttttgtgcagaaattcattacttacgtttttgaagagaggcaaacaaagcccaagaaggagtccaagaaagcggcggagtatagggaaatgaggatgcagttgcagagggagaaggaagaggagctaaggaagtcgagggaagagagggagaccatggagaggaacacgagggctcggaagaaggaggaggagaggaggaagaagagggagatcaggaagaggaagtataaggaatccttgcgccaggcgagtgaccgaaacgagagaatggcgtatttctggtctgatttggcaaataatagcaatgtggccaatgcacttggggtgcttttcttctacattttttacaggactgtggtgcttagttataggaagcagaagaaggactacgaggacaggctcaagattgagagggccgaggctgaggagaggaggaagatgagggagttggagagggagatggagggaattgaaggtgatgatgaggagggtgagcaggggaaaggggaggagaatgcttatttgaaaatggccaagcagtttatgaaatcgggagcgcgtgtgaggagagcacagaacaagaggcttcctcagtatctagagagaggtgtggatgtgaagtttagtgatgttgctgggctgggtaaaattcggcttgaacttgaggagattgtcaagttctttactcacggagagatgtaccgaaggaggggagtgaaaataccaggtggcatacttctttgtggccctcctggagtgggaaagacattgctggcaaaggcagtggctggtgaggcaggggttaatttcttctctatttccgcttcacagtttgtggaaatatatgtcggtgtaggggcttctcgtgtccgagcactttaccaagaagccagggaaaatgccccatctgttgtcttcattgacgagctggatgctgttggaagggagcgtggcttgattaaaggttcaggtggacaggaacgtgatgctactcttaatcagctcctggtgtccttagatggatttgaaggcaggggagaggtgatcactattgcatccacaaaccgaccagacattctggatcctgcacttgtgagacctggcaggtttgatcggaaaatatatatccccaaacccggtcttattggccgcatagaaattctaaaggtccatgctcgtaaaaagccaatggctgaagatgtggattacatggctgttgctagtatgactgatggaatggtaggtgcagagctggcaaacataattgaggttgctgccatcaatatgatgcgtgattcaaggactgagattactactgatgacttattgcaagctgcacaaatggaagaaagaggaatgctagatagaaaggaaagaagcactgagacatggaaacaagtagctataaatgaagctgcaatggctgttgtggctgtgaactttcctgatcttaaaaatatagagtttgtcacaattgctcctagagctggtagggaattgggttatgttcgggtgaagatggattcagtcaaatttaatcaaggaatgctcacacgtcaatcccttcttgatcatattactgttcaactagctccccgtgcagctgatgaactttggtttgggagtggtcagttgagtacgatatgggctgaaactgcagacaatgctaggtctgcagcaaggacatttgttcttggtgggctttctgagaagtatcacggaatgtccaatttctgggtgtcagaccgaattaatgaaattgattcggaagcaatgcggattgtcaactcgtgttatgaacgtgcaaaagagatcctcgagcaaaatagaacgctgatggatgctttggtgaatgagcttgttgagaagaaaagcttaaccaaacaagagttcgtccgtctagtagagttgcacggcttcctaaaaccaatgcctctcagcatacttgacatacgagttgctaagtgtagagaattccaaaaattgatcgatagtggaaaggaaacaactagtttgagtagccacgcataacaaattgcaggggcaaatgccccaccaattttggggaatatttctactatatgctgatttcatgtaccttattcatgcattatattctttaccacaactctacggagtatggccataatttgtcgagtctttaggtaggtagcctttgctagcccgtgagggggacatgtatattttgttttcctacgtttgggtggaaagccaagttacagcctgaattaaagccaagtgtagatctagacattcctgaactattgttttaagtacctctaatctctccggatttctgattatgcctttattgtcataatagtgaactagcaacaaaaataactacct

SEQ ID NO: 2002 - DNA, 3064 bp, Gossypium hirsutum
ggggagacgcagttttttatccgggagaggttttgaagagaaggaagaaaagagtaaaatgctttgtcttaggcttcgtattcgactaaatcgaatgttcaataaccttaactacaatgtctcagtttcgtttcactacgtaagtctatctctttcgatctcttaacatagtgaaattcttttctgttcattttcactcataattctcttcactttttttttcttcattattttttcatggcttatcatttctcttttggttcttcattgtacccaaagcttccatctttaaaacccaaacctcaaaacccatttttcttcagctcttacccttcaatttcttgtcaaatttatagctctaagagcaatagttccgatgatgatgataaagccaagaaaacccatttcaattttgttgctttacccattactcttactataatctctacttcatttccacaacaaagttctcttgctgcagttaaagtatctgataggaaaaaaactcagaaaaaaacccaagaagctttgacccctgagcagataaaacaatggtcgaaaaatctccctattgtaaccaaccggattccatatactgaaattctcagtttgaaacatgagggaaagcttaaacatttaattaagccgcctagtgctagtttgaagcaaagggcagagccagttttagtagttttagaagattctagggtgttaagaactgttttgccttcaatagatagtgataggaagttttgggattcatgggatgagttaaagattgaatctttctgtgttaatgcatatacacctccaattaagaggcctgaggtgccttctccttatttgggatttttatggagggtgcctgcatttatgttgtcgtggtttaagccgaagaaggagtccaaaagggcgctggaaattaggagacaaagagaggagtttaagaggcaaaaaaggaggagttggcgagaatgagggaagagagagagatgattgaaaagatgatgaaggcgcagaagaaggaggatgagaggagaaagaagcgagagattaggaagaggaagtatgaggagtcattgcgtgatgctagaaggaattatcaaagtatggcaaatatgtgggccagtttagctcaggattcaaatgttgcaactgcgcttggattggtgttctttgtgatattttataggacagtggtgcttagttacagaaagcagaagaaggattacgaggataggttgaagattgagaaggcagaggcagaagagagaaaaaagatgagggattggagagggaatggaaggaattgagggggaggatgatgaggctgagcaagggggaggtgagcagaatccttatttgaaatggctatgcaattcatgaagtcaggagcacgtgtgcggagggcacaaaataagagactgccacagtatttggagagaggagtggatgtcaagttctcagacgttgcaggtcttggcaaaatccggcttgagcttgaggaaatagttaagtttttcacacatggggagatgtaccgaagaagaggagtaagaataccaggtggaatacttctttgtggccctcctggggttgggaaaactttactagcaaaagctgtggctggtgaagcaggtgtaaacttcttctccatatctgcttctcagtttgtggaaatatatgttggggttggtgcatcccgtgtccgagcactttatcaggaagcaaaggaaaatgccccttcagttgtatttattgatgagttggatgctgttggaagagagcgtggtttaatcaaaggttctggtggacaagaacgtgatgcaaccttaaatcagcttctggtatgcttggatggttttgaaggaagaggaaatgttatcactattgcttccacaaacagaccagacattctagatcctgcacttgtgagacctggacggtttgaccgaaaaatctttatccccaaacctggactcataggtcgcatggaaattcttcaggttcatgctcgtaagaagccaatggctgaggatgtggactatatggctgttgcaagtatgactgatggaatggttggtgctgagctggcaaacatagttgaggttgctgctattaatatgatccgtgatggaaggactgagattacaactgatgatttgctccaagcagcacaaatagaagaaaggggtatgctagataggaaggagagaagtccagagacatggaaacaagtggctataaatgaagcggcaatggctgttgtagctgtgaactttcctgatctcagaaatatcgaatttgtaacaattgctcctagagcaggtagggaattaggttatgttcggatgaaaatggatcatatcaaatttacgaaaggaatgctaagtcgacaatcccttcttgatcacataactgtgcaattagcaccccgtgcagcagatgaactttggtttggtgagggtcagttgagtacaatatggtctgaaacagcagacaatgctaggtcagcagcaaggatgtttgttcttggtggcctctctgagaaacatcatggattgtccaacttctgggttgcagatcgaattaatgagatagattcggaggcattgcagatagtgaacatatgctacgagcgagccaaagagatcttacagcagaaccgaaagctgatggatgcagtggttgatgaactggttgagaaaaagagtttaacaaaacaagaattctttggacttgtggaattgcatgggtcacttcagccaatgccacccagtatagttgacgttagggttgccaagcgaactcagttccaagaaatgatgatgaaccccaatgtgaaggttacagggagtagttcttcataaaccaccacctatctacttcctattcacatgtataactttgcatcaatcacttccaggtcataccatcaggtattgcttggtataagattttgatttctttttcttgtacttagaaatttcacttatattatctttttaaattaatttacaactttttacatgtttgctttcaaaaagaaaaagtaccgactgcg

SEQ ID NO: 2003 - DNA, 2942 bp, Solanum phureja
ctcaaccttttattattcaaatggcctgtaattccattctcaattctccatttttgccttctttcccctcaaaaaacaaaccccattatcggaaaaatacaattccggtaatcatttcctgcaattctcacaaacccagaactgaagaagacaagaaaattaggataaatcaattgggtttacttaatctttctgttacactcactgtaatatcagcttcacttgtacgacccgcaaatgcagcaaaagtgtctgaaaagaggaaaaagtctgaagctttaacgccacaagagttgaaaaaatggtcacaaggtcttccaactgtgagcaataggttaccttatacagaaatattggatttgaaaagggaagggaaacttaagcatataattaagccacctaatgtagggttaaagcaacggcctgaggtagtgttagctgttctagaggattctaaggttgtaagaattgttttaccttctgttgagagtgatccaagattttgggctgaatgggatgagttaaaagttgatggactttgtatgaatgcttatactccaccattgaaaaaacctgagcttccttcaccttatttggggttcttgtcaaatattccagcttggttgttttcttttatgaaggccaagccacagtcgaaaaaggcgttggagttgaagaggatgagggaagaattgaagagaaggcaaaatcaggagttggcgaagatacggaacgagagggagaggatggagaaggcaatgaaaatgcagaagaaaatggaagagagtaaaagaaaaagagagttgaagagaatgaggtatgaggagtccttgcgtcaagcgagtagaagttctcacgatatggcaatggtgtgggaaagcttggctagtgattcaaatgtttccactgctcttggtttggttttcttctacatattttatagaactgttgtatttagctataggaggcagaaaaaggattatgacgataggttgaagatagagaaagcagatgctgaggagaaaaagaagctgagggaattggagagggaaatggaagggattgagggtgttgatgacgacgaagaagaaggaaggaaaggagaggaaaatccttatatgaagatggctatgcaattcatgaagtcaggtgctcgtgttcgaagagcacgcaatacgaaacttccccagtatttagagagaggtattgatgttaagttctctgatgttgctgggcttggaaaaattagggaggagcttgaggaaattgttaagttcttcacccacggggagatgtatcgcaggcgaggagtcaaaataccaggggggatactgctttgtggtccacctggagtggggaagactttgttagcaaaggcggtggctggtgaggcaggggtgaacttcttctccatttctgcgtctcagttcgttgagatatatgttggtgttggggcttcccgtgttcgagctctctaccaagaggcgagggagaatgcgccatcagtggtgttcatcgatgagttggatgcagttggcagagaacgtggtttgatcaagggttcaggtggacaagaacgtgatgcgactttgaatcagcttcttgtatgcttggatggttttgaaggcaaaggtgaagtcatcactattgcttctacaaatagaccagacatattggacccagcacttgttcgaccagggcggtttgatcggaagatatacatcccaaaacctggtctaattggacgaattgaaattcttaaggtgcacgctcgtaagaagcctatggctcctgatgtggactatatggctgttgccagtatgactgatggaatggttggtgcagagttggccaacattgttgaggtcgctgctattaatatgatgcgtgatgcaagaactgagattacaactgatgacttgatacaagctgcacaaattgaagaacgaggaatgcttgaccggaaggagagaagccctgagatgtggaagcaagtggctattaatgaagcagcaatggctgtggtggcagtgaacttcccagatcttagaaatattgagtttctcactattgctccaagggctggaagagatctgggttatgtgcggatgaaaatggatcacgtcaaatttaaggaaggaatccggcagtcgctcttggatcatatcactgttcagatagcaccacgtgctgctgatgagctctggtatggagagcaccagttcagtacaatatgggctgagactgcagataatgcgaggtcagcggctcggacttttgttcttggtggcctgtctgataaacattatggtttgtctgacttctgggttgcagataggataaatgacattgattccgaggcacttcgcatcttacatatgtgctatgatcgtgcaaaagagatccttcatcaaaaccgaaaccttatggatgcagttgttgatatactagttgagaaaaaaagtcttactaaggagggattctttaaactagttgagctacatgggtcccttcaaccaatgcctcccagtgtagttgatctcaggtctgctaaacgcttggagttccaggatacgctcacaaagcagaaggaaattatttctcaaggacgcaattgagcaagggtatgacttccttggatctaattttgtcttgaagatcctattgaagtggtacaattattgaagcagaattctgctacctcagattggatagagcagagattgcaagagctctctgaatggattttgaagcttcaagcgcgaataatgatctcggatctatgaagctataaatgtgtaccgaatgcagtgaactccttttttttttttttggtcatttagctggttttccctattccattttggtatagattgcacaacagaaaggatatgtataggtcacacatattatttatgctaatgttgcataatactctcatt

SEQ ID NO: 2004 - DNA, 2361 bp, Flaveria ramosissima
agtgatatacttgatttgagacgtgaagggaagcttaagcatgtggttaaaccctcgggtaagggtttgaaggaaaggcctgtggtggttttagctgttttagaggattcgagagtcgttaggcttgtggtgccttctgtagagagtgatccgaagttttggaaagtgtgggatgagttggagattgattcgatttgtgttcaggcttatactcctccggttaagacgccggatgtccctcgtccatttttggggttcttgtccagattcccattgtggatgtattcacttgtgaagccgaaaccagtgtccaaaaaggtgttggaattgaggaaacaaagagaggaattgaagaaaagtaagattaatgaaatgttgagtatgaagaagaaaacggcgcaaatggagaaagcagcaagagcacagaagaagatggaagaaagaaagaagaaaatggaagcgcagaagcttaatagtgagcaagccatgcttgaagcccgtcttaagtactaccgaatgtctaacatgtggaaagaattagctcgtgattccaatgttacattaggtattggactgctgttttttgttatattctaccagactgtagttttaagttacaaaaaacagaaaaaagattatgaagataggttaaagattgagaaagcagaagctgaggaaaagaggaaaatgaaggaattagagaggggaatggcagggtttgaagatgatgatgatgaaggagaaggtaaatcgggtgaagaaaacccgtacatgaagatggctcaacaattcatgaaatcaggtgctcgggttcgaagagcacaaaatcctaagaatgctaaactttcacagtatttagaaagaggtgtggatgtgaagttttcagatgtggctgggctcgggaaaataaggcttgaacttgaggaaattgtgaagtttttcacacatggggaaatttaccgaaggcgaggagtcaaaataccaggtgtatacttctttgtgggccccaggagtgggaaagacattgttagcaaaagcagttgctggtgaagcaggtgtgtaactttttttctatttcggcatcccaatttgtggaaatatatgttggggttggtgcatcacgtgttcgagcgctctatcaagaagcaagagatagtgctccttctgttgtgtttattgatgaactggatgctgttggaagggaacgtggtttaataaaaggttccggtgggcaagaacgtgatgcaactctaaatcagcttcttgtatgcttagatggatttgaaggcagaggaaacgtgatcactattgcctccacaaacagacccgatatccttgatcctgcacttgtgagaccgggtcggtttgatagaaaaatatttatacccaaaccaggcctaatcggacgagttgagattctaaaggtgcatgctcgtaagaaacctatggctgaagatgtagactatgctgctgttgcagctatgactgatggaatggttggtgctgagctggcgaatatcgttgaggtggctgcaattaacatgatgcgtgatggaaggactgagatcaccactgatgacctgttgcaagctgcccaaatagaagaaagaggaatgcttgataagaaagataggagccctgaaatgtggaagcaagtggctatcaatgaagcagctatggctgttgtagcaatgaattttcgtgatcttagcaatatagagtttattaatatcgctccaagagctggtagagaattgggttatgtgaggatgaaaatggatcacatcaaatttaaagaagggttgctgagtcgacagtcacttttagaccacattactgttcaactagcaccacgagcagctgatgagatttggcatggtgagagtcagttgagtacaatatgggctgaaacagcagacaatgccagatcagcagcacgggcacttgttcttggtggtctttcagacaaatattatggtgtatctaatttctgggttgcagatcgaataaatgacattgattctgaggcaatacggatccttaatgtgtgttatgaacgtgcgaaagagatcctggagaaaaaaaggaaactcatggatgctgttgttgataaacttgttgagaagaaaagtctaaacaagcaagaatttcttaacctagttgagttacatggctgtattcaacccgggccaccaagcatactcgatatcagggctttaaaacaggcccagatgcaatcagtgatgatgaagcacaaagaagaagctaatcgggttgtcacgtaacaccacacattaagctcacaatcatattgaaagtttaataagtcagtcttgttggttaagttggagattctgcatc

SEQ ID NO: 2005 - DNA, 2873 bp, Cucumis sativus
gaaagggagatgatttcccgctcttctcttccgaccatgtgaattctccttccatcgatttccccggctggaacgcaattgatggcctgcgaacggtttctcactctttcttccccattttccagtgccaggctcgggacccttaagccacgaacatggcgtcgtccacatccctcaatatcatctcaaatttcaacaccgtccgattctccaaccgacgaacacaacgattctaagaagaagaacaagctgaatttcctgcaaatctccgtaactctgtctatactttcaacctctcttcctatgtccagcgccctcgctgccgccgcttccaaagaagtgaaggaacgaagacgtggacccaagagatcttccgccaaaaaagctgaatctctttcgcctcaggagctgctttcctggtcccagggacttccagctatctcaaaccggattccctataccgaacttctcgatttgaaaagggagggaaaagttaaacatgtgattaaaaatcctaatgggtttttgagactgaggtcggaattagtaatggtgattttggaggattccagagtgttgaggacggtgttgccgtctgtggagagtaatcgaaggttttgggtgctttggaatgagttggggatcgattctgtttgtgttaatgcatatacacctcctataaagcctcctgaattgccgacaccgtatttagggttcttggccagagtaccgttttttatgttttattttggtcaacctaagaaggagtccaagagagttgcacagcttaggcgtctgagggatgaggtaaagatggaaactactactgaattgacgaaaatgaggcaggaaaatgagaagattgaaaaggctatgaagatgcagaagaaacaggaggagaggaggattaagagagagacaaggaggaagaagcaggtggaatcattacgtgaggctagaaaaattagcgaaaatatgggaatgatatgggaagaattagccaatagtccaaatgtggcatttgcccttggtttggtattttttgttattttttacaggaccgtggtgttaagttataggagacagaagaaggattatgaggatcgattaaagattgaggaggctgaagcagaggagaggaagaaaatgctggagttagagacggatctggaagttacagaaggtgaggatgatgatattgagcaaggaaaaggtgaacaaaatccttatttgaagatggctacgcaatttatgaagtctggtgctcgagttcgtcgggctcatggcaagaggctgcctcagtatctggagaaaggggtgaatgtgaagtttgaggatgtcgctgggcttgggaaaataaggctcgagctggaggaaattgtgaagtttttcacacaaggagagatgtacaggagaaggggtgtaaagataccaggtggaatactgcttagcggtcctcctggagtggggaaaactttactagcaaaagcagttgccggtgaggcaggtgttaactttttctccatatctgcttctcaatttgtggaaatatatgtcggagttggtgcatcacgtgttcgagctctgtatcaagaagcaaaggaaaatgctccatcagttgttttcattgatgaactagatgctgttggaagggaacgtggtttgataaaaggttctggagggcaagaacgtgatgctactcttaatcagcttcttgtctgcttggatggatttgaaggcaggggtgaagtgatcactattgcttcaactaatagatcagacatccttgatccagcacttgtgaggcctggacgatttgatcgaaaaatttatattcctaagcctggacttattggtcgcatggagattctcaaagttcatgcgcgaaagaaacctatggctgaagatgttgattacatggctgtagccagtatgacagatggaatggttggtgcagaactagcgaacatagttgaggttgctgctttaaatatgatccgtgaaggcagaactgagattacgaccgatgacttattgcaagctgctcaaatagaagaaaggggactgctagataggaaggaaagaagcccagacacatggaagcaagtggccattaatgaagcagcaatggctgttgtggccgtgaactttcctgatcttgaaaatattgaatttgtcactattgcacctagatctggtagggaattgggttatgttcggatgaaaatgaatgccatgaagtacaatgaaggaatgcttacccgccagtccctcttggatcatataactgttcaactagcaccacgtgctgcagatgaactctggcatggggaagaccagttgagtacaatctgggctgaaacagcagacaatgctagatcagctgctagaacctttgttcttggaggcctctccgagaaacatcatggagtatcaaacttctgggttgcagatcgaatcaatgatattgatttggaagctttgcggattttgagcgtttgttatgagcgtgcaaaagagattttgcaacaaaacagaaagcttatggatgcggtggttgatggtcttattcaaaagaaaagtttatcaaaacaggaattcctccgtcttgtcaagttgcacggctcgattaaacctatgtctccaagcatcattgaccttcgaattgccaagcgggccaagtttgatgaagagatgaagaaaaaccaaaagaaaatacccgtaggcagtaacagctcataaacgtggattccaaaatctaatgctatcactatgccctaaagttttgagatcatggtttcacaaatttctagcagtgactgtgatagcaaaagtcattgcccgagttggagaaggaacatatatattcctac

SEQ ID NO: 2006 - DNA, 2151 bp, Flaveria ramosissima
gagtatgaagaagtaaacagcacaaatggagaaagtcagcgagagacgtcgaacaaggatggaggaaagagagaagaagatggaagcaccgaagctttaatagttgaggcaagcttatgcttgaagctcgtctgaagtactaccgaatgtctaacatgtggaaagaattagctcgtgattccaatgttacattaggcattggattgttgttttttgttatattctaccagactgtagtcttaagttataaaaaaaagaaaaaggattatgaagataggttaaagattgagaaagcagaagctgaggaaaagaggaaaatgaaggaactagagaggggaatggcaggatttgaagatgatgacgatgaaggagaagggaaatctggtgaagaaaacctgtacatgaagatggctcaacaatttatgaaatcaggtgctcgggttcgaagagcacaaaatcctaagaatactaaactttcacagtatttagaaagaggcgtggatgtgaagttttcagatgtggctgggcttgggaaaataaggcttgaacttgaggagattgtgaaatttttcacacatggggaaatttaccgaaggcgaggagtcaaaataccaggtggtatactcctttgtgggcccccaggagtgggaaagacattgttagcaaaagcagttgctggtgaagcaggtgtgaactttttttctatttcggcatcccaatttgtggaaatatatgttggtgttggcgcatcacgtgttcgagcactctatcaagaagcaagagatagtgctccatctgttgtgtttattgatgaaactggatgctgttggaagggacgtggtttaaataaaaggttctggtgggcaagaacgtgatgcgactctaaatcagcttcttgtatgcttagatggatttgaaggcagaggaaacgtgatcactattgcctccacaaacagacccgatatccttgatcctgcacttgtgagaccgggtcggtttgatagaaaatatttatacccaaaccaggcctaatcggacgagttgagattctaaaggtgcatgctcgtaagaaacctatggctgaagatgtagactatgctgctgttgcagctatgactgatggaatggttggtgctgagctggcgaatatcgttgaggtggctgcaattaacatgatgcgtgatggaaggactgagatcaccactgatgacctgttgcaagctgcccaaatagaagaaagaggaatgcttgataagaaagataggagccctgaaatgtggaagcaagtggctatcaatgaagcagctatggccgttgtagcaatgaattttcgtgatcttagcaatatagagtttattaatatcgctccaagagctggtagagaattgggttatgtgaggatgaaaatggatcacatcaaatttaaagaagggttgctgagtcgacagtcacttttagaccacattactgttcaactagcaccacgggcagctgatgagatttggcatggtgagagtcagttgagtacaatatgggctgaaacagcagacaatgccagatcagcagctcgggcacttgttcttggtggtctttcagacaaatattatggtgtatctaatttctgggttgcagatcgaataaatgacattgattctgaggcaatacggatccttaatgtgtgttacggacgtgcgaaagagatcctggagaaaaataggaaactcatggatgctgttgttgataaacttgttgagaagaaaagtctaaacaagcaagaatttcttaacctagttgagttacatggctgtattcaacccgggccaccaagcatactcgatatcagggctttaaaacaggcccagatgcaatcagtgatgatgaagcacaaagaagaagctaatcaggtcgtcacgtaacaccacacattaagctcacaatcatattgaaggtttaataagtcagtcttgttcctaagttggagatgctgcatcttgtgaacgcattgtcgggactgctgtacacaatggtgacgaaccacccgttggttaagctgttggttgctggtttttggtgtttgatgaccaaggttcacaaggaggagccaaagttttgtaaagcttttagcacatagaaatgtattgtattttgttg

SEQ ID NO: 2007 - DNA, 3069 bp, Solanum lycopersicum
ttccaacttttttttgcttagctctacaatgtaatcaccctcaaccctttaattcaaatggcctgtaattccattctcaattctccatttttgccttctttccccccaaaaaacaaaccccattatcggaaaaatacaattccggtaatcatttcctgcaattctcacaaacccagaactgaagaagagaagaaaattaggataagtcaattgggtttgcttaatctttctgttacactcactgtaatatcagcttcactggtacgacccgcaaatgcagcaaaagtgtctgaaaagaggaaaaagtctgaagctttaacgccacaagagttgaaaaaatggtcacaaggtcttccaactgtgagcaataggttaccttatacagaaatattggatttgaaaagggaagggaaacttaagcatataattaagccacctaatgtagggttaaagcaaaggcctgaggtagttttagctgttttagaggattccaaggttgttagaattgttttaccttctgtcgagagtgatccgagattttgggctgaatgggatgaattgaaagttgatggactttgtatgaatgcttatactccaccattgaaaaaacctgagcttccttcaccttatttggggttcttgtcaaatattccagcttggttgctttcttttatgaaggccaagccacagtccaaaaaggcattggagttgaagaggatgagggaagaattgaagagaaggcaaaagcaggagttggcgaagatacagaacgagagggagaggatggcgaaggcaatgaaaatgcagaagaaaatggaagagagtaaaagaaaaagagagttgaagagaatgaggtatgaggagtccttgcgtcaagcgaatagaagttcccgcgatatggcaatggtgtgggaaagcttggctagtgattcaaatgtttccactgctcttggtttggttttcttctacatattttatagaactgttgtatttagctataggaggcagaaaaaagattacgatgacaggttgaagatagagaaagcagatgctgaggagaaaaagaagctgagggaattggagagggaaatggaagggattgagggtgttgatgatgacgaagaagaaggaaggaaaggagaggataatccttatatgaagatggctatgcaattcatgaagtcaggtgctcgtgttcgaagagcacgcaatacgaaacttccccagtatttagagagaggtattgatgttaagttctctgatgttgctgggcttggaaaaattagggaggagcttgaggaaattgttaagttcttcacccacggggagatgtatcgtaggcgaggagtcaaaataccagggggaatactgctttgtggtccacctggagtggggaagactttgttagcaaaggcggtggctggtgaagcaggggtgaacttcttctccatttctgcgtctcagtttgttgagatatatgttggtgttggggcttcccgtgttcgagctctctaccaagaggcaagggagaatgccccatcagtggtgttcatcgatgagctggatgcagttggcagagaacgtggtttgatcaagggttcaggtggacaagaacgtgatgcgactttgaatcagcttcttgtatgcttggatggttttgaaggcaaaggtgaagtcatcactattgcttctacaaatagaccagacatattggacccagcacttgttcgaccagggcggtttgatcggaagatatacatcccaaaacctggtctaattggacgaattgaaattcttaaggtgcacgctcgtaagaagcctatggctcctgatgtggactatatggctgttgccagtatgactgatggaatggttggtgcagagttggccaacattgttgagatcgctgctattaatatgatgcgtgatgcaagaactgagattacaaccgatgacttgatacaagctgcacaaattgaagaacgaggaatgcttgaccggaaggagagaagccctgagatgtggaagcaagtggctattaatgaagcagcaatggctgtggtggcagtgaacttcccagatcttagaaatattgagtttctcactgttgctccaagggctggaagagatctgggttatgtgcggatgaaaatggatcacgtcaaatttaaggaaggaatccggcagtcgctgttggatcatatcactgttcagatagcaccacgtgctgctgatgagctctggtatggagagcaccagttcagtacaatatgggctgagactgcagataatgcgaggtcagcggctcggacttttgttcttggtggtctgtctgataaacattatggtttgtctgacttctgggttgcagataggataaatgacattgattccgaggcacttcacgtattacatatgtgctatgatcgtgcaaaagagatccttcatcaaaatcgaaaccttatggatgcagttgtcgatatactagttgagaaaaaaagtcttactaaggagggattctttaaactagttgagctacatgggtcccttcaaccaatgcctcccagtgtagttgatctcaggtctgctaaacgcttggagttccaggacacgctcacaaagcataaggaaattatttctcaaggacgcaactgagcaagggtatgacttccttagatctaattttgtcttgaagatcctattgaagtggtacaattgtggaagcagaattccaccatctcagattggacagagcagatattgcaagagctctctgaatgtattttaaagcttcaagcgcgaataatgatctcggatatatgaagctataaatgtgtatggaatgcagtgaactcctttttgttttcatttttcttggccatttagctggttttccctattccattttgtgatagattgcacaacagaaaggatatgtataggtcacacatgttgtttatgctaatgttgcataatattctcatcaaaataaactgtacaagactccaaattgcttgggtgggcaaatttaacaagtacttgtcttagtggaagtagcatgtattagat

SEQ ID NO: 2008 - DNA, 2200 bp, Cucumis melo
atgggactcatgtgggtaactttagccggggatccaagtgtgacatcagcccttggtttggtattttttgtaatcttttaccagaccgtggtgttaggttataggaaacagaagagggattatgaggatcgattgaagattgagaaggctgaagcagaggagaggaagaaaaatgcaggagttagaaagggagctggaagatacagaaggtgaggctgatgatattgagcaaggaaaaggtgaacagaatccttatttgaagatggctatgcaatttatgaagtcgggtgctcgagttcgtcgggttcatggcaagaggctgcctcagtatctggagaaaggggtgaatgtgaagtttgaggatgtcgctgggcttgggaaaataaggcttgagctggaggaaattgtgaagtttttcacacaaggagagatgtacaggagaaggggtgtaaagataccaggtggaatactgctttgcggtcctcctggagtggggaaaactttactagcaaaagcagttgctggtgaggcaggtgttaactttttctccatatctgcttctcaatttgtggaaatatatgtcggggttggtgcttcacgtgttcgagctctatatcaagaagcaaaggaaaatgctccatcagttgttttcattgatgaactagatgctgttggaagggaacgtggtttgataaaaggttctggagggcaagaacgtgatgctactcttaatcagcttcttgtctgcttggatggatttgaaggcaggggtgaagtgatcactattgcttcaactaatagaccagatattcttgatccagcacttgtgaggcctggacgatttgatcgaaaaatttatattcctaagcctggacttattggtcgcttggagattctcaaagttcatgcgcgaaagaaacctatggctgaagatgttgattacatggctgtagccagtatgacagatggaatggttggtgcagaactagcaaacatagttgaggttgctgctttaaatatgatccgtgagggaagaactgagattacaaccgatgacttattgcaagctgctcaaatagaagaaaggggaatgctagataggaaggaaagaagcccagacacatggaagcaagtggccattaatgaagcagcaatggctgttgtgggcgtgaactttcctgatcttggaaatattgaatttgtcactattgcacctagagctggtagggaattgggttatgttcggatgaaaatgaatgccataacgttcaatgaaggaatgtttacccgccagtccctcttgaatcgtataactgttcaactagcaccacgtgctgcagatgagctctggcatggggaagaccagttgagtacaatctgggctgaaaccgcagacagtgctagatcagctgctagaacccttgtccttggaggcttctccgagaaacatcatggagtatcaaacttctgggttgcagatcgaatcaataatattgatttggaagctttgcggattttgagcttttgttacgagcgtgcaaaagagattttgcaacaaaacagaaagcttatggatgcggtggttgatggtcttattcgaaagaaaagtttatcaaaacaagaattcctccatcttgtcaagttacatggctcgattaaaccaatgtctccaagtatcattgaccttcgaattgccaaacgggccaagtttgatgaagaaatgatgaagaaaaaccaaaagaaaatacccgtaggcagtaacagctcataaacgtggattccaaaaactaatgctatcactgtgtcctaaaagttttgtgatcaaggtttcacaaatttctagcagtgatactgtgatagcaaaagtcattgcccgagcaggagaaggaacatatatattcctactggaaaccggttcttcctggtgatggattgtggaggcaggaaccttattgatcggttggactgcagaaagatgagtatttaatagttccttttcaattttatccccatcgaaatatgtagttttggagtcgacaatgttaaaacattattttttaccatttatgtatcatttgttgtaactattcctaagttctaggttttttttttggttactcttatagttaatgttaattcgtaataagttgagtttctctcgtgaaatttttggtggctaaattgaaggtactgtttccat

SEQ ID NO: 2009 - DNA, 1586 bp, Fagus grandifolia
agaggtgagcagaatccttatttgaaaatggcaatgcagtttatgaagtcaggagctcgtgttaggcgagcgcataataagaggctgccgcagtatttggagagaggtgtggatgtgaagttcacggatgttgcggggcttgggaaaatacggctcgagcttgaggagattgtgaagtttttcacacacggggaaatgtataggaggagaggagtgaaaataccaggtgggatacttctttgtggtccccctggtgtggggaagactttactggcaaaagctgtggctggtgaggcaggtgtcaacttcttctcaatttctgcctctcaatttgtggaaatatatgttggtgtcggtgcatctcgtgtccgagcactataccaagaagcaaaagaaaatgctccatctgttgtattcattgatgagctggatgctgttggaagggagcgtggtttgattaaaggttctggtggacaagaacgtgatgctacccttaatcagctcctcgtctgcttggatggatttgaaggaagaggagaagtgatcaccatagcttccacaaatagaccagatattctagatccagcccttgtcagacctggacggtttgatcgaaagatatatatccctaagcctggccttataggtcgcatagaaattttgaaggttcatgctcgtaagaaacctatggctgaagatgtggactatatggctgttgctagtatgactgatggcatggttggtgcagagctagccaacatagttgaggttgctgctatcaatatgatgcgtgatggaaggaccgagattaccactgatgacatgttgcaagctgcacaaatggaagaaagaggaatgctagatagaaaggagagaagccctgagacatggaagcaagtagccataaatgaagcagcaatggctgttgtagctgtgaactttcctgatcttaaaaatattgagtttctcacaattgctcctagagctggtagggaattgggctatgttcgaatgaaaatggatcctataaaatttaatgaaggaatgcttactaggcaatccctcctggaccacatcactgttcaactagcaccgcgtgcagctgatgagatttggtatggggaaggtcagttgagtacgatatggtccgaaacggcagacaatgctaggtcagcagcacggacctttgttcttggtggcctctctgagaaacatcatggattatctgagttctgggtggcagatcggattaatgaaattgatgtggaggcattgcggattgtcaacatgtgttatgaacgcgcgaaagagattctgcagcaaaaccaaaagcttatggatgctgtggtagatgaacttgttcaaaagaaaagtttaaccaaacaagaattcttacaccttgttgagttgcatggttccctcaagccgatgccacctagtatacttgacatccggactgcaagacgtgcgcagttccaggaaatgatgatgaaccaaaatgaagtaactgtagagagcaaactatgagctaggtgccaagagaatcatctgttacgtctatgatctcggagcaacacatgagccag

SEQ ID NO: 2010 - DNA, 2082 bp, Helianthus annuus
gttggagttgcggaagcagagggaagagcttaagaagagtaggattaacgagacgatgagtgtgaagaagaaaatggcgcagatggagaaagccgctagagcgcagaagaagacggaggaaagaaagaagaaaatggaagaacagaagcttaatagcgagcaagcaatgatcgaagcgcgtcttaagtactaccgtatgtcgaacatgtggaaagaactagctcgggattccaacgttacgttgggtattgggttgttgtttttcgttatattctgccagacggtggttttaagttataagaaacagaaaaaggattacgaagatcggttaaagatcgagaaagcagaagcggaggaaaagaggaaaatgaaggagttagagagggggatggcgggattagaagacgaagacgatgacggtgaaggaaaatcgggtgaagaaaacccgtacatgaagatggctcaacagtttatgaaatctggtgcgcgggttcgccgagcgcaaaatagtaaaaacgttaagctttcacagtatatggaacgaggcgtggatgtgaagttttcagatgtggctgggctcgggaaaataaggcttgaacttgaggagattgtcaagtttttcacacatggggaaatttatcgtaggcgaggagtcaaaataccaggtggtatacttctttgtgggcccccaggagtgggaaagacgttgttagcaaaagcagttgctggtgaagcaggtgtgaactttttctctatttcggcatcccaatttgttgaaatatacgttggggttggtgcatcacgtgtgcgcgcactctatcaagaagcgagagactgtgctccatctgttgtgtttattgatgaactggatgctgtcggaagagaacgtgggttgataaaaggttccggtggacaagaacgtgatgcaactcttaatcagctccttgtatgcttagatggatttgaaggcagaggaaacgtgatcactattgcttccacaaaccgacccgatattcttgatcccgcactcgtgagaccgggtcggttcgatagaaaaatatttatacccaaacctggcctaattggacgactcgagattttaaaggtgcatgcccgtaagaaaccaatggctgaagatgtagattatgctgctgttgcagctatgaccgatggaatggttggtgctgagctggcgaatatcgttgaggttgctgcaatcaacatgatgcgtgatggaaggactgagatcacgactgatgacttattacaagcggcacaaatagaagaaagaggaatgcttgataagaaagaaaggagccccgaaatgtggaagcaagtggctatcaatgaagccgctatggccgtcgtagcaattaactttcacgatcttagcaatatagagtttattaatatcgctccaagagctggtagagaattgggttacgtgaggatgaaaatggatcacatcaaattcaaagaagggttgctgagtcgacagtcgcttttggatcacattaccgttcaactagcaccacgggccgctgatgagatgtggcatggtgagggtcagttgagtacaatatgggctgaaacagcagacaatgccaggtcagcagcacgcgcgtttgttcttggtggtctttcggacaagtattatggcgtatttatttctgggctgcagatcggataaatgatattgatttggaggcatcgaggatccttgatttatgttatggacgtgcgaaagagctcttggacaaaaacaggaaactgatggatgccattgttgatgctcttattgagaagaaaagtctaaacaaacaagaatttcttaagctagttgagttacatggatgtattcaacccggcccaccaagtatacttgatatgcgggctttaaaacaggcccagatgcaatcagtgatcatgaagcacaaagaagaagctaatcgcgtcgtcacataacaccgcgcacattaagttcacaattatattgaaggtttaaaaagtcgaatcttgttcttgcgttggcaatgctccttgtgaacaaataggcgcgtgcaccatggtgatgaaccgccc

SEQ ID NO: 2011 - DNA, 3366 bp, Elaeis guineensis
cccgtcgtagggagagctctgtcccatatatcgtcccgttcactctcggagcatcacttcttagaccctaatccatctctctcccaagagcacatccactcctccttcgcgactcccatggcgaaccctgaagcagagctccatcccaccccttcgccgctccaatccccgcccccagacgtgcgctaacccctgcttccccacccctccacctcctctccttctatccgctcccatggagctcgcttcttcgagttctctatttttctctcaactttctgttcgcccaaccccaccaagaatccgtttttgctccaagaaaagatcaaattcccccaaatctttgattgcttgccacttgatcggtcctgaagaatccgatgacaaagaaaccaagaaatctcgcattggattgctccagctgtccgtaaccctaaccgtgatctcctcttcgctcccacaatccccggcgcaagctaaggtggcggagaagaagcgaccggcgaagaaaagtacagaggctctctcccccgaggagctcaagtcttggtctcggggccttccgaccgtcggcgaccggatcccgtacaccgaaatcttaaatctgaaggaagaggggaagctcaagcacatcgtaaaattgccttctgtcaatttgaagcagcggacagatccggtattagtcattcttgaagattctagggttttgaggacggtgcttccaaccattgagagagatgataagttttgggagtcgtgggataggttgcagttgaattctgtttgtattaatgcgcatactccgccgattaggaagccagaggttcctagtccttacttggggtggttggcgaagtttccaatgtcattcttgaaaccgaagccgaagtcgaagcgggttttagagcttgagaaggcccggaaggagctggcggagaggaggaagacggagctggcgatggtgaggcaggagagggaggagatggagaaggctctcagggctcagaagaaggctgatgagaggaggaggagattggaggtgaggaaggccaagcacgaggaatcccttcggcaggcgagaaagaactacaggcaaatggcgcttgtgtgggctgacatagcgagggacaagaatgtcgccactgctattggggctttgatgttctatatcttttataggacggtcgtgcttagctacaggaagcagcagaaagattatgaggacaggctaaagattgagaaggccgaggcagaggagcgtaagaagatgagggagttggaaagggaattggtgggacttgagggtagtggtgaggatgagagtgaggagaaaggagagcagaatccttaccttaagatggcaaagaagtttatgcaatccggtgctcgagtacggcgtgcaaatagcaagcggctgcctcaatacatggaaaggggtgtagatgtgaagttcagtgatgttgctggtcttgggaacatacggcttgagcttgaggagatagttaagtttttcacactgggagaaatgtaccggaggcgaggagtgaaaataccaggtggcatactactgtgtgggcctcctggagtgggtaagacgttattggcaaaggctgttgctggtgaggctggtgtgaactttttctcaatttctgcatcacaatttgtagaaatatatgtgggtgttggagcatctcgtgtccgtgcactctatcaagaagcaaaagagaatgctccttccgtcgtgttcattgatgaactggatgctgttggcagagaacgtggtctaattaaaggttctggtggacaagaacgagatgctactctcaatcagctccttgtgtgcttggatgggtttgaaggaagaggtgatgtaatcaccattgctgcaaccaatagaccagacattcttgatccggcacttgtgagacctgggcggtttgataggaaaatttacatcccaaaacctagcctcattggtcgtgttgagattctgaaggtccatgctcgtaagaaaccaatggctgatgatgttgattatgtggctgtagctagtatgactgaggggatggttggtgctgaattggccaacatagttgagcttgctgcaattaatatgatgcgtgatggaaggtctgagataacaactgatgacttgttacaagctgcacagatagaagaaagaggaatgcttgataaaaaggataggagtccagagatgtggaaacgactggctattaatgaagcagctatggctgttgtggctgtgaactttcctgatattaaaaatattgagtttgttaccattgcacctcgagctggcagagaactaggctatgtgcgagtgaagatggatcacatgaaatttaaagaaggaatgcttagccggcagtcccttcttgatcacgtcactgttcaaatagcacctcgtgctgctgatgaaatttggtatggtgaaaatcagctgagtacgatttgggcagaaacagcagataatgctaggtcagctgcgcggagttttgttcttggtggtctttctgaaaaatattatgggctatctgacttctgggttgcagatcgtatcaatgaaattgatctggaggcattgcatgttctaaacgactgctatgaacgagcaaaagagattctgcgacgtaatcgggtccttatggattctgtggtcaatcggctagtcgataagaaaagtctcaccaagcaggagttttttaacctggttagggaacatggacatctggagcctatgccacgcagtattgttgatattaggaatagcaaacgcctgcagtttcaacaaatgatgatggcccaaaaggaatcagcccatggaagccgtgtgtgagagatgcaaagagaacttaccttagacactggcttccatatccggggatggcttccatttttctggacatgttcttataagccaaaatgctgcactcagttcctgtctagaatctggtttggatcaaattttcttactgctaaccacgtgcaatttttgatcttgtatggtcacgaaggtgacgactcttcggatgtagtcattcatgttctctcaggcgattcctcgtcatcttttttctctttttcttttgacatgatgtgataatctcccaaattactgataagagctgcaaacatcgagtttggttggttaagaggttgtcctgagaggtttactaggtccagtttctcagagatctgatcgcacaagattcactttgtaagaatcttttatgtagataataatttatgccctgtaaggctaagcgggtgtataacttcaacttttcagagatttgtatggaaaactgctgtcccgacacgctgatgatgataaaaaaaaaaaaa

SEQ ID NO: 2012 - DNA, 2018 bp, Ambrosia trifida
tttttttgtattctaccagactgtggtattaagttataaaaaacagaaaaggattatgaagataggttaaagattgagaaagcagaagctgaggaaaagaagaaaatgagggagttagagaggggaatggcggggttagatgatgatgatgacgatgatgcagaaggaaaatcgggtgaagaaaacccgtacatgaagatggctaaacagttcatgaaatcaggtgctcgggttcgccgagcacaaaatagtaaaaacactaaactttcacagtatatggaaagaggtgttgatgtgaagttttcagatgtggctgggctcgggaaaataaggcttgaacttgaggagattgtcaggtttttcacacatggggaagtttatcgaaggcgaggagtcaaaataccaggtggtatccttctttgtgggcccccaggagtgggaaagacattgttagcaaaggcagttgctggtgaagcgggtgtaaactttttttctatttcggcatcccaatttgtggaaatatatgttggggttggtgcatcacgtgtccgagcactctatcaagaagcgagagatagtgctccatctgttgtgtttattgatgaactggatgctgttggaagggagcgtggtttaataaaaggttctggtggacaagaacgtgatgcaactctcaatcagctccttgtatgcttagatggatttgaaggcagaggaaacgtgatcactattgcttccacaaacagacctgatatccttgatcctgcactcgtgagacctggtcggtttgatagaaaaatatttatacccaaaccaggcttaattggacgagtcgagattttaaaggtgcatgctcgtaagaaaccaatggctgaagacgtgactatgatgctgtgcagctatgactgatggaatggttggtgctgagctggcaaatatcgttgaggttgctgctattaacatgatgcgtgatggaaggactgagatcaccactgatgacttgttacaagctgcacaaatagaagaaagaggaatgcttgataagaaagaacggagccctgaaatgtggaagcaggtggctatcaatgaagcagccatggctgttgtagcaatgaatttttctgatcttagcaatatagagtttattaatatcgccccaagagctggtagggaattgggttatgtgaggatgaaaatggataatatcaaatttaaggaagggttgctgagccgacagtcgcttttagatcacattactgttcaacttgcaccacgggcagctgatgagatgtggcatggtgagggtcagttgagtacaatatgggccgaaacagcagacaatgccagatcagcggcccgagcatttgttcttggtggtctttcagacaaatattacggtgtatctgattctgggtggcagatcgaataaatgacattgatacggaggcatcaaggatccttgatttgtgttatgggcgtgcaaaagagctattggacaaaaataggaaactcatggatgctgttgttgatgcacttgttgagaagaaaagtctaaacaagcaagaatttcttaaactagttgagttacatggttgtattcaacccagaccaccaagtatacttgatatcagggctttaaaacaggcccagatgcaatcagtgataatgaagcacaaagaagaagctaatcgggttgtcacgtaacgccgcacacattaagttcacaattatatcgaaggcttaaaaagtcaaatcttgttcctgcgttggagattcaccttgtgaacaaataagcgcatgcaaagcgatgatgaaccaactttttgttaagcggtcggttgatgttgattttggtgtttgatgatcaaggttccgagtggcgagccaaagttttgtaaagcgtttaaacacagagaaatgtaatgtattatgtttagaatttggagttgttttagattcacttttatcagttaaagcatgtacattatgtgctcattgtatggcttttaaaatgatca

SEQ ID NO: 2013 - DNA, 2574 bp, Musa acuminata
atggagctcgctgcatcgagctctctcctattctcctccctccccctcgccccatccccaccaaaagcccctttccgctcgattccgcgcaaatgtttcgttccacgcaattccctctccgtcaccatgaccgtcatctcctcctcgcttccgctgccacgtgctcacgctggggtcaccgagaagaagccgaggccaaagcgcccggcggagaccctttcccctgaggagctcaaatcctggtcccgcggcctccccactgtcggcgaccgtattccatataccgaaatcttgacccttagggacgaagggaagctccggcatatcgtgaagccaccttccgtcaccttgaagctgcggccgaacctggtgctcgtcgtcctcgatgattccagggtccttcgggcggtgctgccggcggccgagagggatgagaggttttgggagtcctgggatcggctcgagttggattctttttgcatcaatgcatatacccccccggtccggaagccggaagtccccaccccctatttggggtggttggtaaacattccaggccactttctgtcaatggagaagcccaaacccaagtcaaagcgtgtgttggagcttgagaatgcacggaaggagctggcagagaggcggagagaagagttagcaagagtgagggcagagagggaggcgatggagaaaattatgaaggcacagaagaaggcggaggaaaggaagaggaggaaacagattaagaaggccaaatacgaggagtcgctacggcaggctagaaagaattatcagcggatggcctatatgtgggatgatatggcgagggacaagaatgttgccactgctattgggttcgtgatattctacgtcttctacagaactgttgtgcttaattataggaagcagcagaaggattatgaagataggctgaagattgagaaggcagaggcagaggaacggaagaaaatgaggcagttggagagggaaatggcaggacttgagggaccaggggaagatgagagcgaggagagaggagatgagcagaatccttatatgaagatggcaatgaagtttatgcagtcaggtgctcgggtgaggcgagcgaatagtaaagtaccacaatacttggagaggggagtcgatgtcaagtttagcgatgttgctggtcttgggaaaataaggctagagcttgaggagattgtgaagttcttcacattgggggaaatgtacaggagaagaggcatcaaaataccaggtggcatacttctgtgtgggcctcctggtgtgggtaagacattattagcgaaagctgttgctggtgaggctggtgtgaacttcttttcaatttcagcttcacaatttgtggaaatatatgttggtgttggtgcttctcgtgttcgtgcactgtaccaagaagccaaggaaaatgctcctgctgttgtgtttattgatgaactagatgctgttggaagagaacgtggtcttatcaagggttctggtggacaagaacgagatgccacactcaatcagctccttgtatgcttggatggctttgaaggaagaggcaatgtaattaccatagctgcaaccaatagaccagatatccttgatccagctcttgtgagaccagggcggtttgatagaaaaatattcataccaaagcctagtctaattggtcgaattgagattctgaaggttcacgctcggaaaaagccaatggctgatgatgtggattatatggcagttgccagtatgactaatggaatggttggtgctgagctggcaaacattattgaaattgctgccattaatatgatacgtgatggaaggtctgagataacaactgatgacttattacaagctgcacaaattgaagaaagaggaatgcttgataaaaaggataggaggccagagatgtggaaacgattggctctaaatgaagcagctatggctattgtagctgtcaacttccctgatctaaagaacattgagtttataaccattgcacctcgagctggcagagaattgggttatgtgcgagtcaagatggatcatattaaatttacaaaaggaatgcttagccgccagtccctgattgatcatatcactgttcagatagcccctcgggctgctgatgaaatctggtttggtgagaatcagctgagtacaatttgggcagaaacagcagacaatgcaaggtcagctgcacgttcctttgttcttggtggcctctcagaaaaatatcatggactgtccaacttctgggttgcagatcggatcaatgatattgatctggaggcacagcggttactgaacaattgctatgatcgagcaaaagagatattgcgacgcaataaagagttaatggatgtgatagttgaccaattagttcagaagaaaagtctcaccaagcaggagttctttcgcctggtggaggaatatggtcatgttgatcagatgccgaaaaatattattgatataaggaaaacgaagcttttgcaatttcaacaaatgatgatggctgggaaggaacgagctcagggaagccttgtctgatatgctagaagaatt

SEQ ID NO: 2014 - DNA, 1940 bp, Ambrosia trifida
ggaatggcggggttaggatgatgatgatgacgaagatggagaggaaaatacaggtgaagaaaaccgtacatgaagatggctaaacagttcatgaaatcaggtgctcgggttcgccgagcacaaaatactaaaaacactaaactttcacaatatatggaaagaggtgtggatgtgaagttttcagatgtggctgggctcgggaaaataaggcttgaacttgaggagattgtcaggtttttcacacatggggaagtttatcgaaggcgaggagtcaaaataccaggtggtatccttctttgtgggcccccaggagtggggaagacattgttagcaaaagcagttgctggtgaagcaggtgtaaactttttttctatttcggcatcccaatttgtggaaatatatgttggggttggtgcatcacgtgtccgagcactctatcaagaagcgagagatagtgctccctctgttgtgtttattgatgaactggatgctgttggaagggagcgtggtttaataaaaggttctggtggacaagaacgtgatgcaactctcaatcagctccttgtatgcttagatggatttgaaggcagaggaaacgtgatcactattgcttccacaaacagacctgatatccttgatcctgcactcgtgagaccgggtcggtttgatagaaaaatatttatacccaaaccaggcttaattggacgagtcgagattttaaaggtgcatgctcgtaagaaaccaatggctgaagacgtagactatgatgctgttgcagctatgactgatggaatggttggtgctgagctggcaaatatcgtggaggttgctgctattaacatgatgcgtgatggaaggaccgagatcactactgatgacttgttacaagctgcacaaatagaagaaagaggaatgcttgataagaaagatcggagccctgaaatgtggaagcaagtggctatcaatgaagcagccatggctgttgtggcaacgaactttcctgatcttagcaatatagagtttattaatatcgccccaagagctggtagggaattgggttatgtgaggatgaaatggaccagatcaaatttaaggaagggttgctgagtcgacagtcgcttttagatcacattactgttcaacttgcgccacgggcagctgatgagatgtggcatggtgagggtcagttgagtacaatatgggctgaaacagcagacaatgccagatcagcggcgcgagcatttgttcttggtggtctttcagacaaatattacggtgtatctgatttctgggtggcagatcgaatgaatgacattgatacggaggcatcaaggatccttgatttgtgttatgcgcgtgcaaaagagctcttggacaaaaataggaaactcatggatgctgttgttgttgcacttgttgagaagaaaagtctaaacaagcaagaatttcttaaactagttgagttacatggttgtattcaacccagcccaccaagtatacttgatattagggctttaaaacaggcccagatgcaatcagtgataatgaagcacaaagaagaagctaatcgggttgtcacgtaacaccgcacacattaagttcacaattatatcgaaggcttaaaaagtcaaatcttgttcctgcgttggagatgcaccttgtgacaaataggcgcatgcaaagtgatgatgaaccaactttttgttaagcggtcggttgatgttgattttgttgtttgatgatcaaggttccgagtggcgagccaaagttttgtaaagcgtttaaacacagggaaatgtaatgtattatgtttagaatttggagttgttttagattcacttttatcagttaaagcatgtacattatgtgctcattgtatggcttttaaaatgatcattttaccttttatcaacaacttgtagaagaaacaggcacgtgaa

SEQ ID NO: 2015 - DNA, 2331 bp, Silene vulgaris
tgagggtaagcttaagcatgtcattaagccgactgttgcgtctttaaggcaaaaacccgagtgggttttggttgttttggaggattctagggtttttaggactgttttgccttccttagaggggaatcctaagttttggagtaagtgggatgagttgaaaatcgatacattatgtgttaatgcgtataatccgcctgttaagacgccggagataccgactccttacctagggtttttgtcgagggtgcctatttgggcgctttcatccttttttaagtcaaagccacaatcaaagaaggctttggaattgaagatgatgagggaggagttgaagaggcagaggacagaggaattgacaaggtcgagggtggaaagggagaagttggagaagatgataaaaaagcagaagaagatggatgagaggaataaaagacgggagttgcaaaagaggcagcatgaggagtccttgcgtcaagctcgaaaaaattatcagaaaatgggtatgatgtggagtgatttggctagggatacgaatgtcgccactgcccttgggcttgtcttcttttacatattctaccggactgttgtgttaagctataggcggcaaaggaaggactatgaggataggataaagattgaaaaagcagaagcagaagaaggaaaaagatgagagaattagagaagcaaatggaaggtttggagggtgaagatgaggaagagggaaaacctggtgaagacgatgcttacatgaagatggctatgcaattcatgaggtctggtgctcgtgttcgtcgggcacgaaatagaagattgcctcaatatttagagagagatgtggatgtgaaattttcagatgtggctgggcttggaaaaatacgacttgagctggaagagattgttaaatttttcacacatgcagaaatgtatcgaagaagaggagtgaagataccaggtggcattcttctttgtggtccacctggagttgggaagactttgttagcaaaggccgtggctggtgaagctggtgtaaactttttctcaatttctgcttctcagtttgtggagatttatgtcggagttggggcttctcgtgtgcgagccctttaccaagaggcaaaagagaatgctccatcagttgtcttcattgatgaattagatgctgtggggagggagcgtggcctcattaagggttcaggaggacaagagcgtgatgctacacttaatcagctccttgtatccttggatggatttgaaggaagaggggatgtcataactattgcttccacaaataggccagacatcttagatccagctcttgtgaggcctggaaggtttgaccgaaaaattcatattcctaggcctagtcttcaagggcgtatcgagattttacaggttcatgctcgcaagaaatcaatggctgaggatgttgactatgcatctgttgccaatatgacggacggaatggtaggggcagagctggctaacattattgaggttgctgctataaatatgttgcgggatggtagaaatgagataacaactgatgatttattacaagctgctcaaatggaagaaagggggaatgcttgacagaaaagagagaagtcctgaaatgtggaggcgaatagcacttaacgaagcagcacaggccatagcagctgtcaactttcctgatcttagaaatatagaatttcttaatattgctcccagggctggtagggaacttggttatgttcgtttcaaaattgatcatatcaaatttacggaagggctgctaagccgacaatcccttttggattatataacagttcagttggcacctcgagcagctgatgagttgtggtatggtgagcaccagctgagcacaatatgggcagaaacagctgataacgctaggtcagcagctcgaaactttgttcttggtggcctgtctgaaagcatcatggtttgaacaacttctgggttgccgaaaagatagatgacattgatttggaggctttacgaattctcaacttctgttatgaacgtgtaaaagagatcctacagcgaaaccagaaacttgtgaataccgtggtggatgaactcgttttaaagaagagtttggcaaagaaggaattctttcaccttgttgagatgtatggctcacttgaaccagtggagccaagtatacttgacatcagagctgagcgacgcaagcagttgcaggaaatgatatcaaataaaacagcagctacagcaagcaatgtctaagctaacgatatatacattgtatctgtcaagtaacaccacaatcaaactctggttgaactaacttcatcagtggcttgatcg

SEQ ID NO: 2016 - DNA, 3252 bp, Aristolochia fimbriata
caggcgctccgttgcaacatcgatatacccatttacgctacatctcggcattctcgtatctgcctatctactcttttcaaaggttttctgtaacattcatggcagttctttctatgatgttcatcctaccgtcatcgtttgacggcaacatcggtaagcaacagggaccatgttgatctccaacttgaacaatatcggtaagcaacaggaacaatgttgacctctaacttgaactctcctgctagtgtcatgaactgcattatcggttcctcgagcttttcacccctgtcgttgaaaaaatattctcgaatacgcggtcggaatcggttgtgttactatttatctgcgacatcatgtaatctgaacgctgctgaaggcgaaaaagatgagagaaagaagtgtgtttcgaagttgctcggactatctgtcacttttactgctgtctcttctgtgcttcctcaacctccggcgctagcaaaagtttccgagaagaagcgtccaaccaggaaggaggaagttttgtccccagaagaagtgaagtcttggacgcgagagcttcctgtcgttggagacagaattccgtataccgatttattgaaactgaaagaagaaggaaagctcaaacatataattaagcttccatcagttcacttaaagcaacaaccagattctgttctcgtggttctggacgactctagggttttcagaactgttcttccaacaattgcaagggatgagaagttttgggagtcgtgggataggttagaaattaattccctgtgtatgaacgcatatactcctccgattaaaaaaccagaacttccttctccttatctcggtcttcttcagaaaattcctctttatttattttcaaaagtgaaattcaagccagcgtcgaagcgtgcattggagcttgaaaagatgagaaaagagctccggatgaagggcaaagctgaagtggagagagtgaggaaagagcaggaaatgctggaaaaggctgtaagggctcaaaaaaagatcgaggaaagagaaattaagaaaaggttgagaaaggaacagtatgaacagtcactgcgcaaggcccaaaagaattacaagaatatggcacttgtttgggctgacttggcacggaaccagagtgtttcgactgcccttggtttcgtaatttttttcttattttatcaaactgttgtattgaactataggaaacagaaaaaagattatgaggataggttaaagattgagaaagcagaagctgagtagagaaagaagatgaggaagctggaaaaagagacacagggaatagaggataatgcagaagacatcgaggagggggaaggtgaggagaatccttatatgaagatggccacgcagtttatgcgttctggtgctcgtgttcggagagcccggagcagaaggccacctcaatatttggaccaaagcgtggatgtgaagttctcagatgttgctgggcttggaaaaatacgtcttgagctggaggaggtggtcaaattctttactcagggagaaatgtacagacgacgaggagtgaggatacccggtggcattcttctctgtggtcccccaggagtcggaaaaacattattagcaaaagctgttgctggtgaggcaggtgtgaatttcttctcaatttctgcatcccagtttgtggaaatttatgtcggagttggtgcatcccgtgtgcgagcactttatcaggaagcaaaagagaatgcaccatcagttgtcttcattgacgagcttgatgctgttggaagggagcgtggtcttataaagggttctggaggacaagagcgtgatgctacactgaatcagctgctagtgtgtttggatggttttgaagggagaggtgaggtcatcaccattgctgctacaaatagaccggacatccttgatccagctcttgtgagacctggtcggtttgatcgcaaaatttatattccgaagccttctcttgtgggtcgaattgaaattttaaaggtccacgcccgtaaaaaaccaatggctgaagatgtagattatatggcagttgctagtatgactaggggaatggttggtgctgagttggccaacataattgaagttgctgctatcagcatgatgcgtgatgggagatcagagattactactgatgacttgctgcaagccgttcagattgaagaacgaggaatgttggatagaaaggaacggaccccagaaatgtggaaacaattagcgatcaatgaagctgccatggctgttgtggctgtgaatttccctgatatgaagaacattgagtttgtcacaattgctcctagggctggaagagagttgggctatgtgcgagtgaggatggatcacataaaattccaagaaggaatgttgagtcgtcaatctgtccttgaccatatcactgttcaagtagcgccacgtgcagcagatgagatctggtatggtgaggagcagctgagcacaatttgggcagaaacagcagataatgcaaggtctgctgctaggagctttgttcttggtggtctatcagagaaaaattatggattgtccaacttctgggttgcagatcacattaatgaaattgatctggaggcaatgcgtattctaagtctctgctaccaacgagcaaaagagattctgcaacggaaccgaaaacttatggatgctgtggttgatgaacttaccctgaaaaggaatctaacaaagcatgagttttctcgcttagttgaggcttatggaagccttgaacctgagccacccaatataattgacatcagaatttctaagcgtgctaaattccaggaaatgatgatgggtaaaaaagaaacagctgcccactgaagcagctagttttgtcactgttacgtggttggaccccttgagcttacatactgataggcgttggcagcaaaaagtgcagtagatacgtttgaaggttaaatctccccagcccctaagtttcagaccaggagttgatagaagattttgagcttttctagtgaatttttatgtgatttctgataagatattgatcgttctcatttattgcctcctttaaattatgtcggagagtgggaaggtatcttgtttgtccaataatttggtttcgtttgccaaatttaaattttttgtagaagatagtgtcatgtggaagctcacaaaattttctgttacaaaactttcagtgtaaggcatcgcttagaattgctttttggtaaaggactctttgatatatctctt

SEQ ID NO: 2017 - DNA, 1471 bp, Cirsium arvense
cgagtacttggaaagagacgtcgatgtgaagttcacagatgtggctgggcttgggaaaatacgacttgagttggaggagattgtgaagttcttcacacatggggaaatataccgcaggcgaggagtcaaaataccaggcggtatacttctttgtggcccacccggagtgggaaagactttgttagcaaaagcagttgctggtgaggcaggcgtaaacttcttttctatttctgcatcccagtttgtggaaatatatgttggagttggtgcatcacgtgtccgggcactctatcaagaagcaagggagaatgctccatctgttgtctttatcgatgaactggatgctgttggaagggaacgtggtttaataaagggttctggtggacaagaacgtgatgcaactctaaatcagctccttgtatgcttagatggattcgaaggcagaggaaacgtgatcactattgcttccacgaacagaccagatatcctcgatgctgcacttgtgagaccaggacgtttcgatagaaaaatatttatacctaaacctggcttaataggacgggtcgagattttgaaggtgcatgctcgtaagaaaccgatggctcacgatgtggactatgtggctgttgcgggtatgaccgagggaatggttggtgcggagttagctaatatcgttgaggttgctgcaattaacatgatgcgtgaagggagaactgagatcactacagatgacttgttacaatcagcacaaatagaagaaagaggaatgcttgataagaaagataggagccctgaaatttggaagcaagtggctatcaatgaagcagccatggctgttgttgctgtgaacttccaggatcttaagaatattgaatttattactatcgctccaagagctggtagggaattgggttatgtgcgggtgaaaatggattacatcaaacttgagcaaggctttctgagtcggcagtcgatattggatcacattactgttcaactagcaccacgagcagctgatgagatttggtatggtgaaggtcagttgagtacaatatgggctgaagcagcagacattgctaggtcagctgcacgggcactcgttattggtggcctttcagacagtaactatggtgtacctatctcctgggatacagatcgaataaatgacattgataccgaggcattgcggatcctgaatatgtgttatgaacgcacgaaaaagatcttggagcaaaataggaaactcatggatgctgttgtggatgcacttgtggagaagagaagcatgaacaagcaagaattcatgaatctagtcgagttgcatggatgcattgaaccgagtcccccgagcatactagatatcagggctaataaacgtgcacagatgcaatcaatgattgcacaaggaagcagcagctaatcaggccaccacgtgacaccacaccacaaagattttgaaagttttaaatgt

SEQ ID NO: 2018 - DNA, 2979 bp, Aquilegia formosa
atggactgtttctgtactcttagtagttcatcatcgagattcccatcatcatcatcatcatcaattttacctgtaaaaagttttccaagaagtaagagattatttcctagttcaatttcttgtaattctaaggaatttgaagaagaaaatgaagaaaaaaccaagaaaattggattaaatttacttcaattttcagttactcttacaattgtttcatcttctttcccattgcaatctgcaatggcagcgaaagtttcttcggagaaaaagcgagctgcaaagaaaccagctgaagctttatctcctgaagaattgaaatcttggtttaaaggattacctattgttaatgataggattccttatacagaagtattgaacttaaaagaagaaggaatacttaaacatatagttaagcttcctactgctaagttaaagcaaagaccggattcggtccttattgttttagaggattctagggttttaagaactgttttacctgtaattgaaagagatgacaagttttggaaatcatgggatgagttagaattggattcgttatgtattaatgcttatactccacctattaagaaaccggagattccgtcaccttatttaggagttttgtccaaaatttctacgtatttgttatcatttgctaagggaaagccactgtcaaaaagggcacaggaaattcggagagctaggaatgagctgcaggcaagaacgaattttcagttagcgaaactaaggaaggatggtgagaggatggaaagggttattagagctcagatgaggagggaggagaggaaaaagaagaaagagttgggaaagacccactatcgggagaagttacttatcgcaaggaaacattatgaatatatggcacgttattggatcagaatgagtcgagatgataatgttgccactgctcttggttgtttgtttttctatatattttataggactgttattttgaactataagagacagcaaaaagattacgaggataggttaaaaattgaaaaagccgaggctgaggagaggaagaaaatgagggagttagagagacaattcgaagggggtgaaagtgttgatgatgaaaatgaggaaggtaaaactgaggataatccatatctgaagatggctatgcaatttatgaaatctggtgctcgtgttcgtcgggcacatagtaaaaagctgcctcaatatcaagaaagaggtttggatgtgaagttttcagatgttgcaggtcttgggaaaatacgtcttgagcttgaggaggttgtcaagttcttcacgcatggagaaatgtaccgaaggagaggagtgaaaataccaggtggcattcttctgtgtggacctcctggggtgggaaagacattactagcgaaagctgtagctggggaggctggcgttaattttttctcaatatctgcatcccagtttgttgaaatatatgttggtgtcggtgcttctcgggtgcgagcactttactcagaagcaaaggagaatgcaccatctgttgtcttcattgatgagcttgatgctgttggaagagaacgtggtctgataaagggttctggtggacaggagcgtgatgctacacttaatcagctccttgtatgccttgatgggtttgaaggaagaggagaagtgatcactatagctgccacaaatagaccagatattcttgatccagcacttgtgagacctggaagattcgaccgtaaaatttatatccccaagcctggttttgtaggccgtgctgaaattttgaaggtccatgctcggaagaagccaatggctgaggatgttgactatatggctgttgcaagcatggcagtgggtatggttggggctgatctagctaatataattgaggtggctgccattaatatgatgcgggaaggaaggtccgagattacaactgatgatttgttacaagctgcttatattgaagaaagaggaacgcttgagaagaaagatagaagcattgatatgtggaagcaactggctcttaatgaagcttccatggccgtagtcgctgtaaactttcctgataccaaaaacattgagtttatcaccatatcacctagagctggcagagaaatgggttatgtccgatttaaaattgattatgtgaaattcaaggaagggttgcttagtcgccagtctctcttggatcacatcactgttcagctagcaccacgggcagctgatgagatatggtatggtgaggataagttgagcacaatttgggcggaaacagcagataatgctaggtcagccgccaggagctttgttcttggtgggctttctgagaaacatcacgggttatccgaattttgggtcgcagacagacttaatgagattgatgtggaggcgttgcggattcttaacatgtgttatgttcgcgctaaagagatcctgcaaaaaaatcgaaacctcatggatgccatggtcaatgaactaattgagaagaaaaatctcacaaagcaggaattttttcacctggttgagttacatggctgccttgaacccttgccacctagtatcgtcgaaatcagagatgccaagcgcagacaactccaagcggcattgatgggcaaggagaccccccaaggaagcagtatatgagacaaataccaggatgcgtttgtcagagtatcttggtagaaaaagagagaaaattgatggagcacgaagtggtggcgtttatgtgctctcagtgagctattgctttcctggtccattcaagttatgcatgtcagaatgaaagttactgcaagccgtggtgccaacattctccagaggctgactggagttcgaataacagaattgctaaccaggagcacacaccaaagtcttagtggtctatacagtgacatccttccttcctttttgttattattcagcttgtatttattgtccatgtacttttctcaattttcaataatagaagttccattcttgcagtgc

SEQ ID NO: 2019 - DNA, 2974 bp, Papaver somniferum
actgaggaagcaatttctgcaacttttcagttgcaaataaatgaagtaagtaacattatccatcacatttccacctctttaaattcttttttcatggatagttacagttttcttagtcatcaagattccaattccaccaattgaagagtctgaaccctaaaactcatagaaatagaaaaccaatttacattccttcatcaatttcatgtaattttaaaaactcagaaaatgaagaaaaaaaagaaatggattagaattacttcaattttcagtaaccttatctgtaatttctgcatcattattatcaccaaaagctgcaaatgcagctgtaaagactacgaaatcagggaaacgggcagctaagaaggtagaagccttatcacctgaagagttgaaattatggtctaaagggttgcctgttgttagtaatagaattccatatacagagatattggatttgaaacaagaggggaaacttaaacatttgattaagctgccttcggggaatttgaggctgaagccggattcagttctagttgttttagaggattctagggttttaaggactgttttaccaacattggaaagagatgtgaatttttgggaatcatgggatgagttgaaattggatactgtttgtgttaatgcttatactcctcctgttaagaaacccgagtatccgtcgccttatttaggatttgtgaacaagttttcggagtttgtgatgtcgtttatgaagacaaagccactgtcgaaacgagctctggagattcagatggcgaggaaagagttgcagatgaggaagaagtttgagttggcgagagtgaagaatgaaggggagatgatggagaaggcgcttagaatgcagaagaagacggaagagagggaaaggaggaaggaaattagaaggatagagcaagaggaatcgttgcgtcggtctaaggagagttatgaaaggatggctttagtttgggcaaatatggctcatgatcagactatagcaggatttcttggggttttcttcttttacttgttttatagggttgttgtgttgaattataggcaacaacagaaggattacgaggataggttgaaaattgagaaagccgaccgggaggagaggcagaagatgaggcgattagagaaggagatggaaggtacagagggtgaagaggatgaggttgaaggtaaggatggtgataaaaatccttacatgaaaatggcaaatcagttcatgaaatctggtgctcgtgttcgtcgagcgcgccataggcgattgccccagtttcaggaccgaggtgtggatgtgaagtttacagatgttgccgggcttgggaaaatacgacttgagcttgaagaggttgtgaagttcttcacacatggagaaatgtacagaaggagaggagtaaagataccaggtggtatacttctttgtggaccccctggagtagggaaaactttgttagcaaaagctgtagctggtgaggctggggtgaatttcttttcgatttccgcttctcagtttgtggaaatatatgttggtgtgggtgcttctcgtgtgcgagcattatatcaagaagcaagggaaaatgcaccatctgttgtcttcattgatgaaattgatgccgttggtagagaacgtggtctaattaaaggttctggtggacaagagcgtgatgccactcttaatcagctccttgtatgcttggatgggtttgaagggagaggtaatgtcatcactatcgcagccacaaatagaccagatatccttgatccagcactagttagaccgggaaggtttgatcgaaaaatttacatccccaaacctggccaaattggtcgaattgagattctgaaggtgcatgctcgtaagaagccaattgctgaagatgttgattatatggccgtcgctagtatggcagagggaatggtaggagctgagctagcaaatattattgaggttgctgccattaatatgatgcgtgacgaacgaactgagattacaactgatgatttgttacaagctgtgcaaatagaagaacgaggaacacttgatagaaaggatagaagcctagaaatgtggaagcaactagctctcaatgaagttgccatggctgtggcgtctgtgaactttccagatctgaagaacgttgagtttgtcactatatcacctagagcaggcagagaaatgggttatgtccgggtgaagatggatcatttgaaatttagtgaaggaatgcttagtcgacaatctttgctggatcatattactgttcaattagcacctcgagcggcagacgagatttggtatggcaaagatcagttgagcacaatatgggcagaaacgggagacaatgccaggtccgctgcccgaagcttagtcctaggtggtctgacagataaacattatgggctgtctgatttttgggttgcagaacggcttgatgacatcgatttggaggccttgcagattcttaacacttgttatcaacgcgttaaagagatcctgaagcgaaatcaaacactcgtgaatgtcatggttgatgaactcgttcggaagaaaactcttacgaaacaggagtttttccgcctggtggacctacatggttcgctcgaaccaatccaacctactatccttgacatcagagctgctaaccgcaagaagttacaagaaaagatgatgcaccagatgaaagtatcacaacaaagcagcatgtgagaccgatgaaataaaaaacaaacaccaaaaaggcatcaagtccggtaggatgaagaagcttcacaacgaccaactggttcgaagcagacaccgagattcgagtaccatcaatgaacatcagaacctgggttgtactaaattttgtatctaggcatttctgttagtagttgttttgtcaatacattgttttcttgtaatcttgaacagttcgctgagcggcgggaactgaaagccggtgacaccggaaaaataaaa

SEQ ID NO: 2020 - DNA, 2826 bp, Cirsium arvense
ccaacacagtaacgtaataagtctcgttctatctctctctctctctctctctctctctctatatatatatatatatatttctaggttttgtgctcaatttccatggcagctcagtgtattcctgcttcttcgttgttctcttcaatttcgctatcgcgtagactgcaatctcgaagaattaggtactcagttaacgttaattcatcgattagatgtgaaaaatgtaacttagaaaccgaagaagaatcaaaaagtaggttaaacgcgttgaacttgcttcaaatctctgtgactttaacgataatatcagcttcgctacctcagcctgtgttagcagcgaaagtttctcagaaaaagcgttctccgaaaaaagtagaagcgttaacgcctcaggagtggcgaaaatggtcgcaagggctacctgttgtggctaatcggattccgtataccgatattttggagctgaaacgcgacggaaagcttaagcacatagttaagccccctggtaaaggattgaaggaaaggcctgtagttgttttagctgttttagaggattcgaaggttgttagacttgtggtgccttcgttagagagtgatcagaagttttgggaagcatgggatgcgttggagattgattcgatgtgcattcaagcgtatactcccccggttaagatgccggatgttcctaggccgtttttagggtttttattgaaagtgcctatgtggatgtattcgtttgtgaagccgaaaccggtgtcgaagaaggtgttggagttgaggaaggcaagggaggagcttaagaagagtaggagtaatgaaatgttgagtaggaagaaagaaatggtgaacaaggagaaggcgatgagagcgcagaagaagatggaagagcggaagaagaagttggaagcgcaaaagtttagaaccgagcaatccataaacatagctcgtgctaaatactaccgaatgtctaacatgtggagggaactgtctgaggatcccaacgttacgttgggtgttggcttgttgttcttttttctgttctacaagactgtgattttaaattataagaagcagaggaaggattatgaggataggttgaagattgagaaagtagaggccgaggagaagaggaaaatgaaggacttagagaggggaatgggtggagatgaagaggatgaggaggaagaaggaaaacagggtgaggataacccctacatgaagatggctgcacagtttatgaaatctggtgctcgggttcgccgtgcacaaagagctaaacgttccgagtacttggaaagagacgtcgatgtgaagttcacagatgtggctgggcttgggaaaatacgacttgagttggaggagattgtgaagttcttcacacatggggaaatataccgcaggcgaggagtcaaaataccaggcggtatacttctttgtggcccacccggagtgggaaagactttgttagcaaaagcagttgctggtgaggcaggcgtaaacttcttttctatttctgcatcccagtttgtggaaatatatgttggagttggtgcatcacgtgtccgggcactctatcaagaagcaagggagagtgctccatctgttgtctttattgatgaactggatgccgttggaagggaacgtggtttaataaagggttctggtggccaagaacgtgatgcaactctaaatcagctccttgtaagcttagatggattcgaaggcagaggaaacgtgatcactattgcttccacaaacagaccagatatcctggatcctgcacttgtgagaccagggcgcttcgatagaaaaatatatatacctaaaccaggcctaataggacggattgagattttgaaggtgcatgctcgtaagaaaccgatggctgaagatgtggactatgcggctgttgcaggtatggctgaaggaatggttggtgctgaattagctaatatcgttgaggttgctgcaattaacatgatgcgtgaaggaagaactgagatcaccacagatgacttgttacaatctgcacaaatagaagaaagaggaatgcttgataagaaggataggagcccggaaatctggaggcaagtggctatcaatgaagcagctatggctgttgttgcaatgaacttccatgatcttaagaatattgaatttattaatattgctccaagagctggtagggaattgggttatgtgcgggtgaaaatggattacatcaaatttgagcaagggtttatgagtcggcagtcgatgttagatcacattactgttcaactagcaccacgagcagctgatgagatttggcatggtgagggtcagttgagtacaatatgggctgaagcagcagacattgctaggtcagctgcacgagcactcgttcttggtggccttacagacaattattatggtgtacctatcgcctgggctcccgatcgaataaatgacattgataccgaggcattgcggatcctgaatacgagttatgaacgtgcgaaaaagatcctggagcaaaataggaaactgatggatgctgttgttgatgcacttgttgagaagagaagtctgaacaagcaagaattcatgaatctagtcgagttgcatggctgtattcaaccgagtctgccaagcatactagatatcagggctaaaaaacgtgcacagatgcaatcgatcaccgttaagcacaaggaagaagctaatccggccagcacgtgaccccacaaagattttcaacgtcttaaatgttgaagaagcggtttggtgctatctcaaaggagagtctgaatttgatatcgaaataatcattaaacaaaggtggag

SEQ ID NO: 2021 - DNA, 1349 bp, Brassica napus
gcaaatatatctcccacttgtattagctaagttccaaaaaaagcagaaaaaattcaaatctgaaatctctttctcggtttgtttgcttcaatatggctcctctacctatttcttcgattagagttggtaaatagaggatgttcaagaactaataaaatacaaaaccaaacaaagttccagagagattcataagagccgccaatgaaagaggaggcttagtgtcgcttaagactcactttcaccaacctattcctgttattgatctctctgaactctctaaacctcacactaatgatgattttgtatttgagattcttaagctctcacaagcttgtgaagactggggattttttcaggttataaatcacgggcttgaagtggatgtggtggatgatatagagaaagtggctaaggagttcttcgagatgccattggaggagaagcagaagtatccactggagccagggaccgtacaaggatacggtcaagctttcattttctccgaagatcagaagcttgattggtgcaacatgtttgctcttggtgttcatcctccttctattcgtaaccccaaactttggccttctaagccggctcggttcagtgaaagccttaaaggttactcaaaagaaataaggaaattgtgcaagaggttgttgacgtacatagcaataagcttgggtctaaagaaagagagatttgaggaaatgtttggggaagcagtgcaagcagtgaggatgaactattacccaccatgttcaagccctgatcttgtcttgggacttagtccacattctgatggaagtgctctaacagttcttcaacagagcaaggacagttgtgttgggcttcagatcctcaaggacaatacttgggtccctgtcctacctcttcccaatgcacttgtcatcaacattggtgatacagttgaggtgctaactaatgggaagtacaagagtgtggagcatagggcagtgacaaacagggaaagggagaggcttacaatagtgacattctatgcaccaaactatgaggttgaaatagaaccaatgggtgagttggttgatgatgaaaccaacccatgcaagtatagaagttacaatcatggtgactacagttatcactatgtctccaacaagctccaaggaaagaagtcccttgattttgccaagattctgaattaactagtattactttcacaaccctttcacgatccattaactagttaccacttatttctcttattcttataaactttaggtttggaacttttgtgtgtataataatcggaatgttccccacctaagggttttgacgtcatgattgaactccccaatgtacatacaacc

SEQ ID NO: 2022 - DNA, 1220 bp, Brassica napus
ctacaccttcatcatcatattcctgttgttgatctgtctaaactgtctaaacctcacactgatgatgattttctctttgagattcttaagctctcacaagcttgtgaagactggggatttttccaagttataaatcatgggattgaagtgggtgtggtggaagatatagagaaggtcgccaaggagttcttcgagatgccactggaggagaagaagaagtatccaatggagccagggaccgtacaaggttacggtcaagctttcatcttctctgaagatcagaagcttgattggtgcaacatgtttgctcttggtgttcatcctccttctattcgtaaccccaaactatggccttctaaaccggcccggttcagtgaaaatcttgaaggttactcaaaagagataaggaaattatgcaagaggttgttgaagtacatagcaataagcttggatctaaaagaagagagatttgaagaaatgtttggggaagcagtgcaagcagtaaggatgaactattacccaccatgttcacgtcctgatcttgtcatgggactcagcccacattctgatggaagtgctctcactgttcttcaacagagcaagaacagccgtgttgggcttcagatcctcaaggacaacacttgggtccctgtactacctcttccaaatgcccttgtcatcaacattggtgatacaattgaggtgctaactaatgggaagtacaagagtgtagagcatagagcagtgacaaatagagaaagggagaggcttacaatagtgacattctatgcacccaactacgaggttaaaatagaaccaatgggtgagttggttgatgatgaaaccaacccatgcaagtatagaagctacaatcatggtgactatagttatcactatgtctccaacaagctccaaggcaagaagtcacttgattttgccaagattctcaattaactatattattttcacacccctttcaccttccattaactagttaccacttaatttgttttatttttaagaatttagttgtgggactcttgtgtgtataatgtacaggaatgtttcccacttaggggttttagtgtcatgattaaattccccaatgtaactacaacttgtaatatattatgtgtgtgtgtgggtggagttgggtgtgtttatgtatccatatgtatgccgagaaggaacataaagaataagaaagaacaacatcagat

SEQ ID NO: 2023 - DNA, 2419 bp, Trigonella foenum-graecum
cggccggggctggttgtaaaccctaaaccctagcaaatttctcgagaaaatcacaaaacacaaagcacacacaaatccttcaatctcttccaatggcgccagcaactaagaaaaatcttcaaagccagtcaaagctcaaaaagcccccaaaaagttcaaattgttccaatcaaacacgattccacttccgaatccgaagatgaagaagcaccaccgcttcaacctctggaactcggttccgacgacaacaacaactccgatggttccgattcggacttatcttccgatggtgatgatcaattagccgatgattttctccaaggaagcgatgacgaagacgaagacgaagagaaaggttccggtttggattcggattcggattcggatgatgacgaggtcgctgatattgaaaagaggtctgaacttattgatgcacgaagggatagtgatcagaaggcagctatggatgaattgacgactaacattcaagaagagtctgatgagttcagattaccaaccaaacaggaacttgaggaagaggctttgagtcccccagatctttccaatctacagaggaggattaaagagattgtccgtgttctttccaattttgcggcgttgagacaagatggggcaacgaggaaggattatgttgatcagcttaagaccgatatacgttcatactatggctacaatgagtttctaatcggtgctttagtggagatgtttccagtggttgaactgatggaactgattgaagcctttgaaaagcctcgtcctatatgtctgaggacaaacactttaaagacacgaagaagggatttggcagatgtcttgataaacagaggagtaaatctggatcctcttagcaaatggtcaaaagttggacttgttgtgtatgattctcaagtaccaattggtgccactccagagtacatggctggtttttacatgcttcaaagtgctagttcttttcttcctgtgatggccttggctcctcaagaaaaggagcgaattgttgatatggcggctgcacctggtggtaaaacaacttacatagctgctctaatgaagaactcaggaataatttttgccaatgaaatgaaggtaccacggctaaaatctctgactgcaaatttgcataggatgggtgtatcaaacactgtagtctgcaactatgacgggagggagcttccaaaggttatgggtttcaattcggttgatagggtattattggatgccccttgcagtggaactggggttatatccaaagacgagtcagttaaaacttcaaagaacttggaagatataaagaaatgtgctcatctacagaaggagctccttcttgctgcagtggacatggtagattcttattcaaaatctgggggatacgttgtatattctacatgctcaatcatggttgctgagaatgaagcagttattgattatgtgctcaaaaggagggatgttaagctggttccttgtggacttgactttgggcgtccagggtttacaaagtttagggaacagcgttttcacccttcattagataagacaagacgtttctatccacatgtacacaatatggatgggtttttgttgcaaagttgaaaaaatgagccacccaaaacctgctgcaacatcagaagcatctgaaaaggatgaaacagaaatcgagcttgtgatggacgacgataaacctagtaatggcgttgaagaaaatggcaaacattcttctgaacctgaatccaagaagaggaagaaagataaattcccctcaaaaccaagtaatgatgtaaaagctaatggcaaagaagcttctgaacctgaatccaagaagaggaagaaagataaattcccctcaaaaccaaggaatgatgtaaaagctaatgtcacagatgcttctgaacctaaacccaaaaagtgggagaaaaagaaacgtccatctagagaggagatttcaaaagccagagaggagaagagacttgctttaattgaaaagaagagaaaaagtggtaagcaagagagaagaaaatgatgaatgaccagtggtaattcaggaagtagtgatgaccatatctgtgcaattatagcacagaattgactcagattccatcaatatgggagtactgaggtgcttgcctgtcaaaagaatgtaccttggagtcagtgtcatgacctgatcgaaggtcccagttttgttttgttaagttatttagctgaggcatttttaacatacatctgtttaattaagctgtaaaatcagaatggagaaaaggtgttttttaggcatgaattcatttgaatttttcttctttcttttcttctttctaatgcttgttttcatgtctagtgcccctccgtatttgttataatttgtaagaattagtacacttgcgtttaatgatattataaaatt

SEQ ID NO: 2024 - DNA, 2264 bp, Glycine max
tttcctccaatggctcccgcaaggaagaaaccttctaagccaagcaaatcgccgaagaaccctaggaagacccatcccaagcacgattctacctccgaatccgaagaagacaccccgccgcaactgcaaccggagcaactcgagctcggcgacgacaactccgattccgcgtcggagctctcctccgatggcgacgatccgttagccgatgatttcctccaaggaaccgatgacgacgaagaaaaaggctcaggttcggagtcaggtttggagtcaggttcggattccgattcggatgatggtgatattgaaaagaagtcgagagctattgacgaagagaaggcgaaagaggaagaggacgcggatgccgaaatgcagctcaacatcaaccaagagtctgatgagttcagattgcctaccaaagaggagcttgatgaggaggctctccgcccacctgatctttccaatctccagaggagaaccaaagagattgttcgtgttctttcaaattttaaagctttgaggcaagatgggtcaacgagaaaagagtatgttgaacagcttaagaaagatttatgtacctactatggctacaatgagttcctaattggtgctctagtggagatgtttccagttgttgaacttatggaactgattgaagcctttgaaaagccacgtcctatatgtctgaggactaatacattgaagacacgcagacgggatttggcggatgttttgataaataggggagtaaatttggatcctctaagcaaatggtcaaaggttggacttgttgtgtatgattctcaagtgcctattggtgccactcctgagtacatggctggtttctacatgctacaaagtgcaagctcttttctgcccgttatggctttggctcctcaagagaaggaacgagttgttgatatggcagctgcacctggtggtaaaacaacttacattgctgctctaatgaagaatactggaataatttttgcaaatgaaatgaaggtaccacgacttaagtcactgactgcaaatttgcatcgcatgggtgtatctaacactgtagtgtgtaactatgatggaaaggagcttccaaaggttttaggtgtaaatgctgttgatagagtattattggatgccccttgcagtggaactggggttatttccaaagatgagtctgttaaaacctctaaaagtctggaagatatacagaaatgtgcgcatctacagaaggagctcattcttgcagcaattgacatggtggatgctaattcaaagtctgggggatatgttgtttattctacatgctcaattatggttgccgagaatgagtcagttattgactatgcactcaaaaagcgggatgttaaattggttccttgtggacttgattttgggcgtccaggatttacaaagtttagggaacaacgttttcacccttctttagaaaagacaaggcgtttctatcctcacgtacagaatatggatggtttttttgttgcaaagttgaaaaaaatgagcagctcaaagcctggtgcaatatcatcagaaacagccgagaaagaagacactacctcgttcgtggaggaaaaggagaaatcaagtgatggcataaaagaaaatggcaatgtatcttctgaatcagaaaaggggaagaaaagaaagttcccctcaaaaccaagtaacggtctaaaatcaaatggcaaagaatcttcagaatctgaacccaaaaagaggaataaaaggcaatttccatctaaggaagagatttcaaaagccagggaggataagagaaatgctttaagagaaaaaaggagaaaaggtggcaaacaacagaagaacaaaaaatgatcaaagccagtggcaatacatgaggcagttatagcaccgactcgactcgactcgactcgaagatggaagtactggggtggttgcttgtcataggagtgcaccccggaatcagtggcatgccctaatctagggcacatttttgttttgtttttaaggttattatttagccgaggtatattttataacttccatctgcaaaggtgtaaatcagaaagaaaaaatatttctttttcgtggcatcaattatttggggtttattttcttatcattatcttcaatcttcatgtctattgtcttggatgttaattatccttctttccattacacgtgcttcaaatattgatgattcaccatgtttcagatgttactgttatgttttcatgatcaagtctatctattattaaacactt

SEQ ID NO: 2025 - DNA, 2296 bp, Cajanus cajan
ccgatttttctttttcagaagaaagaagaagaaacacagcgcgcgcaaaccacacactacactacaccactgcttcattcactttccttcaatggctccgccaaggaagaaaccctcgaagccacgcaaatccccgaagaacccgaagaggaccgaacccaagcacgattccagcgacgagtccgaggaagagatgccgccgcagcaactcgagctcggcgatgacggcgccgactccgattccgcgtcggagctctcttccgacggcgatgatcctttggccgacgatttcctccaaggaagcgatgacgaagagaaagcctcgggttcggattcaggttcgggttccggttctgattcggatgatgatgatattgaaaagaagtcgagagctattgatgaagaaaaggcgagagaggaagaggacgcggaagccgaaatgcagctcaacatcaaccaagagtctgatgagtttagattacctaccaaagaggaacttgaggaagaaactctgcgcccacctgatcttaccaatctccagaggaggattaaagagattgttcgtgttctttcaaattttaaggctttgaggcaagaggggtcaacaaggaaagattatgttgagcagcttaagaaagatataagtacatactatggctacaatgagtttctaattggtgctctagtggagatgtttccagttgttgaacttatggaactgattgaagcctttgaaaagccacgccctgtatgtctgaggactaacacattgaagacacgcagacgggatttggctgatgttctgataaataggggagtaaatttggatcctttaagcaaatggtcaaaggttggacttgttgtgtatgattctcaagtgccaattggtgctactcctgagtatatggctggtttctacatgctacaaagtgcaagctcttttctgcctgtgatggccttagctcctcaagagaaggaacgagttgttgatatggctgctgcacctggtggtaaaacaacttacattgctgcactaatgaaaaatactggaataatttttgcaaatgaaatgaaggtacctaggcttaagtcactgactgcaaatctgcatagactgggtgtatctaacactgtagtttgtaactatgatggaaaggagcttccaaaggttttaggtgtcaatgccgttgatagagtcttgttggatgccccttgcagtggaactggggttatatccaaagacgagtctgttaaaacttctaaaagtctggaagatatacagaaatgtgcacatgtacagaaggagctcattcttgccgcaattgacatggtggatgctaattcaaaatctgggggatacgtagtttattctacatgctcaatcatggttgctgagaatgaagcagttattgactatgcactcaaaaagagggatgttaaactggttccttgtggacttgattttgggcgtccagggtttataaggtttagggaacaacgttttcacccttctttagaaaagacaaggcgtttctatcctcacgtgcacaatatggatgggttttttgttgcaaagttgaaaaaaatgagcagctcaaagcctggtgcaaaaccatcagaaacagccgaggaagaagaaactactacgtcagtgaaggaaaaggagaaatcaactgatggcataaaagaaaatggaaatgtatcttctgaacccgaatccaaaaagatgaagaaaaggaaattcccatcaaaaccaagtaatggtttaaaagaaaaaggcaaagaatcttctgaatctgaacctaaaaagaggatgaaaaggcaatttccatctaaggaagagatttcgaaagcaagggaggagaagagaaatgctttaagagaaaaaaagagaaaaggtagcaaaaaacaacagaagcaaaaatgacccgttggcaatacatgaagcagtgatagtcaagtgtgcagttttagcgcagaaccgactcaactccaacaagatggaagtgctgcctgtcacaattttgtaccctggaatcagtgtcatgccctaatcttagggggcccatttttgttttgtttgtaaggttattcatttagctgaggtttattttaactttcgatatgcaaagctgtaaatcagaaaagaaatattcctttttcttatgtggtattatttaatttgaatttattttctaatcaatattgtcctcgatgttagttgtcctccatacgaattacacttgcatcaaatggttttataatacctatgattgatcatgtttcaattgtttta

SEQ ID NO: 2026 - DNA, 1906 bp, Medicago truncatula
acaactcactccatccatcaatggcggttcctccctccgccactccagcttctctttacgtcggcgatctccatcccgacctctccgactctcagcttcacgatgctttctccgatttcaaaactctcgcttctgttcgcatttgccgagactcttcctctggtaaatcactctgttatggttacgtcaacttcctctcccctcacgacgcaattcgtgccattgaggtgaagaatcattctacattgaatggaaaagctattagggtgatgtggtcacgtcgtgatcctgatgcaaggaaaagttgtatagggaacgtgtttgttaagaatttagctgaatcaatagataattctggattagaggatatgtttaagaagtttgggaatattttgtcaagtaaagttgtaatgtctgaggatgggaagagtaaaggatatggctttgttcaatttgaaacagaggaatctgcaaatgctgctattgagaggttgaatggatatcttgttggtgataagcaaatatatgttggaaagtttgtcaagaaaagtgaccgcatatcgtctggcccggatactagatatacaaacttgtacatgaagaatttggacttagatatttcagaaacacttctgcgtgaaaagttttcctcttttgggaaaatcattagcttggctgttgcaaaggacagcaatggtatgtcaaagggttttggcttcgtgaacttcgataacccagaagatgctaaaagggcaatggaaacaatgaatggattgcaactaggttcaaagattctgtatgtagccagggcacagaagaaggctgagcgtgagcagatcttgcaccagcaatttgaagagaaacgaaaggaacaagtcttgaaatataaggggtcaaacatttatgtgaagaatattgatgacaatgttagtgatgaaggactgagagatcactttagtgtatgtggcactataacttctgcaaagattatgcgagatgacaaagggataagcaaaggatttggttttgtgtgcttctccactcctgaggaggctaataaagctgtgaactcttttcatggattcatgttccatggtaaaccgctatatgtttctcttgctcagcggaaagaggacagacaggcacagttgcagctccaatatgcccagcaaattgcaggactcgctgggccttcaactgccattgtccctggtggatatcctcctttctactacacagctactggtgttgtttcacacgcgcctcctcgtgctgggctcgtgtatcagcctatggcattgaggcctggatggagggctaatggctctgcacctcctgccagatcattccaacagtcacctacgcctgttgtttctaacaataatactaggcagcataggcaaaataggggtaggatgaatggccatgcagtatcacagggaaatactcactctggtacatatatgccacaagcccagcaggcttctcagtcagcgatctcttcaagagagtcaagtactcagcagagaactgggcaagctaagtatgtacctagtgggcgccaccgtgagatggaaaaaggatctggattatcatctagtggaggatccttgggaccagaagtgctgcatagcatgcttgctaatgctactccagagcagcagaaggagatacttggcgaacatctatacatgcttgtccagaaaatcaagcctaacctagcagcaaagattactgggatgcttttggagatggacaatgctgaattgctggttctcattgatcaccagagtctctttctgccaaggtggaagaagctttccaagtgctgaagaactctaaagctaaagtttctggtcaggatgtacttcattcaaatttcctttcagctgaggttgctgtgaac

SEQ ID NO: 2027 - DNA, 1780 bp, Glycine max
ttgttaattaataatttcgaaagaaatatgccagattcgagaccagcgagatgctggcaacgttcctgacgtcgacgccgctgctatcggagtcatggcagctgtgcacaaccgccgccgccgccgcgcctcggagtttcgtgaccgagcaacgcggtggcggcgtggtgtacgtggctttccccggggtcgaaatggtggcggcgtcgacggactctagctggagaaactttgtggcgttggatagcatcggcgacatgccactgttctcggcgcgtcgtctcaacaaggaaggcgatgagcctgtgatggtgcatgctgggatgctgaatctcttttccatctttttcgaaccattccaaaaacagatgttggcaatcatgggagacaccaacaccaaattcattgtcataactggccattccattggaggagccacagcctctctatgtgctctttggctactatcttaccttcaccagatatcttcctttatgtccgtgtcagtcttatgcatcacttttggttcaccaatgctagggaatggttctttctcacgtgctattctcagagaaagatggggtgccacacactatggtgaagggtctgcacatgtttggtttcacccgtttgggagctacctttttgtttcatcagaaggagcagtgtgtgtggatggtgcaaatgctgttataaagatgatgcatttgatgtttgcatcaggttctcttgcttgtagtattgaggaccatctgaagtatggagagtatgttaagaatttgtctttgcaattcttgaaccagaacaattccatgcaggggagcattcacgattcaagctatgaagcaggacttgaattggcggttcagtcttcaggtttggctagccaggaatcagaaatcgaacctgccaaggagtgccttaagatgacaaggaggatgggtccatcaccaaccaagaatgctgctaacttagcaattacattatcaaagtttgtgccttatagggccgaaatagaatggtacaaagcttggtgtgaccagcaagttgatcaaatgggatactacgacttgttcaagaggagaaggagcacttcgagaatgaccatgaaagtcaacatgaatcgtcacaaacttgccagattttggaacaatgtgattgaaaaactggagacaaatgagctgcctcatgatttagcggtgcgggctaaatgggtcaatgcttcacatttctacaaactattggttgagccactagatattgcagagtattatgggaaggggatgcacacaaccaaggggcattacatacagcatggcagagagaggaggtatgagatttttgataggtggtggaaggatggaatggccaacacggaagaaaataatgagaggaggagcaagtttgcaagtttgacccaagattcatgcttttgggcaagggtggaggaagcaagggagtggttggacagtgtcagaagtgagagtgacacaacaaagctggctgtgctgtgggataacattgagaaatttgagaagtatgctatggaacttgttgataataaggaggtgtctgaagatgttcttgccaagaactcaagttacagtatatggctggaagatttaagaggactgcgggaactcaaagcaaaggtgaagaggttttcacaccactttaacccgtttctggatggagaagtaattccttaataatttaagatgaaatcaataaataagcttaactttgtagtcagtaatatgcctatgaactacttgtttgc

SEQ ID NO: 2028 - DNA, 1211 bp, Glycine max
gcatataaaatgcttccatcttcttgttgttggcagtgagaagaaaaatgggaggaagaatgcacacgaaatcagactcggaggttacgagcaacagcatggagcagtcgtcaccgtcgcgttcccctccgcggcggccactctactacgtgcagagcccttcgaaccacgacgtggagaaaatgtcgtacggttcaagccccatgggttccccacaccaccatttccactactacctctcttcccccatccaccactcccgcgaatcctccacctctcgcttctccgcttccctcaaaaaccctcgcagcaacttctcctcctcctcctcctggaagaagctccacccacaccccaaccccgacgccggcctcgacgacgacgacgacgacgacgacggcgacgacgacctcaaccacttcccccgcaacctccgcctctacttctgcttcttcctcctctttcttctctttttcaccctcttctctttgatcctatggggcaccagcaagagctacaagcctcgaatcattgtcaagagtatagtgttcgagaacttgaatgttcagtcaggaaacgatggaactggggtacccactgatatgttgtcgttgaactcaacggtcagaattttgtatagaaacccagccactttcttcggcgttcatgtcacttctacccctcttcaccttagctattaccagcttgcaattgcctctggccagatgcagaagttctatcaatcgaggaagagtcagcggaagttggcggtagtggtgctaggacaccagattcctctctatggaggagtgtcagttcttggaaatactaaagagcacttggagaacgttgcattgccactaaaactgacatttgtagtgagatcaagggctttcatcttgggaagattagttaagtctaaattctatcgaagaatcacatgttctgtcactttgcatggcaacaaacttggaaaacatcttaatttgacggattcatgtgtctacaagtgatatatattattccctcaatccttaaaatggttcggacatgctatcactttatcacttgtgaagatagctggtacatttttggctcgtttttcttagttttttattgcccatcatctagcagaacgaacttgtccttttgtctccgtaaatatctgaacgccaattttaatgtaatatgtgttcattttgattcctttt

SEQ ID NO: 2029 - DNA, 1288 bp, Phaseolus coccineus
atattagttaattgtgaaaggctaagtctgacagtaattgaatggtttgatttgatttgatcagtggtgtataaaaactaatgtagttggagagagagagagagagagaaagagaagagaagagagaagaagatgggtggaagaatgcacacgaaatcggactcggaggtaacgagcaacagcatggagcaatcgtcgccggcgcgttcgcctccgcggcggccgctgtactacgttcagagcccttccaaccacgacgtcgagaaaatgtcttacggttcgagtcccatgggttccccgcaccaccatttccactactacctctcttcccccattcaccactctcgcgaatcctccacctctcgcttctccgcctccctcaaaaaccctcgcaacttctcctccaactggaagaagctccacccacacccccagcacgacgccgatcccgacgacgacgcggacgacggcgacgacctcgaccgctcctcccgcaacctccgcctttacttctgcttcttcctcctctttctcatgctcttcacactcttctccatcatcctctggggcgccagcaggagctacaagcctcgggtcattgtcaagagcatagtgttcgagaacttgaatgttcagtcggggaacgatggaagtggcgtgccaacggatatgttgtcgctgaactcaacggtcagaatggtgtacagaaaccctgcgactttcttcggcgttcacgtcacttccacgccttttcagctcagctattaccagcttgcaatagcctctggccagatgcacaagttctacgagtctagaaagagtgagcgaaagttgtcggtagtggtgtttgggcaccagattcctctctatggtggcgtgtcagttcttggaaacactaaagagcatttgcagaatgttgcattgcctctgaatctcacgtttacggtcagatcaagggctttcattctgggaaggttggtgaggtcgaaattctacagaagagtgagatgttctgtgacattgcatggcaacaaacttggaaaacctcttcatttaaccgattcatgtgtctacaagtgagatgttgtgtccccttatcacggattcatgctttccgtttatcacttgtaaaggttgctgctgctacattttttgctccttatttttagtcctttgtcacccatcttctagaacaacaaatttgtccatttgtatccgtaaatatctgaacgccaatttttaatgtaatgtctcattttcgtaacttttctcttcctggtcctgcgca

SEQ ID NO: 2030 - DNA, 1235 bp, Cajanus cajan
gtaagtggcattggcatagttgtattttgtttaatagcgtgtgtgtgtgtgtgtgagtgtgtgagagaagaaggaaaatgggaggaagaatgcacaggaaatcggactcggaggtgacgagcaacagcatggagcagtcgtcgtcgccgccgcgttctccgccgccgcggccactgtactacgtgcagagcccttcgaaccacgacgtggagaaaatgtcgtacggttcaagccccatgggttccccgcaccaccacttccactactacacctcttcccccatccaccactctcgcgagtcctccacctccctcaagaaccctcgccacttctcctcctcctggaagaagctccacccccacccccaccacgacgcggccgccgctgccgacgaggacgaggaggacgacctcctccagcagtcctcccgcaacctccgcctgtacttgtgcttctttctgctcttcgtgatgctcttcacgctcttctccgtcatcctctggggcgccagcaagggctacaagccacgtgtcactgtgaagagcattgtgttggagaatttgaatgtacagtcagggaacgatggaagtggggttccaacggacatgttgtcattgaactcaacggtcagaattgtgtacaggaatcctgcaactttcttcggcgttcacgtcacttgtacccctcttcttctctcctattaccagcttgcactagcttctgctcaggtgcacaagttttatcagtcgaggaaaagtcagaggaagttggcggtagtggtgttaggacaccaggttccgctctatggtggggtgtctgttctggggaacacgaaagagcacttgaacaatgttgcattgccactcaacctgacgtttgtagtgagatcgagggctttcatcttgggaagattggttaagtctaaattctatcgaagaatcagatgttctgtcactttgcatggcaacaaacttggaaaacatcttaatttgacagattcatgtgtctacaaatgatgtatatcataaatggttcggacaaactttgggttttcacgcatgaaaatacagatggtacatttttggctccttatttttatatttttgttgcccgtcgtctagcataacaaacttttccattggattctctttggtactagggcctcattgcaaggtctccgtaaatacctgaacccaaacttactttaatgtaatgtaaactctctttatctttag

SEQ ID NO: 2031 - DNA, 907 bp, Raphanus sativus
aggacatttgtttcttgtcttattccctcttctctctttgctttgctccacaaaaaaaaaggaaaacattactacttagtttgaggcagaagatggagagaagaacctaagtgtaacaaatcttttgttggtgaagatcagttacaattttctgcgttctttctgaagatgacaacaatagcaggaggatcatttggagctaccagctctcgtatctctatactcaccccaactctttcatcctcttctttgtttccaccactaacattgcatcagtcaggtaataaaaaggatagtcagctgcgttgtgccgtgcaagagtcttccacttctgctgttgctactgagaagaaagaaaaaggaaaagaaaaagaagactcaacagtggaagttccagcaaagaaaccaaaaccggcagctgccaaggcagccgtggcaaaaccactgggagaaatgatggaagaagacgtgattcctccactaaaagccattcttgaagctcaagatgatatatctgagattgatttatctttccaagacgataagcttgagggttttttcttcaagaaaggtattcaatattccttctgggccttcttccccagtggtaatctcacaggagcaaagggcttttcaatctcctcatacggatcaggtccaagtaccgtagagccgtttctagtcgacgagaggaaaccaactgcaaaccacgttgtgttttgggtcgagaagcgccttgctgcacaagggattattcccgtctggaaccaataatgtaaaggaggttgtgtttttattattcacttgtttataataaacaattacatttcgtataccaaaactgaagaaaatcaaagtcgtcgtatctctcaatatggattaacgaagagacactcttcattaagca

SEQ ID NO: 2032 - DNA, 1049 bp, Eutrema parvulum
gattgtttgaaatagttatgcaaatttttttctttgttactaaaatatgttatatcctctttaatctgtggttgacaactcttggagtcagcctttttgtcacatttggttttgtcttattgcctcttcttttccttcgctttgctccacacacaaaaaaaaaacattactgtttggtttgaggcagaagatggagagaagaatctgagtgtaacgaatcttgttattggtgaagaagatcagttataagttctgtgttcttcctgaagatgacaacaatagtaggaggatcatttggagccaccagctctcggatctctacacccatcccaactctttcttcctcttctttgtttccaccactaacattgcagcaatcaagtaataaaaaggataaccaattgcgttgtgtcgtccaagagtcttcttccacttctgctgttgctactgagaagaaggagaaagacaaagaaaaagaagactcaacagttgaagttccggcaaagaaaccaaaacccgcagctgctaaagcagcagtggcgaaaccgcttagagagatgatggaggaagacgtgattcctccattaatatcaattcttgaagctcaagatgatatctctgagattgatttagcttttcaagacgataagctggagggttttttcttcaagaaaggtattcaatattccttctgggccttcttccccactggaaacctcacaggagcaaagggcttttcaatctcctcatacgggtcaggtccaagcacggtggagccatttctagtcgacgagaggaaaccaactgcaaaccacgttgtgttttgggtcgagaagcgcctcgctgcacaggggattattcccgtttggaaccaataatgttaggaatcgaaagtgagatggaactttgaacgatatgtaaaggacatgactaccttgaagtattttattcacttgtttataataaaaaagttacatttgtacaccaaaattgatgaaaagcaaagtcttgctatccctcaaaatttatgctaatccattttcagtaga

SEQ ID NO: 2033 - DNA, 903 bp, Arabidopsis thaliana
gtggttggcaaatcttaggctcagcctttttcacatttgtctcttgttttatttcctcttcttttttcctttgcttttggtccactaaaaaacattagtcttgagtttgaggcaaaaaatggagaaaaactgagaattttgagaacaacgaatcttgtaatcgttgaagaagctcaattacagtttctgtttcttcctaattatggcaacaatagcaggaggatcatttggagtcccaagctctcgtatctctataacaacaccaactctctcttcctcttctttgcttccaccactaacattgcaatcaggtactagaaaggacaaccttttgcggtgtgccttgcaagagtcttcaacttctgctgttgctactgaaaagaaaaacaaagaagaaggagaagagtcaacagtggcggttccggcaaagaaacctaaacccgcagctaaagcggctgcagtggcgaaaccgctgagacaaatgatggaagaagacgtgattcctcctttacaagccattcttgaatctcaagatgatatctctgacatagatttatctttccaagacgataagttggaaggttttttcttaaagaaaagtattccatattccttttgggcctttttccctactggaaaccttacaggagcaaaaggattttcaatttcctcacacgggtcaggtccgagcaccgtggaaccatttcttgtcgacgagaggaaaccaactgcgaaccacgttgtgttttgggtcgagaagcgtcttgctgcacaagggatcatccccgtttggaaccaatgaggtttttgttcacttgtaattattacatttgtataccaaaattgaagaaaacttataaatccttgtcataaaattgattaagaaaacaaatgaccctcttt

SEQ ID NO: 2034 - DNA, 1321 bp, Cajanus cajan
tagcaaggaagtagtggtggggatcgtgccacgtgtcggtgctttcttaaacccaagaatccataacgacttggctaatgaatagtgcaaaattgcaacaccaacttcaacttcatcttcacttatccattgctccattcgctattcgctatgttccttctcaagacatggagaaaaacggcttttggtgtttttggctaccttaatttcaccaaagctggtttccttgatcattctaagaaattcaaaccagaggacatggaaattcgaataccagggaagaattgcattgttactggagctaactctggaattggctatgcaacagctgagggtcttgcaaaccgaggtgcaactgtctatcttgtatgtcgtaacaaggagaaaggagaggctgctctttctgatattcgaactaaaactggcaatctgaatgtatatttggagatttgtgacctttcttctgtcaatgaaatcaagtcatttgcttccaggttttctgaaaagaatgtgccagttcatgtgttggttaacaatggtggcttacttgagcaaaatcgagttaccacatcagaagggcttgagttgaactttgctgtaaatgtgttgggcacttacaccatgacagaattaatggtaccattactggaaaaagcttcccctgatgcacgtgtcataacagtatcttctggtggaatgtatacttctcccttgaccaaagatctacagtattctgagagcaactttaatggagttgaacagtatgctcgaaacaagcgtgttcaggttgcactaacagaaaagtgggccgagacatataagaacaaagggataggattttactcaatgcaccctggttgggctgagactcctggggttgcaaagagtttgccaagcttctctgaatcgttttcggggaagcttagaacaagtgaagaaggtgcagacacagttatctggttgacactacaaccaaaggagaaactggtatcaggtgcattttattttgatagagctgaagctccgaagcaccttacatttgcttgtactagagattctcatgctttgatcgactctattgttgatagtcttaattccatggcttcttttgtctaatattgtacttttaccctcgcattaagttgcaacttgcaattaatcataaaacccagttgtgcatcaatataacttttctaaagtttgtaatagtatagattattttcagcaatcatctatggcttatttttccaaccaaatcaaacatttgaattgtactaacttttataactgactagaaataattattatagattatgggttt

SEQ ID NO: 2035 - DNA, 2447 bp, Brassica rapa
cccaaattctccagttataattttaagaaaagtgggaccaaccaataagaaatgtcgcaaaaagtcaatgccaacgacgcgttcatttgactagcaaagtcttcgccgtctccttgtggttatctctattctcctcctctctgtttaaatcaggagagattacctcaaaagccaaacacttccttcaaacaaacaccaccacatggctgcgcgtacactccacgcgctatccacctcccctttatttctcctccttcttttcttcgccgcgtcttcaccgaccaaagctcagcaaccgtacgtcaacaaccaccagctagactgtgagaatcgtgacttcgacaacataaccaacggcttcacctgtaacggcccacgctcatgccgctcctacctcactttctggtctctcccaccgtacaacactcccaactccatcgccacactcctcaacgcctccgccgccgagatccagaccctcaacaacctcacctccctaaccaccgtaatccccacccgtcgactcgtcgtcatcccgaccacctgctcctgctccggcggcggtggcttttaccagcacaacgccacttacagactctccggcgaaagacaggagacttacttctccatagccaacgacacctaccaagctctctccacgtgtcaagccatgatgtcgcagaacccttacggcgagaggaacctaaccgccgggctaaacctcctcgtccctctccgctgcgcttgccccaccgcgaaccaaaccgccgcggggttcagataccttcttacctacttggtcgcgcagggagacagcgtctccgccatcgccgagatgttcagaagctcaacacccgccgtgagctccggcaacgagctcacgtccgacaacatctacttcttcactccgcttctcgttcctctcaggacggaacctacaagaatcgtgattactccgccgtcgccgacgccgccggttgctactccgccgcagtcgccgccggtggatcctccgggggggtcttcttcttcacacaaatggatttacatcggagttggaatcggagccggtttgctcctcttgatctcaatcttatctctctacttctgttactacaaacgaagatccaaaacgtcgtcgttgatagaacagaacaagcttacggactcctcgaccaaacagtctcttccgacaacgtcaacaaaccaatggtcgatcgccttatcaaactcctcagacaccacgtctggtctcaaatcagctatagagtcgttaactctctacagattcagcgatcttcagtcagcgacttcgaacttcagcgaggagaacaagatcaaaggctcggtgtataaggcaacgatcaacggagacgacgcggctgtgaaggtgatcaaaggagacgtgtcttcctcagagatcagcctcttgaagaagctgaaccattccaacatcatccgtctctctggcttctgcatccgcgaaggagcctcgtaccttgtctacgagtactcggagaacggttcggttagcgattggcttcactcgtctaacaagaagaagagtctgacatggagacagcgagttgagatctgtcgggacatagctgaggcgttggactacttgcacaactacgtgacgccgcctcatatccacaagaacttggaatccaacaacgtgcttcttgattccaacttcaaagccaagatttcgaatttcggcgtagcgaggattcttgacgaaggtgatctcgatcttcagttgaccagacatgttgaaggaacacaaggctacttagctccggagtatgtagaaaacggagtcataactccgaagctagacgtgtttgctttcggagttgtggttcttgagcttctttcggggaaagaagcggtgacgacggtggataaggaggagaaggaagagatgttgttgtgtagagagataaacaatgtgcttggaggagagaatgtgagagagaagctgaaggagtttatggattcatctctaggagatgagtatcctttggagctggctttcaccatggcacagcttgctaagagctgtgtggcacctgatattaactcgcgaccgtctattgctcaggttctaaccacgctcttgatgatcgtctcgtcatctattgattgggagccttctcatgaccttcttcatgattcgggatctcttggcaactagttattctattttcttttgttttgtttgtcaataattgagtatttagattttagattttgtgtaatatataagataaggaccatatggctataaaatctactgtaactgagcaaaataagtaccacagtgttcaacaaaagcaatgagaagatttgaatgtttttcacaattcttgtagactaaattttaaactaatctcactcttagattattcttgttagtttgttttacaggtgcttactaattt

SEQ ID NO: 2036 - DNA, 1598 bp, Brassica rapa
aacatgcaaacataatagacaccactgagctccacgcatttcttctataaatgtagactctctcacgactcacaccgcaacgagaaacttgttttagctaaattccaaaaaagaaacagaaaacaaataagatcttaattctccttccgagtttgctttcttcaatatggctcctctacccatttcttcgattagagttgggaaaatagatgatgttcaagaattaataaaatcaaaaccaaacaaagttccagagaggttcataagagaagccaatgagagaggtgtcttagtgtctcataagactcaccttcatcatcatattcctgttgttgatctctctaaactgtcgaaacctcacactgatgatgattttctctttgagattcttaagctctcacaagcttgtgaagactggggatttttccaggttataaatcatgggattgaagtgggtgtggtggaagatatagagaaggtggcgaaggagttcttcgagatgccactggaggagaagaagaagtatccaatggagccagggaccgtacaaggttacggtcaagctttcatcttctctgaagatcagaagcttgattggtgcaacatgtttgctcttggtgttcatcctccttctattcgtaaccccaaactatggccttctaaaccggcccggttcagtgaaaatcttgaaggttactcaaaagagataaggaaattatgcaagaggttgttgaagtacatagcaataagcttggatctaaaggaagagagatttgaagaaatgtttggggaagcagtgcaagcagtaaggatgaactattacccaccatgttcacgtcctgatcttgtcatgggactcagcccacattctgatggaagtgctctcactgttcttcaacagagcaagaacagctgtgttgggcttcagatcctcaaggacaacacttgggtccctgtactacctcttccaaatgcccttgtcattaacattggtgatacagttgaggtgctaactaatgggaagtacaagagtgtagagcatagagcagtgacaaatagagaaagggagaggcttacaatagtgacattctatgcacccaactacgaggttaaaatagaaccaatgggtgaattggttgatgatgaaaccaacccatgcaagtatagaagctacaatcatggtgactatagttatcactatgtctccaacaagctccaaggcaagaagtcacttgattttgccaagattctcaattaactatattactttcacacccctttcaccttccattaactaccacttaatttgttttatttttaagaatttagttgtgggactcttgtgtgtatgatgtacaggaatgtttcccacttaggggttttagtgtcatgattaaattccccagtgtaactacaacttgtaatatattatgtgtgtgtgtgggtggagttgggtgtgtttatgtatccatatgtatgccgagaaggaacataaagaataagaaagaacaatatcagatccatgtttatgtcgatacatgtgtgcatatatataatgtatttcgttagtttgtatcattatgcatatactcctttca

SEQ ID NO: 2037 - DNA, 1153 bp, Brassica rapa
  misc_feature (318)..(318): n is a, c, g, or t
tgaaccaaataagatcttaattctccttccgagtttgctttcttcaatatggctcctctacccatttcttcgattagagttgggaaaatagatgatgttcaagaattaataaaatcaaaaccaaacaaagttccagagaggttcataagagaagccaatgagagaggtgtcttagtgtctcataagactcaccttcatcatcatattcctgttgttgatctctctaactgtcgaaacctcacactgatgatgattttctctttgagattcttaagctctcacaagcttgtgaagactggggatttttccaggttatanatcatgggattgaagtgggtgtggtggaagatatagagaaggtggcgaaggagttcttcgagatgccactggaggagaagaagaagtatccaatggagccagggaccgtacaaggttacggtcaagctttcatcttctctgaagatcagaagcttgattggtgcaacatgtttgctcttggtgttcatcctccttctattcgtaaccccaaactatggccttctaaaccggcccggttcagtgaaaatcttgaaggttactcaaaagagataaggaaattatgcaagaggttgttgaagtacatagcaataagcttggatctaaaggaagagagatttaaagaaatgtttggggaagcagtgcaagcagtaaggatgaactattacccaccatgttcacgtcctgatcttgtcatgggactcagcccacattctgatggaagtgctctcactgttcttcaacagagcaaggacagctgtgttgggcttcagatcctcaaggacaacacttgggtccctgtactacctcttccaaatgcccttgtcattaacattggtgatacagttgaggtgctaactaatgggaagtacaagagtgtagagcatagagcagtgacaaatagagaaagggagaggcttacaatagtgacattctatgcacccaactacgaggttaaaatagaaccaatgggtgaattggttgatgatgaaaccaacccatgcaagtatagaagctacaatcatggtgactatagctatcactatgtctccaacaagctccaaggcaagaagtcacttgattttgccaagattctcaattaactatattactttca

SEQ ID NO: 2038 - DNA, 1467 bp, Raphanus sativus
ggaacgagtccacttgttttagctaaattccaaaaaagtaagagaaaacaaataagatcttaattctccttccgagtttgcttgcttcaatatggctcctctacccatttcttcgattagagttgggaaaatagatgatgtccaagaattaataaaaacaaaaccaaacaaagttccagagaggttcataagagaagccaatgagagaggtgtcttagtgtctcataagactcaccttcatcatcatattcctgttgttgatctctctaaactgtctaaacctcacactcatgatgattttctctttgagattcttaagctgtcacaagcttgtgaagactggggatttttccaggttataaatcatgggattgaagggggtgtggtggaaggtatagagaaggtggccaaggagttcttcgagatgccactggtggagaagaagaagtatccaatggagccagggaccgtacaaggttacggtcaagctttcatcttctctgaagatcagaagcttgattggtgcaacatgtttgctcttggtgttcatcctccttctattcgcaaccccaaactatggccttctaaaccggcccggttcagtgaaaatcttgaaggttactcaaaagagataaggaaattatgcaagaggttgttgaagtacatagcaataagcttggatctaaaggaagagaaatttgaagaaatgtttggggaagcagtgcaagccgtaaggatgaactattacccaccatgttcacgtcctgatcttgtcttgggactcagcccacattctgatggtagtgctctcactgttcttcaacagagtaagaacagctgtgttgggcttcagatcctcaaggacaacacttgggtccctgtactacctcttcccaatgcccttgtcatcaacattggtgatacaattgaggtgttaactaatgggaagtacaagagtgtagagcatagagcagtgacaaacagagaaagggagaggcttaccatagtgacattctatgcaccaaactacgaggttaaaatagagccaatgggtgagttggttgatgatgaaaccaacccatgcaagtatagaagctacaatcatggtgactatagttatcactatgtctccaacaagctccaaggcaagaagtcacttgattttgccaagattctcaattaactatattattttcacacccctttccccttccattaactagttaccacttaatttgttttaattttaagaatttagttgtgggactcttgtgagtataatgtacaggaatgtttcccacttagggggtttagtgtcatgattaaatcccccaatgtaactacaacttgtaatatattatgtgtgtgtgtgtatggtggagttgggtgtgtttatgtgttcatatgtatgccgagaaggaacataaagaataagaaagaacaagatcagatccatgtttatgtcga

SEQ ID NO: 2039 - DNA, 1563 bp, Eutrema parvulum
aacatgcaaacaattataaacatcactgaggtccaagtatttcttctataagtatacactctctcacgacttagaaagcaaagagcccacttgttttagctaagttccaaaacaaaaagcagaaaattaatcaaatctacaatctctttctggttgcttcaatatggctcctctacccatttcttcgattagagttggcaaaatagaggatgttcaagaactaataaaatccaaaccaaacaaagttccagagagattcattagagaagccaatgaaagaggagttcttatgtcacttaagactcatcttcatcatcgtattcctgttattgatctctctaaactctctaaaccacacactcatgatgattttctctttgagattcttaatctctcacaagcttgtgaagattggggattttttcaggttataaatcatgggattgaagtggatgtggtgggagatatagagaaagtggctaaggagttcttcgagatgccattggaagagaagaggaagtatccaatggagccagggaccgtacaaggttacggtcaagctttcatcttctccgaagatcagaagcttgattggtgcaacatgtttgctcttggtgttcatcctccttctattcgtaaccccaaactttggccctctaaaccggcccggttcagtgaaagtcttgaagattactcgaaagagataaggaaactgtgcaagaggttgttgaagtacatagcaataagcttgggactacaagaggagagatttgaggaaatgtttggggaagcagtgcaagcagtgaggatgaactattacccaccatgttcaagtcctgatcttgtcttgggacttagtccacattctgatggaagtgctctcactgttcttcaacagagcaagaacagttgtgttggccttcagatcctcaaggacaacacttgggtccctgttctacctcttcccaatgcccttgtcatcaacattggtgatacagttgaggtgctaactaatgggaagtacaaaagtgtggagcacagggcagtaacaaacagagaaagggagaggcttacaatagtgacattctatgcaccaaactatgaggttaaaatagaaccaatgggtgaattggtggatgatgaaagcaacccatgcaagtatagaagctacaatcatggtgactatagttatcactatgtctccaacaagctccaaggcaaaaagtcccttgattttgccaagattctcaattaactaatattattttcaccaccccatcaccctccattgactagttaccacttaatttgctttttttttagaatttatttgtggaacttttgtgtgtataatgtatatatgaatgttccccacttaggggttttaatgtcatgattaaattccccaatgtaaatacaacttgtaatatattatatgtgtgtgttggtggagttgggtgtgtttaattatgtatttatatgtaatttcgagaaggaacaacaaaaagaacaagaaagaaagaacatctgatccatgtttaggttgaattattaagcacatat

SEQ ID NO: 2040 - DNA, 1386 bp, Brassica rapa
tttgtttgcttcaatatggctcctctacctatttcttcgattagagttggtaaaatagaggatgttcaagaactaataaaatcaaaaccaaacaaagttccagagagattcataagagacgccaatgaaagaggaggcttagtgtcgcttaagactcaccttcaccaacctattcctgttattgatctctctaaactctctaaacctcacactaatgatgattttgtatttgagattcttaagctctcacaagcttgtgaagactggggattttttcaggttataaatcacgggcttgaagtggatgtggtggatgatatagagaaagtggctaaggagttcttcgagatgccattggaggaaaagcagaagtatccaatggagccagggaccgtacaaggatacggtcaagctttcattttctccgaagatcagaagcttgattggtgcaacatgtttgctcttggtgttcatcctccttctattcgtaaccccaaactttggccttctaagccggctcggttcagtgaaagccttaaaggttactcaaaagaaataagcaaattgtgcaagaggttgttgacgtacatagcaataagcttgggtctaaagaaagagacatttgaggaaatgtttggggaagcagtgcaagcagtgaggatgaactattatccaccatgttcaagccctgatcttgtcttgggacttagtccacattctgatggaagtgctctaacagttcttcaacagagcaaggacagttgtgttgggcttcagatcctcaaggacaatacttgggtccctgtcctacctcttcccaatgcacttgtcatcaacattggtgatacagttgaggtgctaactaatgggaagtacaagagtgtggagcatagggcagtgacaaacagggaaagggagaggcttacaatagtgacattctatgcaccaaactatgaggttgaaatagaaccaatgggtgagttggttgatgatgaaaccaacccatgcaagtatagaagttacaatcatggtgactacagttatcactatatctccaacaagctccaaggaaagaagtcccttgattttgccaagattctgaattaactagtattactttcacaaccctttcacgatccattaactagttaccacttatttcttttattcttataaaatttaggtttggaacttttgtgtgtctaataataggaatgttccccacctaagggtgttgatgtcatgattgaactccccaatgtacatacaacatgtattatattatattgtgtgtgggtggagttgggtgagtttatgtgtttatatatgtacgtcgagaaggaacaaaagaataagaaaaataacatccgatccattgttttgttc

SEQ ID NO: 2041 - DNA, 1485 bp, Arabidopsis lyrata
tagactctcactctctcacgactcacagagcaaagagctaaagtccaaaaccaaacacacaaacaaaaatcaaattttatttcttggtctgctttcaagaatatggctcctctacctatttcttcgattagagttgggcaaatagatgatgttcaagaactgataaaatccaaaccaaacaaagttccggagagattcattagagaagagtatgagagaggagtcgttgtgtcgtctcttaagactcatcatcttcatcatcagattcctgttattgatctctctaagctctccaaaccccacaatgatgattttttctttgagattcttaagctctcacaagcttgtgaagactggggatttttccaggttataaatcatgggatagaagtggaggttgtggaagatgtagagaaagtggctaaggagttctttgatatgccgttggaggagaagaagaagtatccaatggagccagggaccgtacaaggttatggtcaagcgtttatcttctctgaagatcagaaacttgattggtgcaacatgtttgcccttggtgttcatcccccacaaattcgcaaccccaaactatggccctctaaaccggcccggttcagtgaaagtcttgaaggttactcaaaagagataagggaactatgcaagaggttgttgaagtacatcgcattaagcttgggtctaaaagaagagaggtttgaagaaatgtttggggaggcagtgcaagcagtgagaatgaattattaccctccatgttcaagtcctgatcttgtcttgggacttagcccacattctgatggaagtgctctcactgttcttcaacagagcaagaacagttgtgttggccttcagatcctcaaagacaacacttgggtccctgttaaacctcttcccaatgcccttgtcatcaacattggtgataccattgaggttctaagtaatgggaagtacaagagtgtagagcatagggcagtaacaaacagggaaaaggagaggcttacaatagtgacattctatgcaccaaactatgaggttaaaatagaaccaatgagtgagttggttaatgatgagaccaacccatgcaagtatagaagctacaatcatggtgactatagttatcactatgtctccaacaagctccaaggcaagaagtcccttgattttgccaagattctcaattaaactaatattagtttcaccccatcaccctccattaactagttaccacttatttgctttcttttttttaagaaaaattatttgttgcaacttttgtgtgtataatgtataggaatgtcccccacttagggtttttagtgtcatgattaaattccccaatgttaatacaacttgtaatatttggtatgtatgtgtgtgggtggaattaggtgtgtgtgtatatgtatatgccgagaaggaacaaaagaaagagaaaaaaaaataacattccatccaatgtatatgttaatt

SEQ ID NO: 2042 - DNA, 1494 bp, Arabidopsis thaliana
atgtagactctcactcttttacgactcaaagagcaaagagctaaagtccaaaaccaaacacaaaaacaaaaatctaaatttctttcttggtctgctttcaatatggctcctctacctatttcttcgattagagttgggaaaatagatgatgttcaagaactcataaaatccaaaccaaacaaagttccagagagattcattagagaagagtatgagagaggagtcgttgtgtcgtctcttaagactcatcatcttcatcatcagattcctgttattgatctctctaagctctctaaacccgacaatgatgattttttctttgagattcttaagctctcacaagcttgtgaagactggggatttttccaggttataaatcatgggatagaagtggaggttgtggaagatatagaggaagtggcttcagagttctttgatatgccattggaggagaagaagaagtatccaatggagccaggtaccgtacaaggttatggtcaagctttcatattctccgaagatcagaaacttgattggtgcaacatgtttgcccttggtgttcatcctccacaaattcgcaaccccaaactatggccctctaaaccggcccggttcagtgaaagtcttgaaggttactcaaaagagataagggaactatgcaaaaggttgttgaagtatatagcaataagcttgggtctaaaagaagagagatttgaggaaatgtttggggaggcagtgcaagcagtgaggatgaattattaccctccatgttcaagtcctgatcttgtcttaggacttagtccacattctgatggaagtgctctcactgttcttcaacagagcaagaacagttgtgttggccttcagatcctcaaagacaacacttgggtccctgttaaacctcttcccaatgcccttgtcatcaacattggtgataccattgaggtgctaagtaatgggaaatacaagagtgtagagcatagggcagtaacaaacagggaaaaggagaggcttacaatagtgacattctatgcaccaaactatgaggttgaaatagaaccaatgagtgagttggttgatgatgagaccaacccatgcaagtatagaagctacaatcatggtgactatagttatcactatgtctccaacaagctccaaggcaagaagtcccttgattttgccaagattctcaattaaactattattaatttcaccccatcaaatctccattaactagttaccacttaatttgctttctttaataagaaaaattatttgttgaacttttgtgtgtataatgtataggaatgttccccacctagggtttttaatgtcatgattaaattccccaatgtgaatacaacttgtaatattttatatgtatgtgtgtgtgtgggtggaattaggtgtgtgttttatgtatataccgaaaaggaacaacaacaaaaaaaaagatgaaaaaactaacatttcatccaattttttatgttgatt

SEQ ID NO: 2043 - DNA, 1669 bp, Gossypium raimondii
ttttcactaatccaaacccttttctttctccagtttcctcattcatttccatttctcaacacaaattttcatcacccatcaagcttttcatcaatggcttcccttcaacaagcttcaatctctcttcaacccaagcttctttcatcttctcaacaccccagatcccttccctctctcaacctctctttttcagccactttcccttccctcaaactctccaccactcgccctcttcatggcggtgccaaaatgtcagcctccgccgcttccagctacgccaccgctttagccgatgtagccaagtccaacaacacccttgatgccaccagctccgacgttgaaaaggtcgagaaaatcttctccgacccacaagtcctccagttcttcaccaaccccaccattgatgtcctcaaaaaacgtcaggttttggatgagattgttagctcctccgagcttcagccgcacacggcgaattttttgaacatcctggttgatgccaagaggattgatcttatcaaagaaatcgtgaaagagttcgagttggtttacaatgagctgacggacacagagctggcggtggtgagttcagtggtgaaattggagtctcaacatttggcacagattgctaaacaggtacagaagctgactggtgctaagaatgttaggattaaaactatgattgacccaagtttggtagctgggtttactatcaggtatgggagttcagggtctaaattgattgatatgagtgttaagaagcaattggaagagattgctgctcagcttgatttgggtgatattcaacttgctgtatgagttttgaattcattttttcccttttgagaattgggtttgtaaacttttttggttattattgtaattgaaataagtacttttaatgttaattgtatgaaatttgtgtatgatgagattgtttgatatgggagaaagtgatagtggttgggatatttcattaggaagggctaggtggaaagttgatattttgggctaaattcttgcatcagattcaaggattctaagcctaaatcccatgaatttaaagcattcaagaagtatgaagcattcatgaatgagtcctgaaacatgggtatcaattcatttagtagagtgtgatggaactttgagatatcagtgaatttgatttatatatttagaaacattcagtagtcagattgttcgcatagcattttcttggtgggatttagggttgctagacaagagttatagaaaccattttgttttgagttctgcatctcagtaatttttgggacatggagtctacagattgaaatatggaaagatgagtaatgttgaagaacaagatctcaatcagtataggaaaccaatccatgtatgcttcagcctttgaaagtcttgttggaatctgtcaataccatcagtcacaactcactttgtaactggacgatcctgtaacttgacatatatcttaacgcaggcaaaagctgacattcacagtacttgaatggaaaccaaattaaccatggagaacaaggaaatgggaaattttagcttgtaaaacctaactctatttctaaggcaaacaacagcattttttggagtgtaactgaatcgagccgagtttgaatattgataaaatagagttcgagtttgatacaaaaaagaaaaa

SEQ ID NO: 2044 - DNA, 1270 bp, Theobroma cacao
ataatcaattaagtacacataattaattaataccaaacattcattaaaaattagaaaaatagcacaaatatagtccctcttgaaattaaacccagtctattctgccccttttatcaattgataggctgctaaaattttgtggagtcccttttatctcccacaatccaataagtggccctccttctccaacccaagataaccccattattcccacaatctgctttccttctctaattttgctcttgaccacaacaattctcacccacccaaaattcctgcgggggaccaaggcgaagcaaacccaaacttcctgactaccaatggcttctttccagcaaacttcaatctctcttcaatccaagctcctcccttcttcccaacttcccagagccctcccttctctcaacctctccttctcagccaccttcccttccctcaaactctcgaccacccgccctctccagggtggcgccaaaatgtcagccacagccgcttccagctacgctttagctttagccgatgtggctaagtccaacaacaccctggactccaccagctccgacattgaacaagtcgagaaaatcttctctgaccctcaagtcatcgacttcttcgccaaccccaccatcgacgctatcaaaaaacgtcaggttttggatgatatagtcaagtcttccgggcttcagcctcacactgcaaactttttaaacatcctggtggatgccaagaggattgacattattaaggaaattgtgaaagagttcgagtcggttttcaataagctgacggatacggaattggccgtggtgagttcagtggtgcccttggagtctcagcatttggcacagattgctaaacaggtgcagaagctgactggtgctaagaatgttaggattaaaaccgcgattgacccaagtttggtagctgggtttactatcaggtatggcaattcagggtcaaaattgattgatatgagtgttaagaagcagttggaggagattgctgctcagcttgatttgggtgatattcaacttgctgtataagtttaaattttcatttttttttatgagaatttgatttggaacctttttgttttggttattatgtaatgtcaattgtatgaaatttgtcctaatattaaactgtttcttttgggagaaactgagggtgcttttgggttctgggaaatggagttattttaatattatgaagagttaatctgtacaaacttacttgaaagaaggatgcttaatgaactatatattttttt

SEQ ID NO: 2045 - DNA, 817 bp, Pteridium aquilinum
accacaaccaattcctcaacccaccccaaaaattccgtgcggggggacccaaggcgaagcaaacccaaacttcctgactaccaatggctcttccagcaaacttcaatctctcttcaatccaagctcctccccttcttccccaacttccccagagccctcccttctctcaacctctccttctcagccaccttcccttccctcaaactctcgaccacccgccctctccagggtggcgccaaaatgtcagccacagccgcttccagctacgctttagctttagccgatgtggctaagtccaacaacaccctggactccaccagctccgacattgaacaagtcgagaaaatcttctctgaccctcaagtcatcgacttcttcgccaaccccaccatcgacgctatcaaaaaacgtcaggttttggatgatatagtcaagtcttccgggcttcagcctcacactgcaaactttttaaacatcctggtggatgccaagaggattgacattattaaggaaattgtgaaagagttcgagtcggttttcaataagctgacggatacggaattggccgtggtgagttcagtggtgcccttggagtctcagcatttggcacagattgctaaacaggtgcagaagctgactggtgctaagaatgttaggattaaaaccgcgattgacccaagtttggtagctgggtttactatcaggtatggcaattcagggtcaaaattgattgatatgagtgttaagaagcagttggaggagattgctgctcagcttgatttgggtgatattcaacttgctgtataagtttaaattt

SEQ ID NO: 2046 - DNA, 1484 bp, Trigonella foenum-graecum
ctaactaaactctcacacttcattgtagtaacttcacaacacatcaaaaatggcttctgcttccaccaccattacctcctctttcctctcaaccccttcttctctcacagagaaaccctcctcattcaaccaaaccttcagcctcggtttcaaaccaaaacactctttctcagtttccgcatcagcatcaccttcaccaccaccctcctatgatctcaattccttcaaattcgctccgatcaaggagtcgattgttgctcgtgagatgactcgtaggtacatgacggacatggtgactcatgccgataccgacgtcgtcatcgttggtgctggctccgctggtttgtcatgtgcttacgagctcagtaagaatcctaacgtcaagatcgctatcattgaacaatctgttagtcctggtggcggtgcttggctcggtggccaactcttctctgcaatggttgtgcgtaagccggcacatcatttcttggatgagcttgaaattgagtatgacgagcaggacgactatgtagtgatcaagcacgctgctctcttcacttccacaatcatgagcaagctactagcaaggccaaacgtgaagcttttcaatgctgtagctgctgaggatttaattgtgaagaatggaagagttggcggtgttgtcactaactgggctttggtttcaatgaaccatgatactcaatcttgcatggaccctaatgttatggagtctaaggtggttgtgagctcttgtggccatgatggtccttttggagccactggtgtcaagaggctcaagagtattggattgatcgataccgtgccaggaatgaaggctctcgacatgaacacggctgaggatgctattgttaggctcactagggaggttgtgcctggaatgattgttactgggatggaggttgctgagattgatggtgctccaagaatgggtccaacatttggagcaatgatgatatcagggcagaaggcagctcatttggccttaagagcactgggacttcctaatgctgtggatcaagcaggaaacattcaccctgagcttgtcctagctgctgctgaatctgctgaagttgcagaagcttaatcattgttacctttaactatttagttaatagtttgaagtgctagtagccagaaataatgtcttttagtttgttgtttgttagtagtgatggttggctggttgatgcgactgtatgaggttttttgtcaatcatatgaatgaatgcgtttgccttttctttcttctctaatatttattattattgtttaatgaaaagggaatacaattaactactattaagggatcagcgtatggtgtttagcaattgtgcctttagctaaggttcccatgatatggtagaagggatctggattttctgctgttacagcttgatgctgtaacaaatcaggattgtccgatctaaatgtgtggtcaagattattaagagtaattttatattgtg

SEQ ID NO: 2047 - DNA, 1426 bp, Cicer arietinum
ccccaataaatatcgcattcccatctctcaaaattacaaaagtcgaacagtgttagttgcttcacagaataaaccaacataacatggcttcagtttccaccatcacctcctctttcctctacaccaatgcctcaaccccttcttccaaatccctctctttcaacacaacccttaacctcggtgttcaaagaaaattctctgtttccgcatcagtagcagcagctaattcaccaccaccctatgaccttaattctttcaaattcgatccaattaaggagtcgattgtgtcacgcgagatgacacgcaggtacatgacagacatggtgacacacgctgacaccgatgttgtcatcgtaggtgctggttctgctggtcttacatgtgcttatgaacttagcaagaatccaaatgttaatattgcaatcattgaacaatctgttagccccggtggtggtgcttggctcggtggccaactcttctctgcaatggttgtgcggaagccagcacatctattcttgaacgaacttggaattgattatgatgaaaaggacaactatgttgtgatcaagcatgcagctctcttcacttccaccatcatgagcaagcttctagcaaggccaaatgtgaagcttttcaatgctgttgctgctgaagatttgattgtgaagaatggaagagttggtggtgttgtcactaattgggctttggtttctatgaaccatgacactcaatcttgcatggacccaaatgttatggaggctaaagttgttgttagttcttgtggccatgatggtccttttggagccaccggagttaagaggctcaagagtatcggcttgatcgataccgtccctggaatgaaggctctcgacatgaacaccgctgaggatgctattgttaggcttactagggaggttgtccctggaatgattgttactggtatggaggttgctgagattgatggtgctccaagaatgggtccaacatttggagcaatgatgatatcagggcagaaagcagcccatctggccttgaaatcactaggacttcctaatgctgtggattatgcaacaaacatccaccctgagcttgtcctagctgctgctgattctgatgaaactgcagatgcttaattgatcaatgttaccattaactatgttgttgtagttaatagtatcaaaaatttgttgttggtagtttagttatgtccggctggttgatggactctagatgaggttttgataataacatgacatgaataaatggttgcaagcacttagaagtgtctatgtttgataataacatcccaacaaatttttcactcttgatgaattagagagaggaaagttgtctcctgaatagatcttatctatttcaatgcgatcttacaatttttaggatttggatctggaaaatagaatttgtg

SEQ ID NO: 2048 - DNA, 1367 bp, Glycine max
actccactcacaactgaaaccaaaactgaaaaaaaaaacaaacaataccataacatggcttcttccaccatcacctcctccttcctaacatcacccccttcatctctcttcaacaaatcatcatccccttccttccatgccacccctactctccgccccctcgcgccacgcgcctccatgtccgcctcagcgccgccctacgacttcggatcgttccggttcgatccgattagagagtcgattgtgtcgcgcgagatgacccgcaggtacatgatcgacatggtcacccacgccgacaccgacgtcgtcatcgttggcgcgggctccgcgggtctctcgtgcgcctacgagctctccaaaaacccctccatcaacatcgccattgttgagcagtccgtcagccccggcggcggcgcctggctcggcggccaactcttctccgccatggtagtgcgtaagcccgcacacctcttcctagacgagctcaatgtggagtatgacgaacaagacaactatgtggtgatcaagcacgcagcattgttcacatccaccatcatgagcaagctcttggccaggccaaacgtgaagctcttcaatgccgtggcggcggaggacttgattgtgaagaacgggagagttggtggggtggtgaccaactgggccttggtttcattgaaccatgacactcaatcctgcatggaccccaatgtgatggaggctaaggtggtggtgagttcttgtggccatgatggaccctttggagccactggggtgaagaggctcaagagcattgggttaattgatagtgtgcctgggatgaaggcacttgacatgaacaaggctgaggatgccattgtgaggctcactagggaggttgtgcctggcatgattgttactgggatggaagttgctgagattgatggtgctccaaggatgggtccaacatttggagcaatgatgatttcagggcaaaaagcagcccatctggctttgagatcattgggacttcccaatgctttggattcagtgggaaacgttcatcctgagcttgtcctagctgctgctgaatccgctgaaattgctgaggcttaattaatgttgcaacaaattaggttaaaatagtatcaatgcttgcaactagaaataataattgtagacttgtacttagggaattaagctttgaaggtgttagtagtgatctattggggtggttgatgcgactctatgaagtttgttaatactatatgaagctttgagggtgttgctagtgatctattgtgtcttactttcctcgaagcctaatttaattgggtcttttttctattataaatggagagggtggtgtaccatccataccttcgtctcaa

SEQ ID NO: 2049 - DNA, 1322 bp, Phaseolus coccineus
taacccatctcactcatttcactctttctcatggcttctacaaccacctcctccttattgtctctcaccactctctccccaccctcttcgtccctgttttccaccaaacccacacatgcaacccctattccccgcttccacgcgcctcgcgcgtctatgtccgccgctccctcacccgcttacgacttatcctccttcaggttccaacccatcaaggagtcgattgtgtcgcgtgagatgacgcgccgctacatgaccgatatggtcacgcatgcagacaccgatgttgtcatcgttggtgctggatctgctggactttcctgtgcctacgagctcagcaagaacccggccatcaatattgccatcatcgaacagtccgtcagccccggcggtggggcgtggcttggtggccagctcttctccgccatgatagtgcgtaagccagctcatatgttccttgacgagcttggtcttgagtatgatgagcaagacaactacgtggtgatcaagcacgctgcattgttcacttctaccatcatgagcaagctcttggctaggccaaacgtgaagctcttcaatgccgtggcagctgaagatttgatcgtgaaggatgggaaagttggtggggttgtcactaactgggccttggtttcgatgaaccatgacactcaatcctgcatggaccccaatgtgatggaggctaaagtggtggtgagttcttgtggccatgatggaccctttggagccactggggtgaagaggctcaagagcattggcttgattgataacgtcccaggaatgaaggcccttgacatgaacaaggcagaggatgccattgtgagactcactagggagattgtgcctggtatgattgttactgggatggaagttgctgagattgatggtgctccaagaatgggtccaacatttggagcaatgatgatatcagggcagaaagcagcccatctggctttgagatctttgggacttcccaatgctttggaatctgtaggaaatgttcatcctgagcttgtcctagctgctgctgctgaatctgctgaaactgcagatgcttaatcaatgttgcatcaaattttacttgatagtagtttcaatgcttgcaactagaaataatacatgtagttcagagattaagcttttaagatcttggttggtagtatgtgactctctatgaggttttgaatgaatgtttatcattatcaactcctttatttctcacctcaaatcccagtttaaaagaccaccacacttttgttctattttgtttgaaatcgaagtaattgaaatagtattttagatga

SEQ ID NO: 2050 - DNA, 1916 bp, Theobroma cacao
aaacataggggagctggccaagtttttgtgttacgaaaaattagagcaaaattggtcatggttatgcgagttgtggagttttatgcccttagccgctaagatggaagtatccacttgccaaatcatttcaagcttgaaactacatatatatgaacaaataatatgcctttcccatgaagaatccaagatactattgtcaaatagataccttcctagggtaacaaattaagtgacaaaaagatgaccaaaagttgagcacttggtgacaaagatcaccgaaagggtctgcaagataatcccacgtgacaaagaaaggacaaagtggggatcagatacagtggtgcctgcaaattggttgaagccaaaatacaccaaaaggacaaagtattttcttgaatgacgtaactcaccctgcaacaagggtaatcagatctttcaacaagaagatcctaacgattctaaacccttcaaatcctatcctttccccaggtgtcctctcagatattttgttcactttccactcttttccaccctcttcacctcttttctgcaatcttctcagctctaagctgcaaaggaaccccaaaaagatcaccctttcttgatttttctcaggcagtaatggcatcatccgtagctactactctcacttcctctaccaaactttacagaaacacttccctctttgagtcttccttccatggggttcccataacgccactttctttccatctcaaggcaaagtcctctccacgcaatgcatcagtttccatgtctgcagcctcatcacctccaccgtatgacctgaacaatttcaggtttgaccccatcaaggaatccatcgtgtcacgtgagatgacacgtaggtacatgatggacatgatcacccacgctgacactgatgtggtggtggttggtgcgggctccgcagggctgtcttgtgcctatgagcttagcaagaacccgtccgtacaggttgctattgttgagcaatctgttagccctggaggtggtgcctggctaggaggacagcttttctctgccatggtagtacgcaaaccagctcatcgcttccttgatgaacttgggattgagtatgatgagcaagacgactatgtggtgatcaagcatgcagccctgttcacatccaccatcatgagcaagcttctagctcgccccaatgtgaagctgttcaatgctgtggcggcagaggacttgatagtgaagggaggaagagttggtggtgttgtgacaaattgggccttggtttcaatgaaccatgacacacagtcctgcatggaccctaacgtcatggaggccaaggtggtggtgagctcttgtggtcatgatgggccatttggagccactggggtcaagaggttgaagagcattgggatgattgatagcgtgccggggatgaaggcactggatatgaatacagctgaggatgctattgtgaggctaactagggaaattgtgcctgggatgattgttactggaatggaagttgccgagattgatggatcaccaagaatgggaccaacatttggagccatgatgatatcagggcaaaaggcagcccatcttgctctgcaatcattgggattgcctaatgcacttgatggaacatatgtgggaaacattcacccagagctgatcttggctgctgcagattctgctgagactgctgatgcttagttgcatagcaattagtcgcgatgatggagattaggggtcggttttatagtcatcggtaggaacgagtggtttggttttagatggttgatgtgattatgtggtgaggtttgttaataaagagggtgtgctgtttagaccctgttggaacttaatggcacgtagcagttagttcttgctgttcttgttgccatcaataagtattgctttttcttcctctt

SEQ ID NO: 2051 - DNA, 1483 bp, Actinidia deliciosa
ttctattctcgacctttggaatcctatcccctccactagtgtcgtctccaaagctcccaatatattctctctcctcaacaaaaaaaacagtttccaaaaacctttcaaatctcatccatggccaccatgacctcaaccctcactctctctctctcctccaagtccaagccggctttcctggattcctcctcccatggcgcggcccttccgtcccgtagcctcctccggccagccaaggcaggtccacagaacttctctgtctcgatgtcggcttcgtctcctccgccgtacgatctccgatcgttcaagttccaaccgatcaaggagtcgatcgtgtcgcgcgagatgacgcggcggtatatgacggacatgatcacgtacgccgacaccgacgtcgtcgtcgtcggagccggatccgccggcctcacctgcgcgtacgagctcagcaagaatccatccgtacaggtggccatcattgagcaatctgtgagcccggggggtggtgcgtggctgggcggccaactcttctcggccatggttgtccgcaagccagcacatctcttccttgatgagctcgacattgagtacgatgagcaggataactatgtggtgatcaaacatgcagctctgttcacatcgaccatcatgagcaagttgttggctcggccaaatgtgaaactcttcaatgccgtggcagctgaggacttgattgtgaaggaggggagagtgggcggtgttgtgaccaactgggccttggtgtccatgaaccatgacacacagtcttgcatggatcccaatgtaatggaggccaaggtggttgtgagttcatgtgggcatgatgggccgtttggggccactggagtcaagaggctgaagagtattggaatgattgacagcgttccggggatgaaggcccttgatatgaatacagctgaggatgcgattgtgaggcttacgagggaggttgtgccgggaatgattgttactggcatggaagttgcccgaaattgatggagccccaagaatgggaccgacatttggagcgatgatgatatcagggcagaaggcagcacatcttgcactgcagtcacttggactgccaaatgcattggacggaacagctgtcggaagcattcaaccagagttgatcctagcctcggcggatggtgctgaaacagttgatgcttaagcttaggaaatttgtcttgtcgttgtgatgggatgctgtcggtaatggaagattcacaagtagaagcctaaacccaatggttagatacaagtatctcaagttttggttaatgtgtctgtcatcttccctttcgtttttctgaaacttgcatagagattgaacttggataagagaattgtatcgggtccttcccaactgttttctctctcaaatctctctccctctcactctcatttggcaactctatcaggctttatttggatatttgaattttaaatttctataaaaaaaaaa

SEQ ID NO: 2052 - DNA, 1219 bp, Actinidia deliciosa
ccacaaccccctcaaatctcatcaatggccaccatgacctcaaccctcacatcctctctctcctccaagcccaaggcgtctttcctggattcatcagcccatggcacggcccttccggcacgtagcgtcctccggcccgccaaggccggccatcaaaacttctccgtctccatgtcggcttcgtctccgccgccgtacgatctccgatcgttcaagttcgagccgatcaaggagtcgatcgtgtcgcgcgagatgacgcggcggtacatgacggacatgatcacgtacgccgacaccgacgtcgtcgtcgtaggcgccggatccgccggcctcacctgcgcctacgagctcagcaaaaatccatcagttcaggtggccatcattgagcaatctgtgagccctgggggtggtgcatggcttggaggacaactcttctctgccatggttgtccgcaagccggcacatctcttccttgatgagctggacattgagtacgatgagcaggacaactacgtggtgatcaaacacgcagctctgttcacatcgaccatcatgagcaagttgttagctcggccaaatgtgaaactcttcaatgccgtggcagctgaggacttgattgtgaaggaaggtcgagtgggtggtgttgtgaccaactgggccttggtgtccatgaaccatgacacacagtcctgcatggaccccaatgtgatggaggcaaaggtggttgtgagctcttgtgggcatgacgggccgtttggggccactggagtcaagaggttgaagagtattgggatgattgatagcgtcccagggatgaaggccctcgatatgaatacagctgaggatgcgattgtgaggcttacaagggagatcgtcccggggatgattgttactggcatggaagttgccgaaattgatggggccccaagaatgggaccaacatttggagcaatgatgatatcagggcagaaggcagcacacctggcgttgcagtcactgggactgccaaacgcgttggacggaacatatgtcggaagcattcacccggagttgatcctagcctcggcagatggggctgaaacagtcgatgcttaagcgtagaaaatttgtcgtctaataaagagaagaggtaacgagaaagttgttagttttgatgggatgctgtgggtaatggaagattcacaagtagaagcctaaacccaatggttagatgcaagta

SEQ ID NO: 2053 - DNA, 1938 bp, Citrus sinensis
gtgactcaccagtcatcatcactgctgcaaatcaaattacttctcattatcaaacttctaagcagcaggggaaggaggggtaaaaaaaaaaaaccatggcagccatggcttctacagctttcgctccttcagtttcgtccaccaccaataagctctttgactcatcctttcatggggctcccatgtcaccttctcttctacgtcttcaacccatcaaatcttctcgtcccaacaacttgtccatttctgcttctgcttctcctccttatgacttgaacactttcaagtttgaccccatcaaagaatccattgtttctcgtgaaatgacacgcaggtacatgacggacatgatcacttatgctgacactgatgtggtagtggttggtgctggctctgctggcctctcttgtgcttatgagctcagcaaaaaccccaacattcagattgctattatcgaacagtctgttagccccggcggtggcgcgtggctcggtggacagctcttctctgccatggttgtgcgcaaaccagcccacatcttccttgacgagcttggcatcgactacgatgagcaagacaactatgttgtgatcaagcatgcagcgctgttcacctccactataatgagcaagctcctggcccgccccaacgtcaagctctttaatgcagtggcagccgaggacttgatagtcaaaggcggcagagttggtggtgtggtgaccaactgggcgttggtgtcaatgaatcacgatacacagtcttgcatggatcccaatgtaatggaagcgaaggtggttgtgagctcttgtggccatgatgggccttttggggccactggagtaaagaggttgaagagtatcggaatgattgaggaagtgcctggaatgaaggcactggacatgaactctgcagaagatgctattgtgaggctgaccagggaggttgtgcctggtatgatagttaccggcatggaagttgccgagattgatggtgctcctcgaatggggccaacatttggagcaatgatgatatcggggcagaaggctgcgcatttggcgttgaagtcactgggccagccgaatgcattagacggtacatatgtgggaggcgttcaccctgagctgatcttagctgcagctgattctgctgagactgctgatgcttaatttggtaataacaggcatcatcactcatcagctgtgtgcatgcaaataaactctggcaaaaaagtagttgtatttaggtggttgtgatggatggttgatgcgaataatgagataatgttgtgaggttttgtgaataaagtgtttgtttccggtccatcatggaacctttaattttaatttctttctcctcttgtaagaaaccgttgtgagtttttcggaggtgaatttgcagttgcgtatctagtccttgttatctgtgttatgtgtaagactgcccttgggctgttcccttttctttgctttgtatgtttataacttgaggcatcagccaatgggaaagtgctgatgtgattaagatcaatgatgaagatctgagcttactctgtttttgttgctagggcaagtgttaactttgatatgatcttgtgatgatcggagtaataagctgtaattgagaaattacgaaaggaccttttatggtgaaaattaagtgattgaatggtgtacatataagaaccccagtttcagtccatgtcaggctgttgagaagccgagatcgatagctcgttcaatttcccagcataatgcctgagataccgagtcaggctcctaaaactgggtagaatttcttgtcccaagggaaataaatgtggattactgaaatcccgtaatgttttgaaaactgttttgtcgtgttaaactctaatttgagagttggaatatgcaacgttgcaacattatcaataagaggatgtgggctctattgctgtga

SEQ ID NO: 2054 - DNA, 2051 bp, Cicer arietinum
gagatagaaaacagacgaggtgcagtgctaatgtggcgcatgttagcgttagtcaaaacctacctatactataaaaatcgcattttcgtaaatttcactttctcaactcttcactcacaaaaaatggcggccgctacttcctcatgttcaactgcgatctcctcctcttccaaaacccttacgaagacaacttccacaactttccctcccaccaatctctcattttcaaagttacatcctcagccagttagggctcgccgatgcatcgccgtcggtagcgcactcggcgcccgcatggtgtcggctcctcccgctgcgcgtccggctttgcttgatttcgacacttctatcttcaagaaggagagggttaacctcgccggacaagatgagtacatcgtgaaaggaggaagggatttgtttcatttgttgcctgatgctttcaaagggattaagcagattggtgtcattggatggggttcacagggacctgctcaggcccagaatctacgggactcacttgctgaagcaaagtctgatattgtggttaaggttggactcaggaaaggttctcattcctttaacgaggctcgggaagctggatttagcgaggataatggaactctaggtgacatatgggaaactatatctggcagtgatcttgtgttgctgctaatttctgattctgcacaggcagataattatgaaaaaatattttctcacatgaagccaaacagcatacttgggttgtcccatggttttcttcttgggcatttacagtcaattggacttgattttcctaaacacttcagtgtaattgctgtgtgccccaaggggatgggtccatctgtcaggaggctgtatgtacaaggcaaagcaataaatggtgctggaatcaattcaagttttggagtccaccaggatgtggatggcagggctactgatgttgctttgggatggtccattgcccttggttctcctttcacatttgccactacattagagcaagaatacaagagtgacatatttggggagagaggaattttacttggcgcggttcatggaattgttgaatccttgtttaggaggtacactgaaaatgggatgagtgaagatctggcttataagaacactgttgagtccataacaggaattatatctaaaactatctcaactaagggtatgttggctgtatacaatgctttatctgaagatggaaaaagagattttgagaaagcatacagtgcttcctattatccctgcatggacattttgtatgaatgctatgaggatgtagccagtggcagtgagattcgcagtgttgttttggctggccgtcgcttttacgagaaggagggtctggctgcatttcccatgggtaaaattgatcagacccggatgtggaaggttggtgaacgtgttcgctctacaagaccagctggtgatctaggccctttatatccatttactgctggtgtcttcgtggcattgatgatggcccagattgagatcttgaggaagaaaggccactcttactccgaaatcattaatgagagtgtgattgagtcagttgattctttgaatccattcatgcatgctcgtggtgtttccttcatggttgacaactgctcaaccaccgcaaggttgggttcaaggaaatgggctccccgatttgattacattctaactcagcaggccttggtggcagtcgacaatggagctcctatcaaccgtgacctcatcagcaacttcatgtctgacccagtgcacggagccattgaagtttgtgctgaactgagacccacagtagacatttcagtgccagcagatgcagactttgtccgccccgagttgcgccagtctagtaactagaacttgaaccaattgttgcgtttcctgagctgattgattccccttaagaatatcctcagaatagcagctatcctgttagtgagtttttaaatggttgagtgttggtatgcaagttttgtatgactactaccaagattttacgtatgacattggtaataattagttaataaattatgtttcac

SEQ ID NO: 2055 - DNA, 1983 bp, Glycyrrhiza uralensis
ggtcttcactgtcactcagaaataatggcggctgctgcttcttcttcttgctacaccgcagtctctgcctcttccaaaaccctagcgaagcccgtcgccaaaagcttttcccccaccaatctctcattttccaagctcagcttccagcccgccagggctcgcagatgcatcgccgtcggcggcgcactcggcgcccgtatggtgtcggcgccgcctgttacgcttccggcgtcgctcgatttcgagacttccatcttcaagaaggagaggattaacctagcaggacacgacgagtacatcgtgaaaggagggagggatttgtttcatttgctgccagatgctttcaagggaattaagcagattggtgtcattggatggggttcacagggacctgctcaggctcagaatctacgggactcacttgctgaagcaaagtctgatattgtggtcaagattggactcaggaaaggttctcgatcctttaatgaggctcgggcagctggatttagtgaggagaatggaactctaggtgacatatgggaaactatacaaggcagtgatcttgtgttgttgttaatttctgattctgcacaggcagataattatgaaaaaatattttcccacatgaagccaaacagcatacttgggctgtcccatggtttccttcttgggcatttacagtcaatgggacttgattttccaaaacacttcagtgtgattgctgtatgcccaaaggggatgggtccatccgtaaggaggctgtacgtccaaggcaaagagataaatggtgctggaattaattcaagctttgcagtccaccaggacgtggatggcagggctactgatgttgctttgggatggtctgttgcccttggttctccttttacatttgccactacattagagcaggaatacaagagtgacatctttggggagagaggaattttacttggtgctgttcatggagttgttgaatccttgtttaggaggtacactgaaaacggaatgagtgaagatctggcttataagaacactgttgagtccataacaggaattatatctaaaaccatctcaactaagggcatgttggctgtatataatgctttatctgaagatggaaaaagggaatttgagaaagcatacagtgcttcatattatccctgcatggacattttgtatgagtgctatgaggatgtagctagtggtagcgagattcgcagtgttgttttggctgggcgtcgcttttatgagaaagagggtctgcctgcatttcccatgggtaaaattgatcagacccggatgtggaaagttggcgaacgtgttcgctctacaaggccagcaggtgatctaggccctttatatccatttactgctggtgtctttgtggcattgatgatggcccagattgagatcctgaggaagaaagggcattcttactccgaaatcattaacgagagtgtcattgagtctgtcgattctctgaatccattcatgcatgctcgtggtgtttctttcatggttgataactgctcaaccacagcaaggttgggttcaaggaaatgggctccccggtttgattacatcctaacacagcaggccttggtggcagtggacaatggagcacctatcaaccaggacctactcagcaacttcctgtcagacccagtgcacggggccattgaagtttgtgctgaactgagacctacagtggacatttcagtgccgccagatgcagactttgtccgtcctgagttgcgccagtctagttaattacaacttgaaaccaatgattgcttttcttgagctgatttctttccagaaagctcagaacagcatctgtcctgttagtgagtttttatttacatggttgagtgctggtatggaagttttgtatcacccctttgtagtactaagattttacgaatgaggaatgttgcatactgtggtattagaaatgagttaataaactacgttttacaaata

SEQ ID NO: 2056 - DNA, 2027 bp, Glycine max
gaatccactgaaccctctttttgcactccaagcagctacactttacactcccataatggcggctgctatgacgtcgtgttcttccgcaatcgccgccgcgtccgaaaccctagccaaacctgcttccaccagaaccttctccgccaccaacctcgctcttcaatcgtcgtcttccaagctcggtttcaaatccctaagacttcgccgatgcgccgccgcctccggctccgccctcggcgcgcgcatggtgtcggtgccggcggtcaaggcccccgcgctactcgatttcgacacgaaggttttcaagaaggagaagattaacctcgccggacacgacgagtacatcgtaaaaggaggcagggatttgtttcacttgttgcccgatgctttcaaggggatcaagcagattggtgttatcggttggggatctcagggacctgcgcaggctcagaatctacgggactcacttgctgaagcaaagtctgatattgtggtcaagattggactcaggaagggttctcgttcctttgctgaagctcgtgcagctgggttttctgaggagaatgggactctaggtgatatatgggaaactgtctctggaagtgatcttgtgatgctgttaatttctgattctgcacaggctgataactatgagaagatattgtctcacatgaagccaaacagtatacttgggctttcccatggttttcttcttgggcatttacaatcattgggacttgactttccaaagaacattagtgtaattgctgtgtgcccaaagggaatgggtccatctgtaaggaggctctatgtccaaggcaaagagataaatggtgctggaattaatgcaagttttgcagtccaccaggatgtggatggcagggctactgatgttgctttgggatggtctgttgcccttggttctccattcacttttgccactacattagagcaggaatacaggagtgatatctttggggagagaggcattttacttggtgctgttcatggggttgtggagtccctgtttaggagatacactgaaaatggaatgaacgaagatctggcctataagaatactgttgagtctataacaggaattatatctaaaaccatctcaactaagggcatgctagctgtatacaatgctttatctgaagatgagaaaagggaatttgagaaggcttatagtgcttctttttatccttgcatggaaattctgtatgagtgctacgaggatgtagccagtggtagtgagattcgcagtgttgttttggctgggcgtcgcttttatgagaaagagggtctacctgcttttcccatgggtaacattgatcaaacccgcatgtggaaggttggggagcgtgtccgatctacaaggccagcaggtgatcaaggcccattatatcctttcactgctggtgtctttgtggcattgatgatggcccagattgaaatcctgaggaagaaagggcattcctactctgaaatcattaatgagagtgtcattgaggctgttgactctttgaatcctttcatgcatgctcgtggtgtttctttcatggttgataactgttcaaccacggctaggttgggttcaaggaaatgggctcctcgatttgactacatcctaacccagcaggccatggtggcggtggacaatggaacacctattaaccgggacttaatcagcaacttcctgtcagacccagtgcatggagccattaaagtttgcgctgaactgagacccacagtagacatttctgtgccaccagatgcagactttgttcgtccagagttgcgttccagcaattagaacttaaaatcaattatggctttcacttcgaatcattttcagatttctcagaactgcagttttgttgttagtttgggttttttagttttgttttcttggttgaatgctagtatgtaagttgtattatcattttgtagtttgtactcgtctgtgttctgccactgaggaacgttacttaatgtcctatttaaatataataagtctgtaaact

SEQ ID NO: 2057 - DNA, 2073 bp, Trigonella foenum-graecum
gacggttacagtgtctaaaaaccagagaagctcactcataaaacacttcaccaaatttcacatttaccaacagttacttccttcttcctccaacaatggcagctacgacgtcgttttctccggctatctccgcctcctccgaaatccaacccaaaccaatcactaccagaaccttcaccacctctaacctcgcactccaatcttcttcttccaagcttcctttcaaacccctatctcttcaccgtcacaccagcatcgtcgcctcatccctcgccgcgcaaatggtctctgcaccgccggcgactaagctccccgcctcactcgatttcgacacgtcgctttttaaaaaggaaaaagtcaacctcgccggacacgaagagtttatagtgagaggtggcagagatttgtttcatttgttgccagatgctttcaaagggattaagcagattggtgttatcggttggggatcacagggacctgctcaagctcaaaatctaagggactcacttactgaagcaaagtctgatattgtggttaaggttggattgaggaaaggttctagttcctttgctgaagctcgagatgctgggttttctgaagaaaatgggactctaggtgacatatgggaaactatctcgggcagtgatcttgtgttgcttttgatttctgattctgcccaggcagataattatgaaaaaatcttttcccacatgaagccaaacagcatacttgggctgtcccatgggtttcttcttgggcatttacagtctttgggatttgattttccaaagaacattagcgtaattgctgtgtgcccaaaaggtatgggtccatctgtgaggagattgtatgtccaaggcaaagagataaatggggctggtattaattcaagttttgcggtccaccaagatgttgttggaagagctactaatgttgctttggggtggtctgttgctcttggttctccattcacttttgccactaccttggagcaggaatacaagagtgatatctttggggagagaggcattttacttggtgctgttcatggaattgtggaatccttatttaggagatatactgagagtggaatggccgaagatgtggcttataaaaacactgttgagagtataacaggaattatatccagaaccatctctactaagggcatgctagctgtatacaatgctttatccgatgatgggaaaaaggaatttgaaaaagcttatagtgcttctttttatccctgcatggaaattttgtatgagtgctatgaagatgtagccagtggcagtgagattcgtagtgttgttctagctgggcgtcgtttttatgagaaagagggactacctgcgtttcccatgggtaaaattgaccagacccgtatgtggaaggttggtgagcgtgttcgttctacaagaccagcaggtgatcaaggcccattatatccttttactgccggtgtctttgtggcattgatgatggcccagattgagatcctgagaaggaaaggacattcctactctgaaatcattaatgagagtgtcatcgaatctgttgattctttgaatcctttcatgcatgctcgcggcgtttccttcatggtcgataactgctcaaccacggctaggttgggttcaaggaaatgggctccacgatttgattacatcctaacccagcagacctttgtggcagtggacaatggtgcacctattaaccgggacctaatcaccaacttcatatcagatccagtgcatggtgcaattgaagtttgtgctgaactgagacctacagtagacatttctgtgccagctgatgcagactttgttcgcccagaattgcgccaatccaacaattagaacttgaagcaattatggcttttactcggtcaaattacagtttgctcggtagactagttgtcttagtccgtttttcctgcttcatttttatgatcgagtgctagtatgtaagttgtattaccattttgtagttgtagtttgtaacactttatgttatgcgaactaggaatgttacttggtgtccgatttaattataagtaaataaagcatgtcg

SEQ ID NO: 2058 - DNA, 2021 bp, Cicer arietinum
cactttctctcacataatatagcgcacgttagcacactctcatttgcttctctttcatttcccaatacttgctgcaacttcttcttcctccggcaatggcgactaccacgtcatcttatccggctatctccgccacctctgaaatcctacttaacccgatcactaccagaagcttcaccaacactaaccttgcactacaatcttcgtttccgaaactcggcttcaaaaccctaactcatcgccgaagcaccggctcagctctcgcagctcgcatggtgtcagcgccggcgataacactcccggactcactaaatttcgacacgtcccttttcaagaaggaaaaagtcaacctcgccggtcacgacgagtttatcgtgagaggtggcagggatttgttccatttgttaccagatgctttcaaagggattaagcagattggtgttatcgggtggggatcacagggacctgctcaggctcaaaatctaagggactcacttgctgaagcaaagtctgatattgttgttaaggttggattgaggaaaggttctagttcctttgctgaagctagagctgctgggttttctgaagaaaatgggactctaggtgatatatgggaaactgtatcgagcagtgatcttgtgttgctgttgatttctgattccgctcaggcagataattatgaaaaaatattttcccacatgaagccaaacagcatacttgggctgtcccatggatttcttcttgggcatttacaatcgttgggacttgattttccaaagaacattagtgtaattgctgtttgcccaaaaggtatgggtccatcagtgaggaggctgtatgtccaaggcaaagagataaatggggctggaattaattcaagttttgcagtccaccaagatgtggatggaagagctactaatgttgctttagggtggtctgttgctcttggttctccattcacttttgccactaccttggagcaggaatataagagcgatatctttggggagagaggcattttacttggtgctgtccatggaattgtggaatccttatttaggagatatactgaaagtggaatggctgaagatctggcttataaaaacaccgttgagagtataacaggaattatatctaaaaccatctcaaccaagggcatgctagctgtgtacaatgctttatctgaagatgggaaaaaggaatttgagaaagcttatagtgcttcgtattatccctgcatggaaattttgtatgagtgctatgaggatgtagccagtggcagtgagattcgcagtgttgttctggctgggcgtcgtttttatgagaaagagggtctgcctgcatttcccatgggtaaaattgaccagactcgcatgtggaaggttggcgagcgtgttcgatctacaagaccagcaggtgatcaaggcccattatgtccttttactgctggtgtctttgtagcattgatgatggcccagattgagatcctgagaaggaaaggtcattcttactctgaaatcattaacgagagtgttattgagtctgttgattctttgaatcctttcatgcatgctcgtggtgtttccttcatggttgataactgttcaaccacggctaggttgggctcgaggaaatgggctccacgatttgattacatccttacccagcagacctttgtggaagtggacaatggtgcgcctattaaccgggacctaatcagcaacttcataacagaccctgttcatggtgccattgaagtttgtgctgaactgagacctacattagacatttctgtgccacctgatgcagactttgttcgtcccgagttgcgtcaatccaacaattagaacattaatcaattatggcttttatattatgtatagtttgttcaaaatagttgttgtattagtcctgaattttcagttgtttcttaatgttatgtgaactaggaatgctacttgacatcctattcaatattaatgtaagttaataaagcatgtcatgcaagtgtaaggtggctc

SEQ ID NO: 2059 - DNA, 2061 bp, Vigna unguiculata
cctctttccacccaaacacactctactccttcttctgcaataatggcggctgctgctgcgacgtcgtgttcttctgcaatctctgctgcctctgaaaccctagccaaaccttcttccagaagcttctccgctaccagcctcgctctacaatcctcttcttccaaactcaactttaaatccctaaagctgaaccgatgcggcgctctcggtgctcgtatggtggcggcgccggtgaaagccccggtgcagctcgatttcgacacgaaagttttcaagaaggagaagattaacctcgcaggacacgacgagtacatcgtgagaggaggcagggatttgttccactttttgcccgacgctttcaaggggatcaagcagattggtgtcatcggttggggatctcaggggcctgcccaggctcagaatctaagggactcgcttgctgaagcaaagtccgatattgtggttaagattggactcaggaaaggttctcgctcctttgctgaagctcgggcagccgggtttactgaggagaatgggactcttggtgacatatgggaaactgtctcgggcagtgatcttgtgatgttgttaatttctgattccgcacaggctgataattatgaaaaaatattttctcatatgaaaccaaatagcatacttgggctttcccatggttttcttcttgggcatttgcagtcaattggacttgactttccaaagaacattagtgtaattgctgtgtgcccaaaggggatgggtccatctgtaaggaggctctatgtgcaaggcaaagaaataaatggtgctggaattaatgcaagttttgccgtccaccaggatgtggatggcagggctactgatgttgctttgggatggtctgttgcccttggttctccattcactttcgccactacattagagcaagagtacaagagtgatatctttggggagagaggcattttacttggcgctgttcatggagttgtggaatccttgtttaggagatacactgataatggaatggacgaagatctggcgtataagaatactgttgagtctataactggaattatatctaaaaccatctcaaccaagggcatgcttgctgtatacaatgctttatctgaagatgaaaaaagggaatttgagaaagcttacagtgcttcttattatccttgcatggacattctgtacgagtgctacgaggatgtagccagtggtagtgagattcgcagtgttgttctggctggacgccgcttctatgagaaagaaggtctacctgctttccccatgggtaacattgatcaaacccgcatgtggaaggttggtgagcgtgtccgttctacaagaccagcaggtgatcaaggcccattatatgcttttactgctggtgtctttgtggcattgatgatggcccagattgagatcctgaggaagaaagggcattcctactccgaaatcattaacgagagtgtgatcgaggctgttgattctttgaatccattcatgcatgctcgcggtgtttctttcatggttgataactgttcaaccacggctagattgggttcgaggaaatgggctccacgatttgattacattcttacccagcaagccttggtggcggtggacaatggaagccctgttaaccaggacttactcagcaactttctttcggacccagtgcatggagccattgaagtctgcgccaaactgagacccacagttgacatttctgtgccagcagatgcagacttcgttcgtccagagttgcgccactccaattagaccaatttatggctttcacctcgaatcattttccgatgtgctcagaactgcagtttcttgttagtttggggtttctagttttgtttttatgaatgaatgctagtatgtaagttgtattatcattttgtagtttgtacctcctgtgtttctgctgccgaggaaggaactttaacataagtaatctacgtccacaaatgttgacccatgtcatttcaacttttcatgcatatccttgcaaacctttcaataatttcaccaccgaaagcaattcgaacc

SEQ ID NO: 2060 - DNA, 1994 bp, Vigna unguiculata
ctctttccacccaaacacactctactccttcttctgcaataatggcggctgctgctgcgacgtcgtgttcttctgcaatctctgctgcctctgaaaccctagccaaaccttcttccagaagcttctccgctaccagcctcgctctacaatcctcttcttccaaactcaactttaaatccctaaagctgaaccgatgcggcgctctcggtgctcgtatggtggcggcgccggtgaaagccccggtgcagctcgatttcgacacgaaagttttcaagaaggagaagattaacctcgcaggacacgacgagtacatcgtgagaggaggcagggatttgttccactttttgcccgacgctttcaaggggatcaagcagattggtgtcatcggttggggatctcaggggcctgcccaggctcagaatctaagggactcgcttgctgaagcaaagtccgatattgtggttaagattggactcaggaaaggttctcgctcctttgctgaagctcgggcagccgggtttactgaggagaatgggactcttggtgacatatgggaaactgtctcgggcagtgatcttgtgatgttgttaatttctgattccgcacaggctgataattatgaaaaaatattttctcatatgaaaccaaatagcatacttgggctttcccatggttttcttcttgggcatttgcagtcaattggacttgactttccaaagaacattagtgtaattgctgtgtgcccaaaggggatgggtccatctgtaaggaggctctatgtgcaaggcaaagaaataaatggtgctggaattaatgcaagttttgccgtccaccaggatgtggatggcagggctactgatgttgctttgggatggtctgttgcccttggttctccattcactttcgccactacattagagcaagagtacaagagtgatatctttggggagagaggcattttacttggcgctgttcatggagttgtggaatccttgtttaggagatacactgataatggaatggacgaagatctggcgtataagaatactgttgagtctataactggaattatatctaaaaccatctcaaccaagggcatgcttgctgtatacaatgctttatctgaagatgaaaaaagggaatttgagaaagcttacagtgcttcttattatccttgcatggacattctgtacgagtgctacgaggatgtagccagtggtagtgagattcgcagtgttgttctggctggacgccgcttctatgagaaagaaggtctacctgctttccccatgggtaacattgatcaaacccgcatgtggaaggttggtgagcgtgtccgttctacaagaccagcaggtgatcaaggcccattatatgcttttactgctggtgtctttgtggcattgatgatggcccagattgagatcctgaggaagaaagggcattcctactccgaaatcattaacgagagtgtgatcgaggctgttgattctttgaatccattcatgcatgctcgcggtgtttctttcatggttgataactgttcaaccacggctagattgggttcgaggaaatgggctccacgatttgattacattcttacccagcaagccttggtggcggtggacaatggaagccctgttaaccaggacttactcagcaactttctttcggacccagtgcatggagccattgaagtctgcgccaaactgagacccacagttgacatttctgtgccagcagatgcagacttcgttcgtccagagttgcgccactccaattagaccaatttatggctttcacctcgaatcattttccgatgtgctcagaactgcagtttcttgttagtttggggtttctagttttgtttttatgaatgaatgctagtatgtaagttgtattatcattttgtagtttgtacctcctgtgtttctgctgccgaggaaggaactttaacataagtaatctacgtccacaaatgttgacccatgtca

SEQ ID NO: 2061 - DNA, 2018 bp, Glycine max
actgaactctcttttgcaccgcaaacagcttcacttcacactctactcccaaaatggcggctgctacgacgtcgtattcttccgcaatcgccgcctcgtccgataccctagccaaacctgcttccaccagaacattctccgccaccaacctcgcccttcaatcgtcgtcttccaagctcggtttcaaatccctaaagcttcaccgatgcgccgccgccgccggctccgccctcggcgcgcggatggtgtcggcgccggcggtcaaggcccccgcactgctcgatttcgacacgaaggttttcaagaaggagaagattaacctcgctggacacgatgagtacatcgtaaaaggaggcagggatttgtttcacttgttgcccgatgctttcaagggtatcaagcagattggtgttatcggttggggatctcagggacctgctcaggctcagaatctacgggactctcttgctgaagcaaagtctgatattgtggtcaagattggactcaggaaaggttctcgttcctttgccgaagctcgggcagctgggttttctgaggagaatgggactctaggtgacatatgggaaactgtctcgggcagtgatcttgtgatgctgttaatttctgattccgcgcaggctgataactatgagaagatattgtctcacatgaagccaaacagcatacttgggctttcccatggttttcttcttgggcatttacagtcattgggacttgactttcctaagaacattagtgtaattgctgtgtgcccaaagggaatgggtccatctgtaaggaggctctatgtccaaggcaaagagataaatggtgctggaattaatgcaagttttgcagtccaccaggatgtagatggcagggctactgatgttgctttgggatggtccgttgcccttggttctccattcacttttgccactacattagagcaggagtacaggagtgatatctttggggagagaggaattttacttggtgctgttcatggagttgtggaatccttgtttaggagatacactgataatggaatgaacgaagatctggcctataagaatactgttgagtctataacagggattatatctaaaaccatctcaactaagggcatgctagctgtatacaatgctttatctgaagatgagaaaagggaatttgagaaggcttatagtgcttcttattatccttgcatggaaattctgtatgagtgctatgaggatgtagccagtggtagtgagattcgcagtgttgttctggctgggcgtcgcttttatgagaaagagggtctacctgcttttcccatgggtaacattgatcaaacccgcatgtggaaggttggtgagcgtgtccgatctacaagagcagccggtgatcaaggcccattatatcctttcactgctggtgtctttgtggcattgatgatggcccagattgagatcctgaggaagaaagggcattcctactcggaaatcattaatgagagtgtcatcgaggcagttgactctttgaatcctttcatgcatgctcgtggtgtttctttcatggttgataactgttcaaccacagctaggttgggttcgaggaaatgggctccacgatttgactacatcctaacccagcaggccatggtggctgtggacaatggaactcctgttaacagggacttaatcagcaacttcctgtcagacccagtgcacggagccattaaagtttgcgctgaactgagacccacagtagacatttctgtgccaccagatgcagactttgttcgtccggagttgcgttctagcaattagaacttaaaagcaattatggctttcacttcgaatctttttcagatttctcagaactgcagttatcttgttagtttgggttttcatgattggatgctagtgtgtaagttgtattgtcattttacagtttgtacccgcctgtgttctgccactgaggaacgttacttggtgtcctatttaaatgagtcacgctagtacttaccatta

SEQ ID NO: 2062 - DNA, 2068 bp, Phaseolus coccineus
tcattcatcgaaccctctttccaccccaactgatacaccctactccacataatggcggctgcgacgacgtcgtgttcttctgcaatctatgccgcctccgaaaccctagccaaaccttcttccagaagcttctccgctaccagcctcgctctgcaatcctcgtcttccaaactcgccatcaaatccctaaggctgagcggatgcggctctgctctcggcgctcgtatggtggcggcgccagctgtgaaggcccctgcgctgctcgatttcgactcgacggttttcaagaaggagaagattaacctcgccggacacgacgagtacatcgtgagaggaggcagggatttgttccaccttttgcccgacgctttcaaggggatcaagcagattggtgtcatcggctggggatctcagggacctgcccaggctcagaatctaagggactcgcttgctgaagcaaagtctaatattgtggtcaagattggactcaggaaaggttctcgttcctttgctgaagctcgggcagctgggtttactgaagagagtgggactcttggtgacatatgggaaactgtatcgggcagtgatcttgtgatgttgttaatttctgattccgcacaggctgataattatgaaaaaatattttctcacatgaaaccaaacagcatacttgggctttcccatggttttcttcttgggcatttgcagtcaattggacttgactttcctaagaacattagtgtaattgctgtgtgcccaaaggggatgggtccttctgtaaggaggctctatgtgcaaggcaaagaaataaatggtgctggaatcaatgcaagttttgccgtccaccaggatgtggatggtagggctactgatgttgctttggcatggtctgttgcccttggttctccattcactttcgccactacattagagcaagaatacaagagtgatatctttggagagagaggcattttacttggcgctgttcatggagttgtggaatccttgtttaggagatacactgagatgggaatggacgaagatctggcgtataagaatactgttgagtctataactggaattatatctagaaccatctctaccaagggtatgctagctgtatacaatgctttatctgaagatgagaaaaggatatttgagaaagcttacagtgcttcttattatccttgcatggacattctgtatgagtgctacgaggatgtagccagtggtagcgagattcgcagtgttgttttggctggacgtcgcttttatgagaaagagggtctggctgctttccccatgggtaacattgatcaaacccgcatgtggaaggttggcgagcgtgtccgttctacaagaccagcaggtgatcaaggcccattatatccttttactgctggtgtctttgtggcattgatgatggcccagattgagatcctgaggaagaaagggcattcctactccgaaatcattaatgagagtgttatcgaggctgttgattctttgaatcctttcatgcatgctcgtggtgtttctttcatggttgataactgctcaaccacggctagattgggttcgaggaaatgggctccacgatttgactacattcttacccagcaggccttggtggcggtggacaatggaacacctgttaaccaggacttacttggcaacttcctttcagacccagtgcatagagccattgaagtttgcgccaaactgagacccacagtagacatttctgtgccagcagatgcagacttcgttcgtccagagttgcgccacgccagcaattagaccaaattatggctttcaccttgaatcattttccgatttactcagaactgcagtttcttgttagaagggtttctagttttatttttatgagtgaatgctagtatgtaagtttatcattttgtagtctgtacctcctgtgtttctgcaaccgaggaacgtttaacataagtaatctacgtctacaaatgcgagccatgtcatttttcatgcagttcctctctataacctttcaataatttcagcaccagcaatttcttcatagcaactc

SEQ ID NO: 2063 - DNA, 2056 bp, Malus domestica
tttcctctgcatcccagtcatcaatggcggcggctacttcctccttctctcctgccctctcccctgctccccaatcatcctccgcatccaaaacccatgtggctccctccagtctagggttttcatccgcggtctccaagtctctcagccctctgagagccaaggccacccgcggtggtaataatgtctccggcggcggctcagctctcggagctcgcatggtgtcaatgccgtccattaagccccctccttctctcgatttcgatacctctgttttcaccaaggagaagatcaacctcgctggtcacaacgagtatattgtgagaggaggaagggatctgttccacttgctgcccgatgctttcaaaggtattaagcagattggtgttatcggttggggttctcagggacctgctcaagctcagaatctaagagattctctagttgaagcaaagtctgacattgttgtcaagattggactcagaaagggttctcgttcttttgctgaagctcgtgcagctggtttcactgaggagaatgggactttgggggatatatgggaaacaatctcaggcagtgatctcgtgttgctactaatctctgattctgcacaggccgataattatgagaaagtattttcacacatgaaaccaaatagtatacttggtctttcccatggttttcttctagggcatttgcagtcagtgggacttgactttcccaagaacttcagtgtaattgctgtatgtcccaaggggatgggtccatctgtaaggagactttatgtccaaggcaaagagataaatggtgcgggaattaattccagttttgcagtccaccaggatgttgatggtagagccacagatgtggccctgggctggtcagttgcccttggttctcctttcacatttgccactacactagagcaggaatacaaaagtgacatctttggcgaacgaggcatattacttggtgctgttcatggaattgtggagtccctgtttagaaggtacactgaaaatggaatgagtgaggatttggcttataaaaacactgttgaatgtataactggaattgtgtcaaggaccatctcggctaagggaatgttagagatttacaactctttgtctgaagatggcaaaaaggaatttgaggctgcatatagcgcctcattttatccatgcatggacatcttgtatgaatgctatgaagatgttgccagtggcagcgagatccgcagtgttgtcttggccggtcgtcgcttttatgagaaggagggtctgcctgcattcccaatgggtaaaattgatcagacccgcatgtggaaagtcggtgagcgtgtcagatcaacaaggccagctggtgatctaggcccattacaccctttcactgcgggtgtttttgttgccttaatgatggcgcagatcgaagtattgaggaagaaaggacattcatattcggagatcattaatgaaagtgttattgagtcggtggattctttgaatccttttatgcatgcacggggagtttctttcatggttgataactgttcaacaacagctcggttgggatcaaggaaatgggctccacgatttgattacatccttactcagcaggccttagtttctgtggacaatggtgcacccatcaaccgagacctcatcagcaacttcatgtcagatccagtgcatggagccatcaaagtatgcgctgaactgagacctacagttgacatttcagtgactgctgatgcagattttgtgcgaccagagttgcgtcagagcaactaaaactcgacgaacctactgcctgagctggcctatgaattccgtttggttccatatttaaggtgtgctgtagtttgtcctagtttattctgtttttactgatcatgtgtacttcaacacattgcaagttgtgtttaacgctgaatgttgtgttatgattttgcggtagtactaagtagttaaaatattaataatgttactgcggatggtggttccttagaatgtctggttattggtttacggatgtagttttcaatttttgcatttct

SEQ ID NO: 2064 - DNA, 2063 bp, Phaseolus coccineus
atcgaaccctctttccaccccaactgatacaccctactccacataatggcggctgcgacgacgtcgtgttcttctgcaatctatgccgcctccgaaaccctagccaaaccttcttccagaagcttctccgctaccagcctcgctctgcaatcctcgtcttccaaactcgccatcaaatccctaaggctgagcggatgcggctctgctctcggcgctcgtatggtggcggcgccagctgtgaaggcccctgcgctgctcgatttcgactcgacggttttcaagaaggagaagattaacctcgccggacacgacgagtacatcgtgagaggaggcagggatttgttccaccttttgcccgacgctttcaaggggatcaagcagattggtgtcattggctggggatctcagggacctgcccaggctcagaatctaagggactcgcttgctgaagcaaagtctaatattgtggtcaagattggactcaggaaaggttctcgttcctttgctgaagctcgggcagctgggtttactgaagagagtgggactcttggtgacatatgggaaactgtctcgggcagtgatcttgtgatgttgttaatttctgattccgcacaggctgataattatgaaaaaatattttctcacatgaaaccaaacagcatacttgggctttcccatgggttttcttcttgggcatttgcagtcaattggacttgactttcctaagaacattagtgtaattgctgtgtgcccaaaggggatgggtccttctgtaaggaggctctatgtgcaaggcaaagaaataaatggtgctggaatcaatgcaagttttgccgtccaccaggatgtggatggtagggctactgatgttgctttggcatggtctgttgcccttggttctccattcactttcgccactacattagagcaagaatacaagagtgatatctttggagagagaggcattttacttggcgctgttcatggagttgtggaatccttgtttcggagatacactgagatgggaatggacgaagatctggcgtataagaatactgttgagtctataactggaattatatctagaaccatctctaccaagggtatgctagctgtatacaatgctttatctgaagatgagaaaaggatatttgagaaagcttacagtgcttcttattatccttgcatggacattctgtatgagtgctacgaggatgtagccagtggtagcgagattcgcagtgttgttttggctggacgtcgcttttatgagaaagagggtctggctgctttccccatgggtaacattgatcaaacccgcatgtggaaggttggcgagcgtgtccgttctacaagaccagcaggtgatcaaggcccattatatccttttactgctggtgtctttgtggcattgatgatggcccagattgagatcctgaggaagaaagggcattcctactccgaaatcattaatgagagtgttatcgaggctgttgattctttgaatcctttcatgcatgctcgtggtgtttctttcatggttgataactgctcaaccacggctagattgggttcgaggaaatgggctccacgatttgactacattcttacccagcaggccttggtggcggtggacaatggaacacctgttaaccaggacttacttggcaacttcctttcagacccagtgcatagagccattgaagtttgcgccaaactgagacccacagtagacatttctgtgccagcagatgcagacttcgttcgtccagagttgcgccacgccagcaattagaccaaattatggctttcaccttgaatcattttccgatttactcagaactgcagtttcttgttagaagggtttctagttttatttttatgagtgaatgctagtatgtaagtttatcattttgtagtctgtacctcctgtgtttctgccaccgaggaacgtttaacataagtaatctacgtctacaaatgcgagccatgtcatttttcatgcagttcctctctataacctttcaataatttcagcaccagcaatttcttcatagcaactc

SEQ ID NO: 2065 - DNA, 2112 bp, Arachis hypogaea
acaaactttgtcaatggctgctgctgccgcttcttcaaacaccatagcactagcagcagctaagcccttaaccaaagcccctactccaaccgttttcaacggtctcgcattctccgttaacaacctcactccaagacccctcgctgctcgccacgtcaacggtgctgccctcgctgctaaaatggtttcgtcggcgccggcggtttctctccctgcctcgcttgatttcaacacttctatcttcaagaaggagaagattagcctcgctggacacgatgagtacattgtgaaaggagggagagatttgtttcatttgttgccggatgctttcaaggggattaagcagattggtgttatcggatggggttcacagggacctgcacaggcccagaatcttcgggactcactcgctgaagcaaagtctgacatagtggttaagattggactcaggaaaggttctagttcctttaatgaagctcgggcagctggtttcagtgaggaaaatggaactctaggtgacatatgggatactatctcaggcagtgatcttgtcttgctcttaatttcagatgctgcacaggcagatagttatgaaaaaatattttcgcacatgaagccaggcagcatacttggattgtcccatgggtttcttcttgggcatttacagtcactgggaattgattttcccaagcacttcagtgtaattgctgtatgtccaaaggggatgggtccttcagtgaggaggctctatgttcaaggcaaagagataaatggtgctggaattaattcaagttttgcagtccaccaggatgtcgatggccgggctactgatattgctttggcatggtctgttgcccttggttctcccttcacatttgcgactacattggagatggaatacaggagtgacatatttggagagagaggcattttactcggtgctgttcatggaattgtggagtccttgtttaggaggtacactgaaaatggaatgagtgaagatctggcttataagaacactgttgagtccataacaggaatcatatctaaaatcatatcaactaagggcatgttggctgtatacaattctttatctgaagatgaaaaaagagaattcgagacggcatatagtgcgtcatattatccctgcatggagattttgtacgagtgctacgaggatgtagctagttgtagcgagattcgcagtgttgttttggctgggcgtcgcttttatgagaaagagggtctacctgcctttcccatgggcaaaattgatcagacccgcatgtggaaagttgggcagcgtgtccgatctacaaggccagcaggtgatctagggccattatatccatttactgctggtgtatatgtggcattgatgatggctcagattgagatcttgaggaagaaagggcattcctactctgaaatcatcaatgagagtgtcattgagtctgttgattcattgaaccctttcatgcatgctcggggtgtatctttcatggttgataactgttcaaccacagcaaggttgggttcaaggaaatgggctcctagattcgattacatcctaacccagcaggccttggtggcagtagacagtggtgcgcctactaaccgggacctgatcagcaacttcttgtcagatccagtccatggagccattgaagtatgtgctgaactgaggcctactgtggatatttcagtcccaccagatgcggattttgtccgtcctgagttgcgccagtctggaaactagaacatcaagcagtggatgctttttcttgagctgattcaatttcagaatgctcagaatagcctgtatcctggtagtgagtggattttgtttgagtgctagtatggaacatctgtattaattctctccagttttaaggattttgcggatgaggaatgttgcgtattaggtaatatcgtactataaatgagctgataagttatgttcacaagtatgtggagtgttatttgttggtatcatggcatcagtccaataacatttcttagagctttattccatatagataaccgaattgacttgcggtgatctttagtgtagataatgtgttaaattttttaatataaatataaaatgga

SEQ ID NO: 2066 - DNA, 2122 bp, Cajanus cajan
gttccattcgctgctactgttactcttcttatcggctataaaatgtctgcgagtgctgcgtcttcggcactctgcgctccttccagaaccttccgcgcgaagcccgtcgcgagagcctccatcgccgttcgcaatctcgcgttctccaagaagctccgcttcggcctcaatcccgtcgccatggccgctcgcatggtggccgcgcccgccgtcactccgccgccgccgtcgctcgacttcgagacctccgtcttcaagaaggagaagattcacctcgcgggacacgacgagtacattgtgaaaggaggcagggatttgttccctctgttgccgggtgctttcaaagggattaagcagattggtgtcatcggatggggctcgcagggacctgctcaggcgcagaatttgcgggactcgcttgcggaagcgaagtctgatattgtggttaaggttgggctcaggaaaggttctcgttcctttaatgaggctcgtgcagctggttttagtgaggagaatggaactctgggtgatatatgggaaactatctcaggcagtgatcttgtgctgctgttgatttctgattctgcgcaggcagacaattatgaaaaaatattttcccacatgaagccaaatagcatattggggctgtcccatggttttcttcttgggcatttacagtcaatgggacttgattttcccaaggaattcagtgtaattgctgtatgcccgaaaggtatgggtccttctgtaaggaggctgtatgtccaaggcaaagagataaatggtgctggaattaattcaagttttgcagtccaccaggatattgatggcagagctactgatattgctttggcatggtctgttgcccttggttccccttttacatttgccactacattagagatggaatacaggagcgacatctttggggagagaggcattttacttggcgctgttcatggtactgtggaatccttgtttaggaggtacactgaacatggaatgagtgaagatttggcttataacaacacagtggaatccattacaggaactatatccaaaattatctcgactaagggcatgttggctgtatacaatgctttatctgaagatgaaaaaaaggagtttgagaaagcatatagtgcttcatattatccctgcatggacattttgtatgagtgctacgaggatattgctgctggaagtgagattcgcagtgtggtcttggctgggcgtcgcttttatgaaaaagagggtcttcctgcatttcccatgggtaaaattgatcagaccaggatgtggagggttggtgagcgtgtccgatctacaaggccagcaggcgatctaggcccattatatccatttactgctggtgtttacgtggcattgatgatggcccagattgaaatcctgaggaagaaagggcattcttactcagaaatcattaatgagagtgtcattgagtctgttgattctttgaatcctttcatgcatgctcgtggtgtttctttcatggttgataactgttccaccacggcaaggttgggttcaaggaaatgggctccccgatttgattacatcctaacccagcaggccttggtggctgtggacaacggagcacctatcaaccaggacctaatcagcaacttcctgtcagacccagtgcatggtgccattgaagtttgtgcggaactgagacctacagtagacatttctgtgccaccagatgcagactttgtccgtcctgagttgcgtcagtctagcaattagaacttgaaccaatcactccttgtcgtgagccatcaccctttcggaatgcttagaatagcagttgtcttgtttgaattttgttcctatggttgagtatggaagtatgtaatttcgctgtgtagtactgagattttaataagaggagtgttgcttaatgccgaattagaaacgagttattaaagacgtgtgaagttcattactaatttttccattaggtgtttcggtcattaacttcagatctatccacaccgcaaaagtagtgtatgtgccatctaaatcttaagatcttaggattaactacaagtcgacaacaaacagtcttcacttgtggaaaaaatgacacatcttagct

SEQ ID NO: 2067 - DNA, 2038 bp, Humulus lupulus
caacactctcttcttctcactctgctactgtcatcaatggcggcggcggctacctcttccttctctccagccatctcggcaccatcctcctctccttcttcccaaacccttctcacccccaaatctcttggcttcgtatctgtcgcctgcaagtctctcaggtctctcaagactgcagcttctcgtgctgataatgtcgctaccggctcagctctcggagctcgcatggtctctgcgcccgccatcaagtctccggtttctctcgattttgacacctctgttttcaagaaggagaaggtcaacctcgctggtcacgaagagtatattgtaagaggaggaagagatttgttccatttattgcctgatgcttttaagggcatcaagcagattggtgtgattggttggggttcccagggacctgctcaagctcagaatttgagagactctctagctgaggcaaagtctgatatcgtggttaagattgggttgaggaagggatctcgctcttttgctgaagctcgtgcagctggtttcactgaagagagtgggacactgggtgatatttatgaaacaatctcaagcagcgatcttgttatgctactcatttctgattctgcacaggctgataacttcgagaaaattttctcacacatgaagccaaacagcatccttggtctttcccatggttttcttttgggccatttgcagtcggttggaatggatttccccaagaacattagtgtaattgctgtatgtcccaaggggatgggtccttctgtgaggaggctttatgtccagggcaaagagataaacggtgcaggaattaattccagttttgcagtgcaccaggatgttgatggacgagctaccgatgtggccttggggtggtcagttgcccttggctctcctttcacatttgccactactctggaacaggaatacaagagtgacatctttggcgagcgaggcattttactcggggctgttcatggcattgtggagtccctattcagaaggtacactgaaaatggaatggctgaagatctggcttacaagaacactgttgagtgtattactggaattatatcaagaaccatttcaactaagggtatgctgtctgtatacaattccctgtctgcagaaggcaaaaaggattttgagacagcttatagtgcctcgttctatccttgcatggatatcttgtatgagtgttacgaagatgtagccagttgcagcgagatccgcagtgttgtcttggctggccgacgattttatgaaaaggagggtcttccagccttcccaatgggtaacattgatcagacaaggatgtggaaagtcggtgagaaagtccgatcaactcgaccagctggtgatttaggtccattgtacccatttacagctggtgtctatgttgcattgatgatggctcagattgagatcttgaggaagaaagggcactcctactcagagatcatcaacgaaagtgtgatcgagtcagtggattcattgaaccccttcatgcatgcccgtggagttgcattcatggttgataactgctccacaacagctcgattgggatcaaggaaatgggcgccacgcttcgactacattcttactcaacaggccttggtggcagtggacaatggcacacccatcaaccaggacctcatcagcaacttcctatcagatcccgttcatggagccattgaagtatgtgcacagctgagacccaccgtggacatttcagtccctgcagatgccgacttcgtgaggcccgagttgcgtaactagagcaactgaaggtgaaacctcgtctattattgcagttatgtttgagcagtagaatcagtcataaagtctagtgaggcgtgatttataatctacaagagttgaattggccgactatagctattagttgcatgtgttttgtatggtaatgttatcagctgtgtttctttcttaaataagaccaagtgaggttaatgttttagtagttttgaaatgacactgagtagttaattataataacaatgtttcc

SEQ ID NO: 2068 - DNA, 2187 bp, Fagus grandifolia
cttcgcttcactttgtctctttatctatcagaccgactctttttttatacctcctcacatttcatggcggcggctacttcttcatcatttgctcaagtgcctctctcgtcttccatctcaaaaaccctaaagcccgtctccaagcctttcactctaggcttcgcggggtcgttttgcaagggcctcaaccctctcagagccgccgcaatcagtggcgttggtttttctggtggatccactctcggtgctaaaatggtgtctgttccggccatcaagccactcacttgtctcaatttcgacaccaagatcttcaacaaggagaaagttaatctcgctggccacgaggagtatattgtgagaggaggaagggatttgttccctttgcttccagaagcatttaaagggattaagcagattggtgttattggctggggttcacagggacctgctcaagctcagaatttaagggattctctcgctgaagcaaaatctgatatcgtggtcaagattggactcaggaaagggtcccgttcttttgctgaagctcgtggagctggttttactgaagagaatggcactctaggggatatatgggagactatctccggaagtgatcttgtattgctactgatttctgattctgcgcaggctgacaattatgagaaagtattctcccacatgaagccaaacagcatacttgggctttcccatgggtttcttcttggtcatttgcagtcggtaggacttgatttccccaaggacatcagtgtgattgctgtatgtccaaagggaatgggtccttctgtaaggagactttatgtccaaggaaaagagataaatggtgcagggattaactccagttttgcagtccatcaggatgttgatggtagagccacagatgttgcccttggatggtcagttgctcttggttctcctttcgcatttgccactacactagagcaggaatataagagtgacatctttggggagcgtggcattttacttggcgctgtccatggaatcgtggagtctttgtttagaaggtacacagaaaatggaatgagtgaagatctggcttacaagaacactgttgagtgcatcacagggataatatcaaggaccatctcaaccaagggcatgttggctgtatacaattccttgtctgaagagggcaaaagggtatttgaaagtgcatatagtgcctcatattatccctgcatggacatcttgtatgaatgctatgaagatgtggccagcggtagtgagatccggagtgttgtcttggctgggcgtcgcttttatgaaaaggatggtctacctgctttcccaatgggtaaaattgatcagacccggatgtggaaagttggtgaacgtgtccgatcagcacggccagcaggagacctaggtccattatatcctttcactgctggtgtttatgtggcattaatgatggcccagattgagatattgaggaagaaaggacactcgtactctgagatcatcaatgaaagtgtgattgagtcagttgattccttgaatccatttatgcacgctcgtggagtgtctttcatggttgataattgttcgacaacagcacggttgggatcaaggaaatgggctccacgttttgattacatccttactcagcaggccttggttgcagtggacaatggttcacccataaaccaggatctcatcagcaacttcctgtcagatccagtgcatggagccattgaagtatgtgcccaactgagacccacagttgacatttcagtgcctgcagatgcagactttgtgcgacccgagttgcgctctggtaattaaagccttaaaacctgtacaccttgagatggccagcaaaatgccttttctggatgtttgagggtgaagacttgttaaatttagaagtaatgtagtttttcttcaatctagtcttgcttggttgagttattctaagtttttgtagagccactattttccttgttgactgtcaagggaattagacgtggcaatgcgtgttcttgttgtagctctggtatgactaaatttttcttaagcaatcttgttggacttcgttttttgtaacttcatgaaaattaaatgaaaaactggatagttgtggtttaataatattagcacccagaacaagggcttggatgttgacagggtaattgaaagggaagtcaa

SEQ ID NO: 2069 - DNA, 2362 bp, Cannabis sativa
aaaatagaaaaatgaataatatttaataaaaattgtcttttttattattttaacattactttcgagtgtgtgtggccctgcaaaatataaagagaactgttgttgaggtgagacgctctctgtctgccacaaaacccttactcttctctctctctaacactctcttcattttactctgctactgtcatcaatggcggcggcggctacatcttccttctctccagccatctctgctccatcctcctctccttctacccaaaaccatctcattcccaaacctcttggcttcgtgtccgtcgcctgcaaatctctcaggtctctcaagactgcagcctctcgtgctgataatgtcgctaccggctcagctcttggagctcgcatggtctctgcgcccgcgatcaagtctccgatctctctcgattttgatacctctgttttcaagaaggagaaggtcaacctcgctggtcacgaagagtatattgtaaaaggaggaagagatttgttccatttattgcctgatgcttttaagggcatcaagcagattggtgtaattggttggggttcacagggacctgctcaagctcagaatttgagagactctcttactgaggcaaagtctgatattgtggtgaagattgggttgaggaagggatctcgctcttttgctgaagctcgtgcagctggtttcactgaggagagtgggactctgggtgatatttatgaaacaatctcaagcagtgatcttgttatgctactcatttctgattctgcacaggctgataactttgagaaaattttctcgcacatgaagccaaacagcatccttggtctttcccatggttttcttttgggccatttgcagtcggttgggctggatttccccaagaacattagcgtaattgctgtgtgtcccaagggaatgggtccttccgtgaggaggctttatgtccagggcaaagagataaacggtgcaggaattaattccagttttgcagtccaccaggatgttgatggacgagctactgatgtggccttggggtggtcagttgccctaggctctcctttcacatttgccactactctggaacaggaatacaagagtgacatctttggcgagcgaggcattttacttggtgctgttcatggcattgtggagtccctattcagaaggtacactgaaaatggaatggctgaagatctggcttacaagaacactgttgagtgtattactggaaatatatcaagaaccatatcgactaagggcatgttggctgtgtacaactcattatctgaagaaggcaaaaaggattttgagactgcttacagtgcctctttctacccttgcatggatatcttgtacgagtgttacgaagatgtagccagttgtagcgagatccgcagtgttgttttggctggccggcggttttatgaaaaggagggtcttccagccttccccatgggtaacattgatcagacaaggatgtggaaggtgggtgagaaggtccgatcagcccgaccagctggtgacttaggtccattgtacccatttacagctggtgtctatgttgcattgatgatggctcagattgaaatcttgaggaagaaaggacattcctactcagagatcatcaacgaaagtgtgatagagtcagtggattcattgaaccccttcatgcatgcccgtggagttgcattcatggttgataactgttcaacaactgctcgattgggatcaaggaaatgggctccacgcttcgactacattcttactcaacaggccttggtcgcagttgacaatggctcacccatcaaccaggacctcatcagcaacttccaatcagatccagttcatggagccattgaagtatgtgcacagctgagacccaccgtggacatttctgtcccggaaaatgcagactttgtgaggccagagttgcgttgaaggtgaagccaacctcctttattgtggcagttgaatcaatcataaattatagtgaggcgttatttagaatctgaatgagttgagttggccagctatagctattagttgcatgtgtttagcatggtaatgttatgttctgtgtttctttcttaaataagaccaagtgaacttaatgttttagtagttttgagatgacattgagtagtagtaattataataacgatgattttatccttatctttgtttgtgtttgtgttagtataatatttgagtagtaactttataaatctgtatcagcggagattttcagattagactgaatttatatatgttataaatgtatcatgtaggctgaataagtgattttctaatgttatctatatacaatttgcgtggaagccattgaatttgaatttgtgg

SEQ ID NO: 2070 - DNA, 1904 bp, Humulus lupulus
ggcggcggcggctacctcttccttctctccagccatctcggcaccatcctcctctccttcttcccaaacccttctcacccccaaatctcttggcttcgtatctgtcgcctgcaagtctctcaggtctctcaagactgcagcttctcgtgctgataatgtcgctactggctcagctctcggagctcgcatggtctctgcgcccgccatcaagtctccggtttctctcgattttgacacctctgttttcaagaaggagaaggtcaacctcgctggtcacgaagagtatattgtaagaggaggaagagatttgttccatttattgcctgatgcttttaagggcatcaagcagattggtgtgattgggttggggttcccagggacctgctcaagctcagaatttgagagactctcttgctgaggcaaagtctgatatcgtggttaagattgggttgaggaagggatctcgctcttttgctgaagctcgtgcagctggtttcactgaagagagtgggacactgggtgatatttatgaaacaatctcaagcagcgatcttgttatgctactcatttctgattctgcacaggctgataacttcgagaaaattttctcacacatgaagccaaacagcatccttggtctttcccatggttttcttttgggccatttgcagtcggttggaatggatttccccaagaacattagtgtaattgctgtatgtcccaaggggatgggtccttctgtgaggaggctttatgtccagggcaaagagataaacggtgcaggaattaattccagttttgcagtgcaccaggatgttgatggacgagctactgatgtggccttggcgtggtcagttgcccttggatctcctttcacatttgccactaccctggaacaggaatacaagagtgacatctttggcgagcgaggcattttactcggtgctgttcatggcattgtggagtccctattcagaaggtacactgaaaatggaatggctgaagatctggcttacaagaacactgttgagtgtattactggaattatatcaagaaccatttcaactaagggtatgctgtctgtatacaattccctgtctgcagaaggcaaaaaggattttgagacagcttatagtgcctcgttctatccttgcatggatatcttgtatgagtgttacgaagatgtagccagttgcagcgagatccgcagtgttgtcttggctggccgacgattttatgaaaaggagggtcttccagccttcccaatgggtaacattgatcagacaaggatgtggaaagtgggtgagaaagtccgatcaactcgaccagctggtgatttaggtccattgtacccatttacagctggtgtctatgttgcattgatgatggctcagattgagatcttgaggaagaaagggcactcctactcagagatcatcaacgaaagtgtgatcgagtcagtggattcattgaaccccttcatgcatgcccgtggagttgcattcatggttgataactgctctacaacagctcgattgggatcaaggaaatgggcgccacgcttcgactacattcttactcaacaggccttggtggcagtggacaatggcacacccatcaaccaggacctcatcagcaacttcctatcagatcctgttcatggagccattgaagtatgtgcacagctgagacccaccgtggacatttcagtccctgcagatgccgacttcgtgaggcccgagttgcgtaactagagcaactgaaggtgaaacctcctctattattgcagttatgtttgagcagtagaatcagtcataaagtctagtgaggcgtgatttataatctacaagagttgaattggccgactatatctatagctattagttgcatgtgttttgtatggt

SEQ ID NO: 2071 - DNA, 2026 bp, Rosa hybrid cultivar
tttgccctctcactctctttctctctccagctcacactaatgtcggctgcaacttcctccttctctccagccctcaccgctactccaccttcatcctccaaagcccacgcggcggctccctccactctcgccttctcctccgccgtctccaagtccctcaaccctctcaggctcagagccgcctctcgcgctgctgctgttggccgcggatccgctctcggtgctcgtatggtctcaatgccgacgattaaggccccgctctctcttgatttcgacacctctgttttcaacaaggagaaggtcaacctcgctggtcacgatgagtatattgtaaagggaggaagggacttgttccatctgctgcccgatgccttcaagggcatcaagcagatcggtgttatcggttggggttcccagggacctgctcaagctcagaacttgagagattctctagctgaagcaaagtcaaatattgtggtcaagattgggctcaggaagggatcccgttcatttaatgaagctcgtgcagctggtttcactgaggagaatgggactttaggtgatatatgggaaacaatctcagagagtgatcttgtgttgctactaatttctgattctgcacaggcagataattatgagaaaatattttcgcacatgaaaccaaatagcatacttggtctttcccacggtttccttctagggcatttgcagtcggagggacttgactttcccaagaacatcagtgtaattgctgtatgcccaaagggaatgggtccgtcagtaaggagactttatgtccaaggcaaagaaataaatggtgcgggaattaattcaagttttgcagtccaccaggatgttgatgggagagccacagatgtggctctgggctggtcggttgcccttggttctcctttcacatttgtcactacgctagagcaggaatacaaaagtgacatctttggcgagcgaggcatattacttggtgctgttcatggaattgtggagtccctgttcagaagatacactgacagcggaatgagtgaagattctgcttataaaaatactgttgaatgtgttactggaattgtgtcaagaaccatatcaactaagggcatgttggaaatatacagctctttgtctgaagctgacaagaaggagtttgagactgcatatagtgcctcctattatccttgcatggacatcctctatgaatgctatgaggatgtagcaagcggcagtgagatccgcagtgttgttttggctgggcggcgattttatgagaaagatggtcttcctgccttccctatggggaagattgatcagacgcgcatgtggaaagttggtgagcgtgtccgatcgacacgtccagctggtgatctaggccctctacaccctttcacagctggtgtttttgtggccctgatgatggcacagattgaagtgttaaggaagaaagggcactcctactcagagataatcaacgaaagtgtaatcgagtcggtggattctttgaatccttttatgcatgctaggggagtttctttcatggttgataattgctcaacaacagcgcggttgggatcaaggaaatgggctccaagatttgattatattctaactcagcaagccttggttgccgtggacaacggtacacccatcaatcaggacctcattagcaacttcatgtcagatccagtgcatggagccattgaagtatgtgctcaactgagacccactgttgatatttcagtgcctgctgatgcagactttgtgcgaccagagttgcgccaatctagcaattagagcttgaagaacctactacgttagctggcctacaaaatcgttttccgggaagtaatgtttgagtgctgtagctttgcccagtttgtcttgtgttacatcgtctatcccatgtacttttattgcaatgcacgttatgtttcttatgaacaaatgaggtatgatgctgaatgttgtattaataatttctgtggtactaataattagttaaataaagttggccctt

SEQ ID NO: 2072 - DNA, 2406 bp, Vitis vinifera
ctgtgaaaaaaaaaaaaatggaaagaaaaaaaaatcctatcaggcccagttgtgtagagcgcatccggcgcacaatagcctagtaaatggaagccctataaactcatctctttgtcgctttaagtggggaatagaggcaaacaatggcggccacaacttccttcgcagcagcggtgccgtcagcttcatcatctctcactaaaaccctaaaatcagactccacaaatcttagtccgaacctagggtttctatcttccaaggcctttcagtctctcagagctcgagtattgcccgctagcagcgtcggcggaactggttcagctctcgctgcaaggatggtgtctactccactgattaagccccccgctcttctcgatttcgaaacctccgtcttcaagaaggagaaggtctccctcgctggtcacgacgagtatattgtgagaggaggacgggatctgtttcatttgctgccggatgctttcaaggggattaagcagattggtgttatcggttggggctcacagggtcctgctcaagctcagaatttaagggattctcttgtggaagcaaaatctaatatcgtggtcaagataggtctcaggaagggatccaagtcatttgctgaagctcgtgctgctgggtttaccgaagagaatgggaccctgggagatatatatgaaaccatttcaggcagtgaccttgtcatgctattgatttccgactcagcccaggctgacaactatgagaaaatattctcacacatgaagccaaacagcattcttggactttcccatgggttccttcttggtcatttgcagtccctgggccttgattttccaaagaacattagtgtgattgctgtgtgtcctaagggaatgggcccatctgtgaggagactctatgtccaaggcaaggaggtaaatggtgctggaattaactccagttttgcagtccaacaggatgttgatggtagagccacagatgttgccctaggatggtcagttgcccttggttcaccttttacttttgccactacacttgagcaagagtacaagagtgacatctttggggagcgaggaattttgcttggtgctgttcatggaattgtggagtccttgtttagaaggtacactgagcatggaacgagtgaggatctggcttacaagaacactgttgagtgcattactggaattatatcaaagaccatttcaactcagggtatgttggctgtgtacaatgccttgtcagaagatgggaaaaaggaatttgaggctgcatacagtgcctcatactatccttgtatggacattttgtatgagtgctatgaagatgtagccagtggaagcgaaatccgcagtgttgtgttggctgggcgtcgcttttatgaaaaagatggtctaccagctttccctatgggtaagattgatcagactcgaatgtggaaagttggtgagagagtgcgctcagtacggccagctggtgacttgggtccgttatgccccttcactgctggtgtgtatgtggctttaatgatggcacagatcgagattttgaggaagaaagggcactcgtactcggagatcatcaatgaaagtgtgattgagtcagtagattctttgaatcccttcatgcatgctcgtggagtttcattcatggttgataattgttcaaccacagcacgtctaggatcaaggaaatgggccccacgatttgattacatcatcacccaacaggcgctggtggcagtggacaatggtgttcccatcaatcgggacctcatcagcaacttcctctctgatcctgtgcatggagccattgaggtttgtgcccagctgagaccaactgttgacatctcggtgcctgcagatgcagatttcgttcgcccagaattgcgccagtctagcaactaaattccggagatggttagcttgctcgggatgtttcatggtgtttgaatctaggtgtgttaagagtgctatcttgttttttttcggttgagtcttatccaaaatatctatcgcagtatatgttgtgtgctagagcaatggaacacaagatcatgcacttcctattagttattttgggacaataatacattagtattatgaaaagtgatggactccctggagttcgttgtaggttttctcagcctcttatggtcatgaacccagcttgaattttggtaattttcaacagcgacgactagagcgccttggctttggtttagctttcaccattttactaggagagctccacaccctattttgtggcattaaaatcatgcatgaactacagtgatgcccttggacgaagtttgatgtggtgttgttccatattagtcatctttcatggaggctcttaatttgcaggatttagctgatttctctcattagcttgtacatgagt

SEQ ID NO: 2073 - DNA, 1980 bp, Vigna unguiculata
cctgtgcataaaacacaccgttttgctgcgccgattgttagcgtctccgctgttacttactttttctggcctataaaatgtcggcaaccgcttcttctacttcactctgcgccacttccagaaccttctacgctaagcccgtcctcgccagaaccttcgtcgcgcttcccacacgcgcgttctccaagctcgccttccaattcaggcccctctccatggccgcgctcggtgctcgcaatgtggccgcgcccgccgtggccccgcctccctcgctggacttcgaaacctccgttttccagaaggagaagattaacctcgccggacacgacgagtatattgtgaaaggagggagggacttgttccctctgctgccggctgctttcaaggggattaagcagattggtgtcatcggatggggttcgcagggacctgcacaggcacagaatttgcgggactctctcgctgatgcgaagtctgacattgtggttaaggttggcctcaggaaaggttctcgttcctttaatgaggctcgctcagctggttttagtgaggagaatggaactctgggtgacatgtgggaaaccatctcaggcagtgatcttgtgttgctgttgatttctgattctgcacaggcagataattatgaaaaaatattttcctacatgaagccaaatagcatacttgggctgtcacatggttttcttcttgggcatttacagtcaatgggacttgattttccgaagcacttcagtgtaattgctgtatgcccgaaaggtatgggtccttctgtaaggagactgtatgtccaaggcaaagagataaatggggctggaattaattcaagttttgcagtccaccaggatgtggatggcagggctactgatgttgctctggcatggtccgttgcccttggttccccttttacatttgccactacgttagagatggaatacaggagtgacatctttggagagagaggcattttgcttggtgctgttcatggtgttgtggaatccttgtttaggaggtacactgagcatggaatgaatgaagatttggcatataacaacactgttgagagcattacaggaactatatctagaatcatctccactaagggcatgttagctgtatacaatactttatctgaagatggaaaaagggaatttgagaaagcatatagtgcttcatattatccctgcatggatattttgtacgagtgctatgaggatatcgctgttgggagtgagattcgcagtgttgtcttggctggacgtcgcttttatgagaaagagggtctgcctgcctttcccatgggcaaaattgatcaaaccaggatgtggaaggttggtgagcgtgtccgatcaacaaggccagccggtgatctaggcccattatatccatttactgccggtgtctatgtggcattaatgatggcacagattgagatcctgaggaagaagggacattcttactctgaaatcattaacgagagtgtgatcgagtctgttgattctttgaatcctttcatgcatgctcgcggtgtttctttcatggttgataactgttcaacaacagcaaggttgggttcaaggaaatgggctccccgatttgattacatcctaacccagcaggccttggtggctgtggacaatggagcacctatcaaccaagacctaatcagcaacttcctgtcagaccaagtccatggagccatcgaagtttgtgctcaattgagacctacagtggacatttcagtgccaccagatgctgactttgtccgtcctgagttgcgtcagtctaccaattagaacaccaaccaatttcttgagcctattcctttctacggagtgcttaaacgacaatggtaatttgagttttgttcttatggtatgtattatgactatgtaatactgtactgagactttaataatgaggaatgtttcttaatgccgaatatacgagggaaattcattacta

SEQ ID NO: 2074 - DNA, 2052 bp, Sesamum indicum
accacacttcctctctctctctctaagctctctctcttacacattttcagatctcctttacgaactcgaaaagcccaagtgcaatggcggcggctgcgcccacctctttctccaccaccaccgccaccacctcttctaaggccctaaaaccatcgtccaatgcgccagctctctccttgagcttcctatcgtcctcttccccttcgcttaggtcgctccgtgcttcccgagctgggtctccagcttccggctccgctctggcggcgcgcatggtgtcggctccagcgatcaagccccctgcgttgctagattttgagacctccgttttcactaaagagaaaatcaacctcgccggtcatgatgagtacattgtgagaggagggagaaatctgttcaagttgttgccggatgcattcaagggcataaagcagattggagtgattggttggggttcacagggacctgctcaagctcagaatttaagggattctttagctgaagtgaagtctgatattgtggtcaagattggtttgaggaagggatctagatcatttgcggaggcccgtgctgctggcttcacagaagaaaatgggaccctaggagacatatgggaaactgtctccagcagcgatttggtgctgctcttgatatcagatgcagcccaggctgataactatgaaaaagtgttctcccacatgaaaccaaatagcatactgggactttcccatgggttcctgttgggccatctgcagtcaatgggtcttgacttccccaagaacattagtgtgatagccgtatgtccgaaaggaatgggaccctctgtgagaaggttatacgtccaagggaaagaaattaatggtgctggtatcaattcaagttttggcgtccaccaggatgttgatggcagagccacagatgttgcccttggatggtcaattgcccttggttcaccttttacttttgccactactctggagcaggagtacaggagtgacatttttggagagcgtggcattttacttggtgctgtgcatggggttgtggaatccttattcagaaggtacactgaaaatggaatgagtgaggatcttgcttacaagaacacagtggagtgcattacaggaatagtatctaagaccatatcaacaaagggtatgctggctgtctataatgcattgagtgaagatgccaaaaaagaatttgagacagcatacagtgcttcattttatccctgcatggatatcctgtatgagtgctatgaggatgtagccagtggcagtgagataaggagtgttgttttggctggccgtcgtttttatgaaaaagagggattgcctgctttcccaatgggcaaaattgatcagacacggatgtggaaagttggtgagcgagtacgagcaacacgtcctgcaggtgacttaggacccctgtatcctttcactgctggagtcttcgtggcattgatgatggcccagattgagattttgaggaagaaaggccactcttactctgagattattaatgagagtgtgattgaggctgtggattcattgaatcctttcatgcatgctcgaggtgtttcgtttatggtcgataactgttcgacgacagcacggttgggatcaaggaaatgggctccaaggttcgattacatccttacccaacaggcactggtcgcagtggacaatgacacccccatcaatcaggatcttatcagcaacttcctgtctgaccctgtccatggtgctattgaagtatgcgcccaactgagacctaccgtcgacatctcagtgcccccagatgctgactttgtgcgccctgaattgcggcaatctggcaactgaaatttcaaggaaatctacgcatgagccagtagtccgctaatgtcgaatttagggaccttatgagtaatgctgttttactagtagaaatttgttgcgtatgtcctttttctgacaatgtgacttggcctgctctagtagttgatataatcttatgatatttgagtgcttattctaaaaaattgttattgtgtttgccaaattccctgca

SEQ ID NO: 2075 - DNA, 1989 bp, Glycine max
gccactctgctgcagtgctgcttcatactttttctcgcctataaaatgtccgccactgcttcactctgcgccacttccagaacaactttctcatcatcgaagcccgtcgcgagaagaagctgcttcgtcgcggttcccaaaatcgcgtttcccaagctccgtttcaaacccgtcgctatggctacgctcggcgctcgcatggtggccgccgcacccaccgtcactccgccggcctcgctcgacttcgaaacctccgttttcaagaaggagaagattaacctcgctggacacgacgagtacatcgtgaaaggagggagggatttgttccctctgttgcagggtgctttcaaggggattaagcagattggcgtcattggatggggttcgcagggacctgctcaggcacagaatttgcgggactcgcttgctgatgcaaagtctgatattgtggtcaaggttgggctcaggaaaggttctcgctcctttaatgaggctcgcgcagctggttttagtgaggagaatggaactttgggtgacatatgggaaactatctcaggcagtgatcttgtgttgctcttgatttctgatgctgcacaggctgataattatgaaaaaatattttcccacatgaaaccaaatagcatactgggtctgtcccatggttttcttcttgggcatttacagtcaataggacttgattttcccaagcacttcagtgtaattgctgtctgcccgaaaggtatgggtccttctgtcaggaggctgtatgtccaaggcaaagagataaatggtgctggaattaattcgagttttgcagtccaccaggatgtggatggcagagctactgatgttgctttggcatggtctgttgcccttggttcgccttttacatttgcaacttcgttagagatggaatacaggagtgacatctttggggagagaggcattttacttggtgctgttcatggtattgtggaatccttgtttaggaggtacactgaacatggaatgagtgaagatttggcctataacaacactgtcgagtccattacaggaactatatctaaaataatctcgactaagggtatgttggctgtatacaatgctttatctgaagatgaaaagagggaatttgagaaagcatatagtgcttcatattatccatgcatggacattttgtatgagtgctatgaggatattgctgctggaagtgagattcgcagtgttgtcttggctgggcggcgcttttatgagaaagagggtctgcctgcatttcccatgggtaaaattgatcagacccggatgtggaaggttggtgagcgtgtccgttctacaaggccagctggtgatctaggtccattatacccatttactgctggggtctacgtggcattgatgatggcccagattgagatcctgaggaagaaggggcattcttactctgaaattattaacgagagtgtcattgagtctgttgattctttgaatcctttcatgcatgctcgtggtgtttcattcatggttgataactgttcaactacggcaaggttgggttcaaggaaatgggctccccgatttgattacatcctaacccagcaggccttggtggctgtggacaatggagcacctatcaaccaggacctaatcagtaacttcctgtcagaccaagtgcatggagccattgaagtttgtgctcaactgagacctacagtagacatttctgtgccaccagatgcagactttgtccgtcccgagttgcgtcagtctagcaattagaacttgaaccaaattcttgagcctattcctttttggaatgcttagaatagcagctgtcctgttggtttgaattttgttcatatggttgagtgctgtgctgtggaagtctgtattatcactatgtagtactgagattttaataatggggaatgttgcttaatgtgaattagaaatgagttaataagacaagtgaagttcattactaggtttcca

SEQ ID NO: 2076 - DNA, 2349 bp, Prunus persica
gcctcatttttgctctgttaatggcggcggctacttcctccttctctccagccctctctgctctacaattgtcgtcagcatccaaaacccacgaggctccgtccagcctagggttttcttctgtggtgtcgaagactctaaaccctctcatagccaaagctacacgcggtgttaacagtgtctccggcggcggctcggctctcggagctcgtatggtgtcaatgcctactgttaagcccccggtgtctctcgatttcgagacatctgttttcaagaaggagaagatcaatctcgctggtcacgacgagtttattgtgagaggagggcgggatctgttccatttgttgcccgatgctttcaagggtattaaacagattggtgttatcggttggggttctcagggacctgctcaagctcagaatttaagagattctctagctgaagcaaagtctgatattgtggtcaagattgggctcaggaagggttcccgttcttttgctgaagctcgtgcatctggtttctctgaggagaatgggacattgggtgatatatgggaaacagtctcgggcagtgatctcgttttgctactaatttctgattctgcacaggctgataattatgagaaagtattttcacacatgaagcccaatagtatactgggcctttcccatggtttccttttagggcatttgcagtcagtgggtcttgacttccccaagaacatcagtgtaattgctgtatgtccaaaggggatgggtccatctgtaaggcgactttatgtccaaggaaaagagataaatggtgcgggaattaattccagttttgcagtccaccaggatgttgatggtagagccacagatgtggcccttggctggtcggttgcccttggttctcctttcacttttgctactacgctagagcaggaatacaaaagtgacatctttggcgagcgaggcattttacttggtgctgttcatggaattgtggagtccctgtttagaagatacactgaaaatggaacgagtgaagatttggcttataaaaacactgtagaatgcgtaactggaattgtgtcaaggaccatctcgactaagggcatgctggagatatacaactctttgtctgaagatggcaaaaaggaatttgagactgcatatagtgcctcatactatccttgcatggacatcttgtatgaatgctatgaagatgtagccagcggtagtgagatccgtagtgttgtcttggccgggcgtcgcttttatgagaaggatggtctgcctgcattcccaatgggtaaaattgatcagacccgcatgtggaaagtcggggagcgtgtccgagcaacacggccagctggtgacctaggcccattataccctttcactgctggtgtttttgttgccttgatgatggcacagatcgaagtcttgaggaagaagggtcattcatattcagagatcattaatgaaagcgttattgagtctgtggattctttgaatccttttatgcatgctcggggagttgccttcatggttgacaattgttcaacaacagctcggttggggtctaggaaatgggctccaagatttgattacattcttactcagcaggccttggtttctgtggataatggtgcacccatcaaccaagacctcatcagcaacttcatgtcagatccagtacatggagccattaaagtatgcgccgaactgagacctacagttgatatttcggtgcctgctgatgcagactttgtgcgaccagagttgcgtcaatctagcaattagaacttgaagaacctactgcccgtgttggcctacaaaatccgtttggcgaaatattaaggtgtgatgtagttttacccagtttctgtgttttcatcatgtgtacttttatcggattgcaagttgtgtttgacgctggatgttttttttaatgattttgcataataataagtagttaaattattaatggtgtttgcctttctgagtccaagttgatgttatcgcacatggtggttccttttgaaggtctggtaattggattatgatgcagcttcagagaggagggaaaaaaaggccagcaaattagggcatggttcctttgaaggcctagcttattagtcaagtggaagttgactggctaaaaatttgtatttcttattgttgcaagtgcgccattaataccgttgagttagtaggctcatacacaagaagcctgggagttattgactttttacctagattggcccaggtcatgagttgtaatgaaaatgacagaagaatctgcctaaagcacaattggttagattcaattcaatttaatttaaattgaactttaagaagctcg

SEQ ID NO: 2077 - DNA, 2046 bp, Phaseolus coccineus
ggcctataaaatgtcggcaaccgcttcttctacttcactctgcgccacttccagaaccttctccgctaagcccgtcctcgccagaaccttcgtcgcgcttcccaaacgcgcgttctccaagctcgccttccaattcaggccgctctccatggctgcgctcggtgttcgcaatgtggccactccggccgtggtcccgctgccctcgctcgacttcgaaacctccgttttccagaaggagaaggttaacctcgccggacacgacgagtatattgtgaaaggagggagggacttgttccctctgttgccggctgctttcaaggggattaagcagattggtgtcatcgggtggggttcgcagggacctgcacaggcacagaatttgcgggattctctcgctgatgcgaagtctgatattgtggttaaggttggccttaggaaaggttctcgttcctttaatgaggctcgtgtggctggttttagtgaggagaatggaactctgggtgacatatgggaaaccatctcaggcagtgatcttgtgttgctgttgatttctgattctgcacaggcagataattatgaaaaaatattttcctacctgaagccaaatagcatacttgggctgtcacatggttttcttcttgggcatttacaatcaataggacttgattttccgaaacacttcagtgtaattgctgtgtgcccgaaaggtatgggtccttctgtaaggagactgtatgtccaaggcaaagagattaatggggctggaattaattcaagttttgcagtccaccaggatgtggatggcagagctactgatgttgctctggcatggtccgttgcccttggttccccttttacatttgccactacattagagatggaatacaggagtgacatctttggagagagaggcattttacttggtgctgttcatggtgttgtggaatccttgtttaggaggtacactgagcatggaatgaatgaagatttggcatacaacaacactgttgagtgcattacaggaactatatctagaatcatctcgactaagggcatgatagctgtatacaatgctttatctgaagatggaaaaagggaatttgagaaagcatatagtgcttcatattatccctgcatggacattttgtatgagtgctatgaggatattgctgctgggagtgagattcgcagtgttgtcttggctggacgtcgcttttatgagaaagagggtctgcctgcgtttcccatgggtaaaattgatcaaacacggatgtggaaggttggtgagcgtgttcgatctacaaggccagcaggtgatctaggcccattatatccattcactgccggtgtctatgtggcattgatgatggcgcagattgagatcctgaggaagaagggacattcttactctgaaatcattaacgagagtgtcattgagtctgttgattctttgaatcctttcatgcatgctcgcggtgtttctttcatggttgacaactgttcaaccacagcaaggttgggttcaaggaaatgggctccgcgatttgattacatcctaacccagcaggccttggtggctgtggacaatggagcacctatcaaccaagacctaatcagcaacttcctgtcagaccaagtgcatggagccattgaagtttgtgcccaattgagacctacagtggacatttcagtgccaccagatgcagactttgtccgccctgagttgcgtcagtctaccaattagaacacgaaccaatttcttgagcttattcctttctacggagtgcttaaattgtaatgttgatttgagttttgttcttatggttgagtgctgctatggaagtatgtattatcactatgtaattctgtactgagactttaataattaggaatgttgcttcatgccaaatagacgagtgaattcgttaccaggttttcatcaagtgttacagtactcagtaacttgatctttccatgcctcgtaagtaatgtgtcatctaaatcattaggattaactgcaataaacagccctcaaccgtggaaaaa

SEQ ID NO: 2078 - DNA, 2038 bp, Platanus occidentalis
acgcggggaatggcggccgcaccttccttctccccctcggtggcttctcctacttcctcatctaaaaccctaaaaccagtcgccaaaaccctaggttccaccctagggtttctctcgtcgtcttcaaaatctttcaaacctctcctcgctcgtgtatcgacgagcaataccccttcatcgactggaggatccgctctcggagctcggatggtgtcaatgcctgcgatgaagccaatgacgacgctcgatttcgaaacttctgtgtttaagaaggagaaggtcactcttgctggtcatgacgagtttattgttagaggtgggagagatttgttccattttctgccagatgcgttcaaggggattaagcagattggcgtcatcgggtggggatctcagggtcctgcccaagctcagaacttgagagattctcttgcagtagcaaagtctgacattgtagtgaagattggactgaggaagggatctcgttctttttctgaagctcgtgctgctggatttactgaagaaaatggtactctcggtgacatatgggaaactgtttcgggcagtgatcttgtgctgctattgatttctgatgctgcacaggcagacaattatgagaaagtattctcccacatgaagccaaacagcatactggggctgtcccatgggtttcttcttggacatttacagtcactagggcttgatttccccaagaacatcggtgtcattgcagtatgccccaaagggatgggcccatctgtgaggagactatatgtgcaaggcaaagagataaatggtgcaggaatcaattccagttttggtgtccatcaggatgttgatggtagagctacagatgttgctttagggtggtcagttgccctgggttctccttttacatttgccactaccttagagcaagagtacaagagtgacatttttggggaacggggcattttacttggtgctgttcatggaatcgtggagtccttgtttagaaggtacactgagaatggaatgagtgaagatctcgcttacaagaacactgttgagtgcatcacgggaattatatcaaagaccatctcgacaaagggtatgctggctgtgtacaacgccttgtcagagggtggtaagaaggaatttgaagctgcatatagtgcttcattttatccttgtatggacatcctgtatgagtgttatgaggatgtggccagcgggagtgagatccgaagtgttgtcttggctgggcgtcgcttttatgaaaaggatggtctaccagcgttcccaatgggtaaaattgatcagacacgtatgtggaaagttggagagagagtacgatcaacccgaccagaaggtgacttgggtcccttgcatcctttcacagctggggtctatgtggcattaatgatggctcagattgagatactgaggaagaagggacactcatactcggagatcatcaacgaaagtgtgatcgagtctgtggattctttgaaccccttcatgcatgcacgtggcgtctcattcatggttgataactgctccactacggcaagactgggttctaggaagtgggcaccacgcttcgattacattctcacccaacaggctctagttgctgtagacaatggtactcccgtcaatcaggacctcattagcaactttgtttcggacccagtacatggagccattgaagtctgtgcccagctgagaccaactgttgacatctcagtgcccccagatgcagattttgttcgcccagagctgcgtcagtccagcaactagactcaagatcgtggtatccagtagcattccttttattggggatgcttcagagaagttttccttaaactagggatctagagtgtatctggtttacctctttgaagggttctgtttgttgtcatcttcggtgttgagaatttcgaacaaacgtcgtgatctgatgatattcctacggttagtttttcttgttgaatggtttcttatgtagtaagtctgaatgttggtatgcatgtaaccagtaattatgagtcacaac

SEQ ID NO: 2079 - DNA, 2036 bp, Triphysaria pusilla
gtttttctctcacattgttacatttgcctttacacactcgaaaagctacagtagcaatggcggcggctgcgccaacctccttctccacctccactcccacctcctccaaagccttgacaccatcttctagagctccaacgatctccttgggcttcctatcatccgcatccccttcccttaagccgctcagggctgccgccgattctcgagccgcttctcctgcatccggctctgctctggctgctcgtatggtgtcggcccccactatgaagccccctgcagccctggatttcgacacgtctgtgttcagtaaagagaaaatcaacctcgctggtcacgatgagtacattgtaagaggaggcagaaacttgtttaagttactgccagatgcattcaagggtataaagcaggttggagtgattggttggggctcacagggtcctgcacaagcccagaatttaagagattctcttgctgaggcaaaatctgatatagtggtcaagattggtttgaggaagggttctagttcatttgctgaggctcgtgctgctggttttacagaagaaaatgggaccctaggagacatatatgaaactgtttccagcagtgatttggtgctgctcttgatatcagactctgctcaggctgataattatgaaaagttgttctccagcatgaaaccaaacagtatactaggactttcgcatgggttcctgttgggtcatttgcagtcaataggtctcgactttcccaagaacatcagtgtgatagctgtatgtcccaagggaatgggaccctcagttagaaggttatacgtgcaagggaaagaaatcaatggtgctggcattaattctagttttgctgtccaccaggatgttgatggcagagctacggatgttgcccttggatggtcagttgcccttggttcgcctttcacttttgccactactctggagtcggagtacaagagtgatatttttggggagcgaggaattttacttggtgctgtgcatggtgttgtggagtccttattcagaaggtacactgaaaacggaatgagtgaggatcttgcttacaagaatacagtggagagcattactggaataatatccaagaccatatcaacaaagggtatgcttgctgtctacaatgcgttaagtgaagacgacaaaaaagattttgaggcagcatatagtgcttcgttttatccatgcatggatatcctatacgagtgctatgaagatgtagccagtggcagtgagataaggagtgttgtattggctggccgtcgcttttatgaaaaggaaggcttgcctgctttcccaatgggcaaaattgatcagacgcggatgtggaaggtcggtgagcgagttagagcaacacgtccagctggtgacttgggacctctgtaccctttcactgcaggcgtctttgtggcgttaatgatggcccagattgagattttgcgaaagaaaggccactcatactctgagattataaacgagagtgtgatcgagtctgtggattcattgaaccctttcatgcatgcccgtggtgtgtcattcatggttgacaactgttcgacaacagcacgtttaggatctaggaagtgggcccccagatttgattacattctcacccagcaggcactggttgcagttgacaatgctgcaccgatcaatcaggacctaatcagcaatttcctctcggatcctgtgcacggtgctatcaaagtttgtgccgagttgaggcctactgttgatatctcagtgccagcagatgcagattttgtccgtccggaattgcgccaatctggtaattgaggacagaggtgttaagctcttgattagttcgggccgggcttagatgttttgttcttgtgagggttgttacttgtagtactctttatgtattttgttttgctcatttgccgacaatgagtgtaatgatatccatgtggacttttacgagtgtgttaaactagctcttgttattgtagcgtggatgatttgtgcaatagccggttattggctgaa

SEQ ID NO: 2080 - DNA, 2039 bp, Catharanthus roseus
tccctgaaaccctctcttttctcctcacactttccttccccatccctcacaaatcgcagactccactcgctaatggcggcggcagcagctacttccatctccgtttccaccgctccggcggcaacaaaaaccctaaaacacccgaccaaaacctcggtccacaatctcagtttcctttcttcatccacgccttcgctcaagcatctcgcagctcgcgccgcctcatttacaacatcatgtggctccgccgttgccgctcgaatggtctccacgcctgcagctgtgaagccgccaactaatcttgattttgagacctcagtcttcaagaaggagaaaatcaatcttgcgggccacgaggagtatattgtgagaggaggaagggatttgttcaatcttttgccggatgcattcaagggaatcaagcagattggtgtcatcggctggggttctcagggacctgctcaagctcagaatctcagagattcacttgctgagacaaaatctgatattcttgtcaagattggattgaggaaaggctctcgttcatttgctgaggcgcgtgcagctgggtttagcgaggagaatggaacccttggggatatatatgagactatatctggtagtgatttggtgctgctcttaatctctgacgccgcacaggctgataattatgagcaagtgttttcacacatgaagccaaatagtatccttgggctttcgcatggcttccttcttggccatttgcagtcaatgggtcttgacttccccaagaatattagtgtaatagccgtatgtcccaaggggatgggtccatcagtgagaaggttatatgtgcaggggaaggaaatcaatggtgctggtatcaattctagttttgctgttcatcaggatgttgacgggagggctacagatgttgctctcgggtggtcagttgctcttggttctccttttacctttgccactactctggaacaggaatacaagagtgacatcttcggggagcgaggcattttactgggtgctgtgcatggaattgtggagtcactgttcaggaggtacaccgagaatggaatggcagaagaacttgcatacaaaaataccgtagagtgtataacaggcattatttcaaaaaccatatcaacgaagggcatgttggctgtttacaatgcattaactgaagaagaaaagaaggaatttgagactgcttatagtgcttcattttatccctgtatggatatcttatatgaatgctatgaagatgtggctactggaagtgagattcggagtgttgtcttagctggacgtcgcttttatgaaaaagagggtctccctgccttcccaatgggcaagattgaccaaacaagaatgtggaaagtaggtgagcgagtccgatcagtacgaccaactggtgatttgggccctttatgcccattcacagctggtgtctatgtggctttgatgatggcacagattgagatcttgaggaagaaagggcactcctattctgagatcataaatgagagtgtgattgagtctgtggattctctaaatccattcatgcatgctcgtggggttgcattcatggttgacaattgttcaacaaccgcacggttaggatcaaggaaatgggctccccggtttgattacatcctcacacagcaggctatggtggctgtggacaataaaactcccatcaacagggatctcatcagcaacttcctatcagatcctgtgcacggagctattgaagtttgtgcccagttgagacctactgttgacatttcagtgcctgcagatgccgatttcgtgcgcccagagcttcgtcagtctagctaaagcatgtctcaactcttgacgtcgattttaccagttgaggaaccgaattagatttagttatatatgtctagacttgaggttgtaggctttttgggtgttttccagcgcgtgcttcattacaagaatggttctgtatgttgtgagtttgaactttgatggtggttctgccagtaatttatggataataaacttgtgggtttttc

SEQ ID NO: 2081 - DNA, 2157 bp, Eucalyptus grandis
gtccccttctctctctgcattccccgcaaacaacccgcttcctttcctaagctctccagctctcgacaatggcggcggcgacctccttctccccgtccctctccgccgcggcctcctcgaaatccctcaaggccctcgccaacccctccccggccggcctcagcctcagcctcgggttcctctcctcgtcctccggctcctcccgggccctcagggccgccgccgccgccgccgccgggaatggcgctggcggctcggccctgggcgctcgcatggtgtccgtgccggccgtcaagccgctcgccccgctggatttcgagacctcggtgttcaagaaggagaaggtcacgctcgccggtcacgacgagtacattgtgagaggaggaagggacttgttcccgctgctgcccgatgcgttcaagggaattaagcagattggtgttattggttggggttctcagggtcctgctcaagcccaaaatctgagagattctctggctgaagcgaagtctaatatcgtggttaagattggactcagaaaaggttcccgatcttttgctgaagctcgtgctgcaggattttctgaggagaatgggacactgggtgatatatgggaaaccatttcaggaagtgatcttgtgttgctactgatttctgatgctgcacaggcggataactatgagaaagtgttttctcacatgaagccaaacagcatcctcggtctgtcccacgggttccttttggggcatttgcaatctatgggacttgacttccccaaaaacatcagcgtgattgctgtgtgccccaaggggatgggtccctctgtaaggagactctatgtccaaggcaaagagataaatggtgctggaatcaattccagttttggagtccaccaggatgttgatggaagagccactgacattgcccttggttggtcagttgcacttggttctccatttacatttgctacaactttggagcaggagtacaaaagtgatatctttggggagcgtggcattttacttggtgccgttcatggagttgtggaatccctgttcagaaggtacactgaaaatggaatgagtgaagatctggcatacaacaataccgttgagtgcataacaggcatcatatcgaagaccatttccacaaagggcatgttggctgtttacaattcactgtctgatgaaggaaaaaaagaatttgagaaggcatacagtgcatcgtactatccttgcatggacatcttgtatgagtgctatgaagatgttgccagtggtagtgagattcgcagcgttgttcttgctggacggcgcttttatgaaaaggatggtctacctgctttcccgatgggcaagatagatcagacccgcatgtggaaagtgggtgagcgtgtgcgagcagcaagaccagctggtgaccttggcccattatatcctttcacagctggtgtctttgttgccttgatgatggcccagattgaaatcttgaggaagaaaggacactcctactctgagatcatcaatgagagtgttatagaatcagttgattctttgaaccccttcatgcatgcccgtggagtctcttttatggtcgacaattgttcgaccacagctcgtcttgggtcaaggaagtgggctccccgatttgattacatcctgactcaacaagctttagttgctgtggacaatggtgccccagttaaccatgacctcatcagcaacttcttctcagatccggtgcatggagcaattggagtttgcgcacagttgagacctacagttgatatctctgtgcctgcaaatgcagactttgtccgacctgagttgaggcagtctgctaattgaagctttgagaataagctaaagcgcaactttgcatgtggtactgtatttgagggagttgtatcgtgcatctaagtaggttatgtgatgtgggttattccattgtatttccctgtctgaatcgcgacaagtttgtgcctgttgagctaatgacagatcatgaaccattttgccctattgattttgagtaataacttcttcacgtgttagatgtgtcaatcgtcataatctttttgctcaaagatgaccgacatttgtttccatactgcttatttacattgatgtgatctcaacaagcagaagtctctttata

SEQ ID NO: 2082 - DNA, 1968 bp, Amsonia hubrichtii
acctcttccttgagcagattccattcggtaatggcggcgcccgcagctacttccttctcagtctccaccactcggggacccaaaaccctaaaacacgagaccaaaacctcagtacacaatctgagtttcctttcttcctcaacgccttctctcaagcctctggaagctcgcgcagcctctgtagccgtatctgcatcatccaatggctccgccgttgctgctcgtatggtctctactcctgccgctgtaaagcctcaaacttctcttgattttgatacctctgtcttcaagaaggagaaggtcaaccttgctggccacgaggagtatattgtgcgaggaggaagggatttgttcaagctgttgccggacgctttcaagggaatcaagcagattggtgtcattgggtggggttcgcagggacctgctcaagctcagaatctacgagattcacttgccgaggcaaaatctgatattgtggtcaagattggtttgagaaaaggttctcgttcatttgctgaggcccgtttagctgggtttagtgaggagaagggaacccttggagacatatatgagactatatctggtagtgatctagtgctactcttaatttccgatgcagcacaggctgataattatgagaaagtgttttcccacatgaagccaaatagtatccttgggctttcgcatggcttccttcttggccatttgcagtcaatgggtcttgatttccccaagaatattagtgtaatagctgtatgtcccaaggggatgggtccgtcagtgagaaggttatatgtgcaagggaaagaagtcaacggcgctggtatcaattccagttttgctgttcatcaggatgttgatgggcaggctactgatgttgctcttgggtggtcagttgcccttggttctccttttacctttgccactactctggaacaggagtacaagagtgacatcttcggggagcgaggcattttactgggtgctgtacatggcattgtggagtcactgttcagaaggtacactgagaatgggatggccgaagatcttgcatacaagaacactgtggagtgtataacaggaattatttcgaaaaccatatcaacaaagggcatgttggctgtttacaattcattaactgaagaagaaaagaaggaatttgagactgcctatagtgcttcattttatccctgtatggatatcttatatgaatgctatgaagatgtggctactgggagtgagattcggagtgttgtcttagctggacgtcgcttttatgaaaaggagggtctccctgctttcccaatgggcaaaatcgaccaaacaaggatgtggaaagtaggtgagcgagtgcgagcagtacgaccagctggtgatttaggtcctttataccctttcacagctggtgtttatgtggcattgatgatggcacagattgagatcttgaggaagaaagggcactcttattccgagatcataaatgagagtgtgatcgagtccgtggattctctaaatcctttcatgcatgctcgtggggttgcattcatggtggataattgttcaacaactgcacggttaggatcaaggaagtgggctccccgatttgattacattctcacacagcaggctcttgtggctgtggacaacaaaactcccgttaacagggatcttatcagcaacttcttatctgatccagtgcatggagctattgaagtgtgtgcccagttgagacctactgttgacatttcagtgcctgcagatgctgattttgtgcgcccggagcttcgccagtccaactaaagctatctcaagtcttgatgtcaattacctagagctatgccagttggggactgaatagatttagttttaaatacgcacttgaggtgtggggttttctggatatcccagagcatactgctctctagcgtgcctcagtcctagtatgcgagaattgttctgtatgttgtg

SEQ ID NO: 2083 - DNA, 1883 bp, Flaveria ramosissima
ccaccatgacgacggcgacggcgacgcgaccttctcaccttaacacccacaacctcatcgtcaacagctgcaccatctctaaaagttgctcccaaaaccctagggtttaacgtcggattactcgcctccaaaacaacattcaaatcactcaaagctcgatccaatggcggatccggatccgctctcggagcccgtatggtctcagctccatcaataacccgacccacgcttcttgatttcgaaacctctgtgttcaaaaaggagaagatcaaccttgctggtcatgatgagtatattgtgagaggaggaagagatttgttccatttgttgcctgatgcctttaaaggtatcaagcagattggtgttattggttggggctctcagggtcctgctcaagctcaaaaccttagggattctcttgcagaagcaaaatctgacattgtagtgaagattggtttacgaaagggttcgagttcgtttaaagaggctcgtgctgctggttttactgaagaaactggaactcttggagatatttatgagaccatcctcgggaagtgacttggtcctgctcttaatttcagattcagctcaggctgataactatgagaaaatcttttcacacatgaagccaaacagcatacttggactgtcccatgggtttcttcttggtcatctacaatcagctggtcttgatttccccaagaacataagtgtggttgctgtgtgccccaaaggaatgggtccatctgtcaggaggctgtatgttcaaggaaaagagtaaatggagctgggatcaatgcaagttttgctgtccatcaggatgttgatggaagagccactgatgttgcccttggatggtcagttgctcttggttcaccttttacatttgccactacactcgagcaggaatacaggagcgatatatttggcgagcgaggtattttacttggtgcggtgcatggtattgtggagtcattgtttagaaggtataccgaaggtggtatgagtgaagaattggcttacaaaaataccgtagagtgcataactggcataatatcaaagaccatatcaactcagggtatgaaggctgtatacgagtcattgtcagaagaaagcaaaaaagagttcttgacagcatacagtgcctcttactatccttgtatggacattttgtatgagtgctatgaggatgtagcaagcggtagtgaaattagaagcgttgttttggctggtcgtcgattttatgaaaaggagggtttgccagcttttcctatgggtaagattgatcagactcggatgtggaaagtaggcgaacaggttcgggctgtccgacccgctggagatttaggtccgttgtatcctttcacagctggtgtatatgttgcgctaatgatggcccagattgaggtgttgaggaagaaaggacattcttattctgagatcatcaatgaaagtttgatcgagtctgtggattccctaaacccgttcatgcatgctcgaggcgtctcctttatggttgacaactgttcaactactgcacggttgggatcaaggaaatgggcgccacgctttgattacattcttacccaacaggctttagttgctgtagacaatggagccccactaaaccaagacctcatcagcaacttctttgaagacccggtgcatgaagctgtcaaagtttgtgcagagttgagacccactgttgacatctcggtgcctgctgatgctgattttgtcagacccgagttgcgtcaatctagcaactagagatagtggtaagttcataccccggtatgatctttaccttagttttcaaacaatgcaggaattatgtctgtttggtagggtgttatggataatgtctcttatggatgttgtga

SEQ ID NO: 2084 - DNA, 1948 bp, Cichorium intybus
cctcttaaaccgggagtcgataatggcggcggcgacaacctctttctcaaccttagcacctacagcttcgtcgtcggcagcctcggcttctctcaaggtcgcccccaaaaccctagggtttaatgtcgggttcccgtcttccaaaatttcctcaaaatctctcaaagctcgttccaatggcagttctggatctgctctgggggctcgtatggtttccgcgccagcaataaccaaacctccaacgttgcttgatttcgaaacctctgttttcaaaaaggagaagattaaccttgctggttatgacgagtatatcgtgagaggaggaagagatttgttccatttgttgcctgatgcctttaaaggtatcaagcagattggcgttatcggatggggttcccagggtcctgctcaagctcagaatctcagagattctcttgtagaagcaaaatctgatatcgtagtaaagatcggcttacgaaagggttcaagctcattcaacgaagcacgttctgctggtttctctgaagaaaatggaactctcggagacatttatgaaaccatctccggcagtgacctggttctcctcttgatctccgactcagctcaagctgacaactatgagaaaatcttctctcacatgaaaccaaacagcatccttggactctcccatggattccttcttggtcacctccaatcagccggccttgatttccccaaaaacataagcgtggttgctgtttgccccaaaggcatgggtccatcagtaagaaggttatacgttcaaggaaaggaaattaacggagctggaatcaatgcaagttttgctgtccatcaagacgttgatggaagagccactgacgtggcacttgcatggtcagttgcccttggttctccttttacattcgccactacacttgaacaggagtacaaaagtgacatttttggggaaagaggtattttacttggtgcggttcatggtattgtggagtctctgtttagaaggtatacagaaggcggtatgagtgaagatttggcttacaaaaatactgtcgaatgcataactgggaacatatcgaaaacaatctcaactcagggaatgaaagcagtatacgagtcattaacagaagaaggcaagaaggagtttttaaaagcatacagtgcctcatactacccttgcatggacattttatacgagtgctatgaagatgtagcaagtggcagtgagatccgaagtgttgtgctcgctggtcgtcgattttacgaaaaggagggtttacccgcattccccatgggcaaaattgaccaaacccgcatgtggaaagtcggtgagcgtgtccgcgcgacccgacccgcgggcgatcttggcccgttgtatcccttcacagccggtgtctatgttgctttaatgatggctcagattgaggtgttgaggaagaaggggcattcgtattctgaaattatcaatgagagtttgattgaatccgtggattcattgaacccgtttatgcatgcgagaggtgtgtcgtttatggtggacaactgctcaacaaccgcaagattgggatcaaggaagtgggccccacggttcgactatattctgactcagcaggctttggtggcggttgacaacgggagcccgcttaaccaggatttgattagcaacttctttgaggacccggttcatgaagcggttaaggtttgtgctgaattgagaccaaccattgacatctcggtgcctgttgatgctgattttgttagacccgagttgcgccaagctagcaactagtgggacccaagtacggttggtattaaggtatgagtatgggtatggttctagttttatgtgttttgtagaatgttttgtgttgtggtttggttttggatggacgctgtgatggattttgttgcattttgtaataatggaagtggtcctgtcttggggaaaaaa

SEQ ID NO: 2085 - DNA, 2467 bp, Populus trichocarpa
acgaaccagcatttaaaagcaaagtcattttagaactctgctcctcttctccacatttcccttctccaactctctcactgaaaacaaatggcggcggctacatccttctccaataccctcaccactccagccccttcaaaaaccctaaagcctgcatcttcaagatcgctgctatgtaacagcaatttagggttttcatcatcactctcttctaagaccttcaaacctctcaaagccagcagtggtaacatctctgctggagttttgggtgctaagatggtctcttcggttcccagtgtgaaacccatgatctctcttgattttgagacctctgtgtttaagaaggagaaggtctctcttgctggtcacgatgagtacattgtgagaggagggagggatttgttccacctgctgcctgatgcatttaaggggattaagcagattggcgttatcggatggggttcccagggtcctgctcaagctcagaatctaagggattctcttgctgaagcaaagtctgatattaaagtcaagattggactgaggaagggctctcgttcctttgctgaagctcgtggtgctggttttacagaagaaaatgggactctaggtgatatatgggaaaccgtttctggcagcgatctagtattgctactgatttctgatgctgcacaggcagataactatgagaaaatcttctctcacatgaagccaaacagcattcttgggctttcccatggatttcttcttgggcatttgcagtcaacgggacttgattttccaaagaacatcagtgtcattgctgtgtgccccaagggaatgggtccttctgtgaggagactctatgttcaaggcaaagaggtcaatggtgctggaattaattccagtttcgcagtccaccaggatgttgatggtagagccactgatgttgccttgggatggtctgttgcccttggttcacctttcacatttgccactacactagagcaggaatacaagagtgatatctttggggagaggggcattttgcttggtgctgttcatggaattgtggagtccttgtttagacggtacactgaaaatggaatgagtgaagatgaggcctacaagaatactgttgagtgcattactggaaccatatcaaggaccatatcaaccaagggcatgctggctgtttacaattccttgtctgcagaaggcaaaaaggaattcgagactgcttacagtgcctcgttttatccctgcatggacatcttgtatgagtgctatgaagatgtagcctctggaagtgagattcgcagtgttgtcctggctggacgtcgcttttatgaaaaggaaggtctaccagcttttccaatgggtaaaattgatcagacacgcatgtggaaggttggtgagcgagtccgggctgcccggccagctggggacttaggtccattgcatccattcactgctggtgtctatgtggcactaatgatggctcagattgaaatattgaggaagaaaggccattcttactctgagatcattaatgaaagtctgattgaatctgtggattccttgaatccatttatgcatgcccgtggagtttcttttatggttgataactgctcaaccacagcaagattgggatcaaggaaatgggctcctcgttttgactacatcctcacccagcaggccttggtagcggtagacaacagtactcccatcaaccgtgacctcatcagcaacttcttttcagatccagtgcatggagccgttgaagtctgtgcccaattaagacccacagttgacatttccgtgccagcagatgctgactttgtgcgacctgagctccgccaatctagcaactgagattcaaaaggagaacctttagcttgaaataacaaggagaatttttccatatttggtctgatggagaagctcccatgagttactagcagagtgtagttttattatgaactcctagtgtgagcttgagtattgtctgtctgtctgtcttgttctgcattaaaacgagtatgtatttttgtcatgtcagcatctaaagagtatgcacttgtatgagcgacttagttgcctttctactctgcagaagtgaaatctagttctgttgtgatatatggaaagtacctagcatcagagtatccacatagtacaactggaatgcgggagaaaagggaggtcgaacatgcatgctatgacagtaggagagatgcactcttcttactgattttgtctccactcgctgcttaggcactaaaacgtgggatgataattacaatcacctctaaacatgcaatcgaagcagacgtgtaatctggttggtttcaaatctccgttgcagtgttgagaatacaaccagacgtccgatgttcaagagtgagattatgggtgggaaagagggtgcactgcctagtacctggtaggtaaatttggaaaataaaagctttagctcgatactatt

SEQ ID NO: 2086 - DNA, 2090 bp, Citrullus lanatus
atcctccatttctttgctcactcatccatggccgccgccacgtatttctctccctccatctcagcctcatcaaccaaaaccctgaaacaagctgttgctttgcagcctcttgctccttccaccttaggttttttgtcctcctcttcctcaggatccaatgctctcaaggctgttggtattggtgcagctaacgccgtcggctcagctttaggtgctcgaatggtgtctgttcctgcgatcaaatccttaccctctctcgattttgacacatctgtcttcaagaaggagaaagttaatcttgctggtcatgatgagtatattgttagaggaggcagagatctttttcccttgctgccggaagccttcaaggggatcaagaaaatcggtgtcattggctggggttcccaggcacctgcacaggctcagaatttaagggactcgcttgctgaagccaagtctgacattgtggttaagattggcctgaggaagggttcccgctcttttgcggaagctcgtgcagttggtttttctgaagagaatggaactttgggtgatatatatgaaactatatccgaaagtgatcttgtcatgcttctgatttctgattctgcacaggctgataactatgagaagatattttctcacatgaagccaaacagcattcttgggctttcccatgggtttcttcttggccatttgcagtcatcggggcttgatttccctaagaatatcagtgttattgctgtttgtccaaaggggatgggtccatctgtgaggagactatatgttcaaggaaaagagatcaatggtgctggaattaattctagttttgcagttcaccaggatgttgatggcagagccacagatgttgcattgggttggtctgttgcccttggctctcccttcacatttgctacaactctagagcaagaatacaggagtgacatctttggcgagcgaggtattctacttggtgctgttcatggaattgtggagtccttgttcagaaggtacactgaaaatggaatggctgaagacctggcttacaagaacactgttgaaagcataacaggaattatatcaaagaccatttccactaagggaatgttggcagtgtacaattccttctctcctgatgagaaaaaggaatttgagagagcatatagtgcatcatattacccctgtatggatattctctatgaatgttatgaagatgttgccagtggaagtgagatccgcagtgttgtgcttgctggccgacgattttatgaaaaggagggtctcccagctttcccaatggggaacattgaccagacccggatgtggaaagtcggtgaacgtgtccgacaatcacgtcctgcaggtgaccttggcccgttgtatcctttcaccgctggtgtatatgtggcattgatgatggcacagatcgagattctgaggaaaaagggccactcctactctgagatcatcaacgaaagtgtgatcgaatcagtcgactctttgaacccgttcatgcatgctcgtggtgtgtctttcatggttgacaactgttccacaaccgcacgattgggatctaggaagtgggctccgcgctttgactacattctcacccaacaagccctggttgccattgacaatggttcagccattaaccaagaccttatcagcaacttcctatctgacccagttcatggagcaattgaagtatgcgcacagttgagacctactgttgacatttctgttccagctgatgctgattttgttcgcccagaactacgtcaatcgagcaactgaaatgtgccaccgaccagaagcccatgaaccagctcgatgaaggactgctgtatgtatctacaaaatatgtactgttatcctaattttcttcaaggtctagttttttaaagtttatgatgagagttagttgaacgagtgggtagtaataaatcgaatgttccagagttttcgtggtcattttgtctaagtaagttatgtagacttgagagatcatgttagaattatcatctctacttttatggcatctaatattagtttcatcctaaattccactctagtgacgacttcctccatat

SEQ ID NO: 2087 - DNA, 2054 bp, Triphysaria pusilla
actcactctctgcgctctgtttctctcgcacattcatagacaccctttccacactcgaatagccacagcgaaatggcggcggctgcgccaacctccttctccacctccacacccaccaccacctccaaatccttgaaaccttcttctagaactccggcaatctcatttggtttcctatcatcctcatccccttcccttaagccgctcagggctgccgccgattcccgagccgcgtctcctgcatccggctccgctctggctgctcgtatggtgtcggccaccagtatcaagtcccccacagctctggatttcgacacatctgtgttcactaaagagaaaatcaacctcgctggtcacgaagagtacattgtaagaggaggcagaaatttgttcaagttcttgccagatgcattcaagggtataaagcagattggagtgatcggctggggctcacagggtcctgcacaagctcagaatttaagggactctcttgtagaggcgaaatctgatattgtggtcaagattggtctgaggaagggttctagttcatttgctgaggcccgtgcagctggttttacagaagaaaatgggaccctaggagacatttatgaaactgtttccagcagtgatttggtgctgctcttgatttcagactctgctcaggctgataattacgaaaagctgttctccagcatgaaaccaaacagcattctaggactttcccatgggttcctgttgggtcatttgcagtcaataggtcttgactttcccaagaacatcagtgtgatagctgtatgtcccaaggggatgggaccctcagttagaaggctatacgtgcaagggaaagaaatcaatggtgctggcattaatgctagttttgctgtccaccaggatgttgatggcagagctacggatgttgccctcggatggtcagttgcccttggttcgcctttcacttttgccactactctagagtcggagtacaagagtgatatttttggggagcgaggcattttgcttggtgctgtacatggtgttgtggagtccttattcagaaggtacactgaaaatggaatgcgcgaggatcttgcttacaaaaatactgtggagagcattactggaataatatctaagaccatatcaacaaagggtatgcttgctgtctacaattcgttaagtgaagatgacaaaaaagattttgaggcagcatatagtgcttcattttatccatgcatggatattctatacgagtgctatgaagatgtagccagtgggagtgagataaggagtgttgtcttggctggccgtcgcttttatgaaaaggaagggttgcctgctttcccaatgggcaaaattgatcaaacacggatgtggaaggtcggtgagaaagttcgagcaacacgtccagctggtgacttgggacctctgtaccctttcactgcaggtgtctttgtggcgttgatgatggcccagattgagattttgcggaagaaaggccattcatactctgagatcataaacgagagtgtgatagagtctgtggattcattgaatcctttcatgcatgcccgtggtgtttcattcatggttgataactgttcgactacagcacggttgggatctaggaagtgggccccgagatttgattacattctcacccagcaggcactggttgcagtcgacaatggcacaccgatcaatcaggacctcatcagcaacttcctatcggatcctgtgcacggtgcgatcgaagtgtgtgcccagttgagacctactgttgatatctcagtgcctgctgatgcagattttgtccggccagagttgcgtcaatctaattgaggcttgatcagtttgtgccgagctttagatgttttgttccagtgagttgaatttagggggtccttgaagatctgttttacttgtagtactctgttatgtattttgtttgctcctttgccgactatgagtgtaatgttatatccttgtggacttaaccagcggttaaacggtaaaccagctattgttattagctgaaataaagtgctagtcttgtc

SEQ ID NO: 2088 - DNA, 1933 bp, Brassica juncea
ggagtaggtaaagctgagtgtgctttattaacctcctcctctcagtttctgtgtgtgtgaccctaatttgctccctcccgcagacattttgctattacactgagcgactcaaatggcggctgccacttcatccatcgctccttccctctcttgcccatcccccaaaacccttaggtcttcgaaagccacaacctttgcctttcccaacatcggtttcctctcgtctacttccaagtctctgaggtccctcaccgccaccgtcgccggaaatggtaccggatcttccctctccgcacgaatggttgcgtcttccgcggtcagagcccctatgtctctcgatttcgagacgtctgtcttcaaaaaggagaaagtgtctcttgctggtcacgaagagtacattgtgagaggaggaagggacttgttcaagcatcttcctgatgctttcaaggggattaagcagattggtgtcattggctggggatctcagggacctgctcaagctcagaatttaagggattcacttgtggaagcaaaatctgacattgttgttaagattgggcttagaaagggctctcgctcatttgaggaagcacgtgctgttggcttcaccgaagaaagtggtacgttgggtgatatttgggaaactatctctggcagcgatcttgtgttgcttttgatctctgatgctgctcaggctgataactatgagaaaatattctcccacatgaagcctaacagcattctcggtttgtcacacgggtttctactgggtcatttgcagtccatgggactcgatttccctaagaacatcagcgtggtagctgtttgccctaagggaatgggtccatccgtgaggaggctttacgtccaaggaaaagaaatcaacggtgctggaatcaacgccagttttgctgtccaccaggatgttgacggtagagctgctgatgttgctttgggatggtcagtagcacttggttctccctttacttttgctactactcttgagcaagagtacaagagtgacatctttggagaaagaggtatcctgcttggtgctgttcacggaatcgtggagtctctgttcagaaggtacaccgaaaatggaatgagtgaagacttggcttacaagaacacagtcgagtgcatcacaggaaatatctcgagaactatctctactcagggaatgttggctgtgtacaactccttgtctgaagaagggaaaaaggatttcgagactgcatacagtgcatccttctacccttgtatggagattctctatgaatgttacgaggatgtagcagccggcagcgagatcaggagtgttgtcttagccggtcgtcgcttctacgataaggagggcttacctgcattcccaatgggaaagatcgatcagacaagaatgtggaaggtcggtgaacgcgtcaggaagtccagaccagctggtgacttgggtcccttgtatcccttcaccgctggagtttacgtcgcccttatgatggctcagatcgagatcttgaggaagaagggtcactcctactcggagatcatcaacgagagtgtgattgagtctgttgattctctgaacccgtttatgcacgctagaggagtgtccttcatggtggacaactgctcgaccacggcaagattgggatccaggaaatgggcaccacggtttgactacaacctgacccaacaagctctggtggctgtggacaatggtgcaccaatcaacaaagacttgatcagcaacttctttgctgatccagtccatggtgctatccaggtatgtgcggagctcaggcccaccgtggatatctcagtgcctcaagatgcagattttgttcgaccagagctgcgtcagtccaactagagtgttatcagtgtttgaaatgttatcagtctctttcctatgtaatcgtgttttgaagaaaga

SEQ ID NO: 2089 - DNA, 2017 bp, Platanus occidentalis
tctccccctcggtggcttcttcaccctcatgcaaaacccttaaaccagaggctaaaacccttggtttcagagtagggtttatctcttcttcgtctaaaaccctgaaaccgctcctcgctcttgtctcgacgagcaatgcctgctccacggccggaggaggatcggcccttggagctcgcatggtatccatgcctgcgatcaaacccattacgacgcttgattttgacacctctgtgtttaagaaggagaaggtctcgcttgcgggtcatgaggagtatattgttagaggtgggcgggatttgttccatttgctgccagatgcgttcaaggggattaagcagattggagttattggttgggggtctcagggccctgcccaagctcagaacttgagggattctcttacggtagcaaattctgacatagtggtcaagattggactgaggaagggctccgcctctgctgctgaagctcgtgctgctggatttacagaagagaatggcactctgggtgatatatgggaaactgtttcgagcagtgatcttgtgttgttattgatttcagatgcagctcaggcagataattacgagaaaatattctcccacatgaagccaaacagcatactggggctttctcatgggtttcttcttggacatctacagtcactagggcttgacttccccaagaacatcagtgtaattgctgtttgccccaagggaatgggtccatctgtgaggagactctatgtccaaggcaaagagataaatggtgcaggaatcaattccagttttgctgttcatcaggatgttgatggtagagctactgatgtagctctaggttggtcagttgctcttggttctccttttacatttgccactaccctagagcaagagtacaagagtgacatttttggggagcggggcattttgcttggtgcggttcatggagttgtggagtccttgtttagaagatacaccgagaataagatgagcgaagatcttgcttacaagaacactgttgagtgcatcacaggaattatatcaaagaccatctcaacaaagggtatgctggccgtgtacaattccttgtcagaggatggtaaaaaggaatttgaggctgtatatagtgcttcttattatccttgtatggacatcctgtacgagtgctatgaagatgtagctagtgggagtgagatccggagtgttgtcttggctgggcgacgcttttatgaaaaggatggtcttccagcattcccaatgggtaaaattgatcagacacgaatgtggaaagtaggtgagcgagtacgttcaacacggccacaaggtgacttgggtcctttgcatcctttcacagctggggtctttgtggcattaatgatggctcagattgaggtattgaggaagaaagggcattcatactcggagatcatcaacgaaagtgtgatcgagtctgtggactccttgaatccattcatgcatgcacgtggagtctcattcatggttgataactgctccacgactgcgagattggggtccagaaagtgggctccccgctttgattacattctcacccagcaggctttagtggcagtagacaagggggcacctgtcaaccaggacctcatcagcaacttcctgtcagatccagtacatggagccattgaagtctgtgcacagctgaggccaactgtcgacatatcggtgacagcagatgcagattttgttcgcccagagctgcgccagtcaagcaattagagtccagaagatctaagtagtcagcagatggggatgcctaatggataagctttcttgagttagggtaatatctggtttacatctgagttgtcatggtccttgttgagtgttccaaactagagccgaggtgatatgacaatgttaccgccgttattattattcgtaattgtggtttgttttttgttctcctgttgaatggttctttgcttacaggtctggaatgtttgtaaggtatttgctactttcccataatttattgttct

SEQ ID NO: 2090 - DNA, 2090 bp, Helianthus annuus
ggcataggcggggggagtgatgctctaaaaaaatatattttatagacccattttttctactcaactctatgattacaatacagttcgatacagtctgacacgtaatagggctccactagtcagtagtcacgtctcactctctccctgcatttcattactcttttaacccttgattatgacgaccgccgccgcaaccaccttctcctccgtcgcacctaccacctcctcttcaccatctccgacactcaaaaccctaggtttcaccacaaccttcctctcatccaaaacctccttcaaatcactccacgctcgcgtatttccatccaacatgacctctgtctccgctatgggagctcgtatggttgcatctccgacgatcaccaagtcgccggcgtctctcgatttcgaaacctctgttttcaaaaaggagaaagtcaaccttgctggtcacgaagagtacattgtgagaggaggtagagatttgtttcatctattgccggatgcatttaaagggattaagcagattggtgtcattggttggggttctcagggtcctgcacaagctcagaatttaagggattcacttgcagaagcaaagtctgatattgtagtgaagattgggctgaggaagggttcgagttcgtttgctgaggctcgtgctgctggtttcagtgaagagaatgggactcttggagatatatatgatactatttctggtagtgatttggtcctgctattgatatctgattcagctcaggctgataattatgagaaaatcttctcccacatgaaaccaaacagcattcttggactttcacacggtttccttcttggtcatttacaatcaatcggtcttgatttccccaaaaatttcagtgtggttgctgtatgccccaaaggaatgggcccatcggttagaaggctatacgttcaaggaaaagagatcaatggagccgggatcaatgctagttttgctgtccatcaggatgttgacggtagagccaccgatgttgcacttggatggtcagttgctcttggttcaccttttacatttgccactacactagagcaggagtataaaagtgatatatttggtgaaagaggtattttacttggtgccgtgcacggtatcgtggagtcattatttagaaggtacacagaacaaggtatgactgaagatctggcttacaagaacactgtagaatgcataaccggagtaatatcaaagaccatatcgactaagggtatgaaggctgtctatgagtcactctcagaagaaggcaaaaaagatttcttgattgcatacagtgcttcttattatccgtgcatggaaatcttgtacgagtgttacgaggatgtggctagtggcagtgagattaggagcgttgttttggctggtcgccgtttttatgaaaaagagggtcttccagcgttcccaatgggcaaaatcgatcaaacccggatgtggaaagttggtgaacgggtccgtgctacccgacccgccggtgatttgggcccgttatatccttttacagcaggtgtctacgtagcactaatgatggcccagattgaggtattaaggaagaaagggcactcttattctgaaatcatcaatgaaagtttaatcgaatctgtggattcgttgaaccctttcatgcatgctcgaggtgtttcgttcatggtggacaactgttccactactgcgaggttagggtcaagaaaatgggctccacggttcgactacaatctgacccaacaggccttagttgcagtggacaatggcgcgccagtgaaccaggatctggttaagagcttctttgaagatccggttcatgatgcagtcaaagtgtgtgcagagttgagacccaccgtcgatatctcggtgcctgcagatgctgattttgtgagacccgagctgcgtcaatcgaataactaaaatgggatgagttaagttatttacgttatacacctgccgtggtgtttaaagttatgttatgtatggcgtgtttgttacggatgcgtttttggtggttcgttggattttgtaattttggaataatggtggtgttggtgtatggtcttgttttcag

SEQ ID NO: 2091 - DNA, 1899 bp, Euphorbia peplus
tcactagtcatttcttactctctgcaacttctcagcatccatatcggagccacaataatgtccgccgccacgtcattctccgccactctatcatctccatcgccgtctaaatctctcaaatgtccgccgaaatccctgtcctcgagctccggcttaggatttactccggtcagccacaagcccttcaagccgctgaaagctagcaacggcggcggcggctcagctctaggtgctcggatggtgtctatgcctgctgctgttaagcctttgatttctcttgattttgagacctctgtcttcaacaaagagaaagtgtcccttgctggccatcaagagtacattgtgagaggaggaagggatttgttccacttgttacctgatgcattcaagggaatcaagcagattggtgtcattggttggggttctcagggtcctgctcaagctcaaaacttgagggattcccttgctgaagccaagtctgatattgttgtcaagattggattgaggaggggttctcgatcatttgctgaagctcgtgcagcaggttttactgaagagagtgggactcttggtgatatttgggaaactgtttcagggagcgatcttgtattgctattaatttctgatgctgcacaggctgacaattacgagaaggtgttctcacatatgaagccaaacagcatacttggactgtctcatggatttctgctcggacatctccaatcaagtggacttgacttcccaaagaacatcagtgtcgttgctgtatgtcctaaggggatgggtccatctgtaagacggctttacgttcaaggaaaagaggtcaacggtgctggaatcaatgctagttttgcagtccaccaggatgttgacggtagagctacagatgttgccttgggatggtcagttgcccttggctctcccttcacttttgccactacactagagcaggagtacaagagtgacatctttggggaacgaggcatcttgcttggtgctgttcacggaattgtggagtccttgtttagacggtacacagaaaatggaatgggtgaagaggaggcttacaaaaataccgttgagggcataacaggaaatatatcaaagaccatctcgactcagggcatgttggctgtatacaattctctgtccgaagaaggcaaaaaagaatttgagattgcttacagcgcctccttttatccttgcatggaaatcttgtatgagtgctatgaagatgtggccagtggtaacgagattcgtagtgttgttttggcgggacgccggttttatgagaaagaaggtctaccagcttttcccatgggtaatattgatcaaacacgcatgtggaaggtcggtgaacgtgtccgctcaactcggccagcaggggacttgggtccgttgtatcctttcactgctggtgtgtacgtggcattgatgatggcgcagattgaaatcttgaggaagaaaggacactcatactccgaaatcattaacgaaagtgtgattgagtctgttgactccttgaacccattcatgcatgcacgtggagtttcattcatggtcgacaactgctcgacaacagcaagattgggatcaagaaaatgggcacctcggttcgactatatcctgactcagcaagctttggtagctgttgacaatggcaccccagtgaaccgagatctcatcagcaatttcttatcagaccctgttcatggagccatcgaagtatgcgcccagttgagacctaccgttgatatctcaatccccgcagatgctgactttgtgagaccggagttgcggtaatctagtagtcgagattggaagtaccatggttagcttgaataggttggctaaatcctattattatgtacggttgagggagaagttaaatttgagttt

SEQ ID NO: 2092 - DNA, 1939 bp, Helianthus annuus
gcagagtacgggggagttcgatacagtctgacacgtaataggtagtcagtagtcacgtatcactctctccctgcatttcattactcttttaacccttgattatgacgaccgccgccgcaaccaccttctcctccgtcgcacctaccacctcctcttcaccatctccgacactcaaaaccctaggtttcaccacaacctttctctcatccaaaacctccttcaaatcactccacgctcgcgtgtttccatccaacatgacctctgtctccgctatgggagctcgtatggttgcgtctccgacgatcaccaagtctccggcgtctctcgatttcgaaacctctgtttttaaaaaggagaaagtcaaccttgctggtcacgaagagtacattgtgagaggaggtagagatttgtttcatctattgccggatgcatttaaagggattaagcagattggtgtcattggttggggttctcagggtcctgcacaagctcagaatttaagggattcacttgcagaagcaaagtctgatattgtagtgaagattgggctgaggaagggttcgagttcatttgctgaggctcgtgctgctggtttcagtgaagagaatgggactcttggagatatatatgatactatttctggtagtgatttggtcctgctattgatatctgattcagctcaggctgataattatgagaaaatcttctcccacatgaaaccaaacagcattcttggactttcacacggtttccttcttggtcatttacaatcaatcggtcttgatttccccaaaaatttcagtgtggttgctgtatgccccaaaggaatgggcccatcggttagaaggctatacgttcaaggaaaagagatcaatggagccgggatcaatgctagttttgctgtccatcaggatgttgacggtagagccaccgatgttgcacttggatggtcagttgctcttggttcaccttttacatttgccactacactagagcaggagtataaaagtgatatatttggtgaaagaggtattttacttggtgccgtgcacggtatcgtggagtcattatttagaaggtacacagaacaaggtatgactgaagatctggcttacaagaacactgtagaatgcataaccggagtaatatcaaagaccatatcgactaagggtatgaaggctgtctatgagtcactctcagaagaaggcaaaaaagatttcttgattgcatacagtgcttcttattatccgtgcatggaaatcttgtacgagtgttacgaggatgtggctagtggcagtgagattaggagcgttgttttggctggtcgccgtttttatgaaaaagagggtcttccagcgttcccaatgggcaaaatcgatcaaacccggatgtggaaagttggtgaacgggtccgtgctacccgacccgccggtgatttgggcccgttatatccttttacagcaggtgtctacgtagcactaatgatggcccagattgaggtattaaggaagaaagggcactcttattctgaaatcatcaatgaaagtttaatcgaatctgtggattcgttgaaccctttcatgcatgctcgaggtgtttcgttcatggtggacaactgttccactactgcgaggttagggtcaagaaaatgggctccacggttcgactacaatctgacccaacaggccttagttgcagtggacaatggcgcgccagtgaaccaggatctggttaagagcttctttgaagatccggttcatgatgcagtcaaagtgtgtgcagagttgagacccaccgtcgatatctcggtgcctgcagatgctgattttgtgagacccgagctgcgtcaatcgaataactaaaatgggatgagttaagttatttacgttatacacctgccgtggtgtttaaagttatgttatgtatggcgtgtttgtta

SEQ ID NO: 2093 - DNA, 2102 bp, Lactuca sativa
attttaataaaatatattttccacacctaccttgtagtaacccattcaaagtttcaaactatacccacagcacgttgcggcgtatattagcccccattgcatataagtagggctacagcaaagctccagcttacctcttcagccgtttctcctcgtctattacacgataatggcggcggcggcaacaacctctttctcaaccttggcacctaccgcttcgtcgtcggcagcatcggcttctctcaagctcgccccccaaaccctagggtttaatgtcggctttctgtcttccaaaacttcctccaaatccctcaaagcccgctctaatggcagttctggatctgctcttggggctcggatggtttctgccccagcgataactaagcctccgacgctgcttgattttgaaacatctgttttcaaaaaggagaagattaaccttgccggttatgatgagtatatcgtgagaggaggaagagatttgttccatttgttgcctgatgcctttaaaggtatcaaacagattggggttattggatggggttctcagggtcctgcacaagctcagaatcttagggattcccttgtcgaagcaaaatctgacatcgtagtgaagattggattacgaaagggttcaagctcgttcaacgaagctcgtggtgctggtttctctgaagaaaacggaactctcggagacatttatgaaaccatctccggcagtgacctggttctgctcttgatatccgattcagctcaggctgataactatgagaaaatcttctcacacatgaaaccaaacagcatcctaggactttcccatggattccttcttggacaccttcaatcagctggacttgatttccccaagaacataagcgtggttgccgtttgccctaagggcatgggtccatcagtaaggagactgtatgttcaaggaaaagagatcaatggagctggaatcaatgccagttttgcagttcatcaggatgttgatggaagagccactgatgttgcacttgcatggtctgttgcccttggttctccttttacattcgccaccacacttgaacaggagtacaagagtgacatattcggggaaagaggtattttacttggtgctgtgcatggtattgtggagtctttgtttagaaggtatacagaaggtggtatgagtgaagatttggcttacaaaaatacagttgaatgcatcactgggaacatatcaaagacaatctcaactcagggaatgaaagctgtgtatgagtcattaacagaagaaggcaagaaagaattcttaacagcatacagtgcctcatactacccttgcatggacattttatacgagtgctatgaagatgtagcaagtggcagtgagataagaagtgttgtgctagctggacgtcgattttatgaaaaagagggattaccagctttccccatggggaaaatcgaccagacccgtatgtggaaggtcggtgaacgggtccgtgctagccgacccgcgggtgatttgggtccgttgtatcccttcacagcaggtgtctatgttgcactgatgatggcacagattgaggtgttgaggaagaaggggcactcatactctgagattatcaatgaaagtttgattgagtctgtggattctttgaacccgtttatgcatgcgcgaggtgtgtcgtttatggtggacaactgttcgacaactgcaaggttggggtcgaggaagtgggccccacggtttgactatattttgacccaacaggctttggtggcggttgacaatgggagcccgcttaaccaggatctgattagcaacttctttgaggacccggttcatgaagcggttaaggtgtgtgctgagttgagaccaacaattgacatatcggtgcctgttgatgctgattttgtgagacccgagttgcgacaagcgagcaactaggtcaaggtgggcccatgtatggttcatatatttcatatcaaggtatggttctagttttattatgtgttttgtagaatgtttgtgtttttttttcgatggatgttgtgatggattttgttgaattttgtaataatggaagtggtccagagttgggtttttttttttt

SEQ ID NO: 2094 - DNA, 2147 bp, Mimulus guttatus
tctctctctctctctctgagtcacattttcagagtacagattagcaaactcgaaaagccacagaaatggcggcggcggctcctacctccttctctgccaccacagcagccaccacctcttccaaaaccctaactcctcagactaaatccccatcgatctccttgggcttcctatcttcctcatccccttcacttaaacccctccgagctaccgccgccgcttctcgaaccggctcccgtgcttccggctccgcatcggcggcccgcatggtgtcggttcagaccgtcaggcccccggcttcacaggatttcgaaacctccgttttcagtaaggagaaaatcaacctcgccggttacgatgagtacattgtgagaggagggagacacttgttcaagttgttgcccgatgcattcaagggtatcaagcagattggagtgattggttggggctcgcagggacctgctcaagctcagaacttaagagattctctagctgaagcaaactctgatattgtggtcaagattggtttgagaaagggttctagctcatttgctgaagcccgtgctgtagggtttacagaagaaaatgggacccttggggatatatatgaaaccatatccaatagcgatttggtgcttctgttgatatcagattctgctcaggctgataattacgagaaagtgttctcccacatgaagccaaacagcatacttggactttcccacgggttccttttgggccatttgcagtcaatgggtcttgacttccccaaaaacattagcgtgatagccgtatgccccaagggaatgggaccctctgttagaaggttgtatgtgcaaggaaaagaaataaatggtgccggtattaatgccagttttggtgtccaccaggatgctgacggaagagccacagatgttgctcttggatggtcagttgcccttggttcaccttttacttttgctaccaccctcgaacaggagtacaagagtgacatttttggggaacgaggcattttacttggtgctgtgcacggtattgtggaatcgttattcagaaggtacactgaaaatggaatggctgaggatctcgcatacaagaacaccgttgaaagcattacagggataatatccaagaccatatcaacaaagggtatgcttgctgtctacaatgcattaaatgaagatgagaaaaaagaattcgaggcagcatatagtgcttcgtattatccctgcatggatatcttgtacgagtgctatgaagatgtagccagtggaagcgagataaggagtgttgttttggctggccgtcgattttatgataaggaaggattaccttctttccctatgggcaaaattgaccagaccaggatgtggagagtcggtgagagagttcgtgcaacacgtccagcaggtgacttggggcctctgtatcctttcactgccggtgtctttgtggcgttgatgatggcccaaattgagattttgaggaagaaggggcactcttactcagagatcatcaacgagagtgtgatcgagtccgtcgactcattgaacccattcatgcacgcccgaggcgtttctttcatggtcgacaattgctcgacgacagctcgtctgggatcgaggaagtgggccccgcgattcgattacatcctcacacagcaggctctggttgcagtggacaacaacgcaccgatcaaccgtgacctgatcagcaacttcttgtccgatcccgtgcacggtgctattgaagtgtgtgcagaactgaggccaactgttgatatctcagtgcccgcagatgctgattttgttcgccccgagttgcgtcagtctgcaaactgaagatgatttgagctgagattttttagagggttttatgtgtttgtgtgagtgagagacagcccacccaagtgggggctgctgctttgctttgtttgaatttatgagtagatttttgtcatgcatgcatgtctttgttttgtgacgttgctactttttggtatcttatgttagtcggaataatgttataaactttagtgcttaatcttttggaaaaatctgatttttttcggaagtgaaaaatccattccaattccgtcaaaaaaaaaattggaatttcagaaatttgaatgaaaaaccttgtaacaa

SEQ ID NO: 2095 - DNA, 2124 bp, Quercus alba
taacctcagctgtcattgctctctttctctctgcgcctctctttgttgagttttcttcgatgtcggcggctacctcatcgttcgccccagcagcagctatatcagccccttcatcgtcgatctccaaggccctaatccccgtttccaagcccttctgtctaggcttcgccacctccttttctaagggcctcaaagctctcagagccacctctggtgttaccggctccactgggtcctctctcggcgctaaaatggtgtctgttccagccatcaaggcccccactttgcttgatttcgacactaaggtgttcaacaaggagaaagtcaaccttgctggccatgacgagtatattgtgagaggaggaagagatttgttccctttgttgcctgaagcgttcaagggaattaagcagattggtgttattggctggggttcacagggacctgctcaagctcagaatttaagggattctcttgttgaagcaaaatctgatattgttgtcaagattggactcagaaagggctcccgttcttttgctgaagctcgcgcagctggttttactgaagaaagtggcactctaggcgatatttatgaaactgtctccggcagtgatcttgtgttgctactaatttctgattctgcacaggctgacaattatctgaaaatattctcccacatgaaaccaaacagcatacttgggctttcccatgggtttcttcttggccatttgcaatcggaaggacttgacttccccaaaaacatgagtgtgattgctgtctgtccaaagggaatgggtccttccgtaaggagactttatgtccaaggcaaagaaataaatggtgcagggattaattccagttttgcagtccaccaggatgttgatggtagagccacagatgttgcccttggatggtcagttgctcttggttctcctttcacatttgccactactctagagcaggaatataaaagtgacatctttggggagcgtggcattttacttggtgctgtccatggaattgtggagtccttgtttagaaggtacacggaaaatggaatgagtgaagatctggcttacaagaacactgttgagtgcatcacagggataatatcaaagaccatctcaaccaagggtatgttggctgtatacaattccttgtctgaagaggacaaaagggtatttgagactgcatatagtgcttcatattacccttgcatggacatcttgtatgaatgctatgaagatgtggccagcggtagtgagatccggagtgttgtcttggctgggcgtcgcttttatgaaaaggatggtctaccagctttcccaatgggtaaaattgatcagacccggatgtggaaagttggtgaacgtgtccgatcagcacggcctgcaggagacctaggtccattatatcctttcactgctggtgtttatgtggcattaatgatggcccagattgagatattgaggaagaaaggtcactcatactctgagatcattaatgaaagtgtgattgagtcagttgattccttgaatccctttatgcatgctcgtggagtttccttcatggttgataattgttcaacaacagcgaggttgggatctaggaaatgggctccacgttttgattacatccttactcagcaggccttggttgcagtggacagtggtgtacccataaaccaggatctaattagcaacttcctgtcggatccagtgcatggagccattggagtatgcgcccaactgagacctaccgttgacatttcagtgcctgcagatgcagactttgtgcgacccgagttacgtgcatctggcaattaaaggctttaaaaatctgtaccctgagatgtccagcaatgccttttgagatggtttgagcgtgaagacttaaaatttaggggtgctgtagttttttcattctagtcttcttggttgaactattcgatgtatttgcagagccactatatgttcctatttgactggtgaggaaataaaggcgtggcaatgtgagtacttcttgtagctttggtgtgactaaattattctgagttatctttgttagacttcgttatgtgcaactttaatgagagttatatgaaaaatggggtagttgtggttt

SEQ ID NO: 2096 - DNA, 2057 bp, Cucumis melo
ctttgctgactcatccatggccgccgccacacatttcgctccctctatctcagcctcttcaaccaaaaccctaaaacaagctgctgctttgcagcctctatctccttccagcttaggctttttatcatcttcttcctcaggattatacgctctcaaagctgttggtatttgtggtgccaatggcgtcggttcagctcttggtgctcgcatggtctctgttcctgccatcaagcccttaacctcgcttgattttgatacatctgttttcaagaaggagaaagttaacctcgctggccatgatgagtatattgtcagaggaggcagagatctttttcccttgctgccggaagccttcaagggaatcaagaaaatcggtgtcattggctggggttcacaggcacctgcacaagctcagaatttgagggactcccttgctgaggccaagtctgatattgtggttaagattggtctgaggaagggttcccgctcttttgcagaagctcgtgcagttggtttttctgaagagaatggaactttgggtgatatatatgaaactatatccgaaagtgatcttgtcatgcttctgatttctgattctgcacaggctgataactatgagaaaatattttctcacatgaaaccaaacagcattcttgggctttcccatgggtttcttcttggccatttgcaatcattggggcttgatttccctaagaatatcagcgtgattgctgtttgtccaaaggggatgggtccatctgtgaggagactttatgtacaaggaaaagaggtcaatggcgcgggaattaattctagttttgcagttcaccaggatgttgatggcagagccacagatgttgcattgggttggtccattgcacttggttctccattcacatttgcaacaacactagagcaagaatacaggagtgacatctttggcgagcgaggtattctacttggtgctgttcatggaattgtggagtccttgttcagaaggtacactgaaaatggaatggcggaagagctggcttacaagaacaccgtcgaaagcataacaggaattatatcaaggaccatttctaccaagggaatgttggcagtgtacaattccttctctcctgatgagaaaaaggaattcgagagagcatacagtgcatcatattacccatgtatggatattctctatgaatgttatgaagatgttgccagtggaagtgagatccgcagtgttgtgcttgctggtcgacgattttatgaaaaggagggtctcccagctttcccaatgggcaacattgaccagacccggatgtggaaagttggtgagcgtgtccgacaatcacgtcctgcaggtgaccttggtccgttgtatcctttcactgctggtgtatatgtggcattgatgatggcacagattgagattctgaggaaaaagggccactcttactctgagatcatcaacgaaagtgtgatcgaatcagtcgactctttgaacccgttcatgcatgcccgtggtgtttctttcatggtcgacaattgttccacaactgcacgattgggatctcgaaagtgggctcctcgtttcgactacattctcacccaacaagctctggttgccattgacaacggttcagccattaaccaagaccttatcagcaacttcctgtctgacccagttcacggagcaattgaagtttgcgcccagttgagacctaccgttgacatttctgttccagctgatgctgatttcgttcgcccagaactacgtcaatcgagcaactaaaatatgccaaactgaattagatcgatcatgctcgacgaaggactgctgtatgtatctacaaaatatgtactgttatcctgatcttcttcaagatctagttttttcaagtttactataagagttagttgagcgattggtaataataaatagagaatgttcctgagttttcgtggttgttttggctaagtcgttcgttatgtagacctgtggggataattatcaactacctacttttatggcatctaatattagtttcatcctaaattccatctaa

SEQ ID NO: 2097 - DNA, 1928 bp, Helianthus annuus
ctcccagcatttcattactcttttaacccttgattatgacgaccgccgccgcaaccaccttctcctccgtcgcacctaccacctcctcttcaccatctccgacactcaaaaccctaggtttcaccacaacctttctctcatccaaaacctccttcaaatcactccacgctcgcgtatttccatccaacatgacctctgtctccgctatgggagctcgtatggttgcatctccgacgatcaccaagtctccggcgtctctcgatttcgaaacctctgtttttaaaaaggagaaagtcaaccttgctggtcacgaagagtacattgtgagaggaggtagggatctgtttcatctattgccggatgcatttaaagggattaagcagattggtgtcattggttggggttctcagggtcctgcacaagctcagaatttaagggattcacttgcagaagcaaagtctgatattgtagtgaagattgggctgaggaagggttcgagttcgtttgctgaggctcgtgctgctggtttcagtgaagagaatgggactcttggagatatatatgatactatttctggtagtgatttggtcctgctattgatatctgattcagctcaggctgataattatgagaaaatcttctcccacatgaaaccaaacagcattctcggactttcacacggtttccttcttggtcatttacaatcaataggtcttgatttccccaaaaatttcagtgtggttgctgtatgccccaaaggaatgggcccatcggttagaaggctatacgttcaaggaagagagatcaatggagccgggatcaatgctagttttgctgtccatcaggatgttgacggtagagccactgatgttgcacttggatggtcagttgctcttggttcaccttttacatttgcgactacactagagcaggagtataaaagtgatatatttggagaaagaggtattttacttggtgccgtgcacggtatcgtggagtcattatttagaaggtacacagaacaaggtatgactgaagatctggcttacaagaacaccgtagaatgcataaccggagtaatatcaaagaccatatcgactaagggtatgaaggctgtctatgagtcactctcagaagatggcaaaaaagatttcttgattgcatacagtgcttcttattatccgtgcatggaaatcttgtacgagtgttacgaggatgtggctagtggcagtgagattaggagcgttgttttggctggtcgccgtttttatgaaaaagagggtcttccagcgttcccaatgggcaaaatcgatcaaacccgcatgtggaaagttggtgaacgggtccgtgctacccgacccaccggtgatttgggcccgttatatccttttacagcaggtgtctacgtagcactaatgatggcccagattgaggtattaaggaagaaaggacactcttattctgaaatcatcaatgaaagtttaatcgaatctgtggattcgttgaaccctttcatgcatgctcgaggtgtttcgttcatggtggacaactgttccactactgcgaggttagggtcaagaaaatgggctccacggttcgactacaatctgacccaacaggccttagttgcggtggacaatggcgcgccagtgaaccaggatcttgttaaaagcttctttgaagatccggttcatgatgcagtcaaagtgtgtgcagagttgagacccaccgtcgatatctcggtgcctgcagatgctgattttgtgagacccgaactgcgtcaatcgaataactaaaatgggatgagttaagttatttacgttatacacctgccgtggtgttttatgttatgttatgtatggcgtgtttgttacggatgcgtttttggtggttcgttggattttgtaattttggaataatggtggtgt

SEQ ID NO: 2098 - DNA, 1987 bp, Raphanus sativus
gggaccctaatttgctcagcgcagacattattactgagactcaaaatggcggctgcgacttcatccatcgctccttccctctcatgcccatctccttcttcttcctccaaaaccctcaggtcctcgaaagccacaacctttgctttccccaacatcggttccctctcgtctgcttcaaagtctctgaggtccctcactgccaccgccgcgggaaatggtatcggatcttccttatccgcgcgaatggttgcgtcctctgcggttagagcacctatgtctctcgatttcgagacgtctgtgttcaaaaaggagaaagtgtctcttgctggtcacgaagagtacattgtgaggggaggaagggacttgttcaagcatcttcctgatgctttcaaagggattaagcagattggtgtcattggctggggttctcagggacctgctcaagctcagaatttaagggattcgcttgtggaggcaaagtctgacattgttgttaagattgggcttagaaagggctctcgctcatttgaggaagcacgtgctgttggcttcaccgaagaaagtggtactcttggtgatatatgggaaactatctctggcagcgatcttgtgctacttttgatctctgatgctgctcaggctgataactatgagaaaatattctcccacatgaagccaaacagcattctcggtttgtcacacgggtttctactggggcatttgcagtccatgggacttgatttcccaaagaacatcagcgtggtagctgtttgccctaagggaatgggtccatctgttagaaggctttatgtccagggaaaagaaatcaacggtgctggaatcaacgccagttttgcagtccaccaggatgttgacggtagagccgctgatgttgctctgggatggtcagtagcacttggttccccttttacttttgctactactcttgagcaagagtacaagagtgacatctttggagaaagaggcattttgcttggtgctgttcacggaatcgtggagtctctgttcagaaggtacaccgaaaatggaatgagtgaagacttggcttacaagaacactgtagagtgcatcacaggaaatatctcgagaactatctctacccagggaatgttggctgtctacaactccttgtctgaagaaggcaaaaaggatttcgagactgcatacagtgcatccttctacccttgtatggagatcctctacgaatgttacgaggatgtagcagctggcagcgaaatcaggagcgttgtcttagccggtcgtcgcttctacgataaggagggcttacctgcattcccaatgggaaagattgatcagacaagaatgtggaaggtcggtgaacgcgtcaggaagtccagaccagctggtgacttgggtcccttgtatcccttcaccgctggagtttacgttgctcttatgatggctcagattgagatcttgaggaagaagggtcactcctactcggagatcatcaacgagagtgtgattgagtctgttgattctctgaacccgtttatgcacgctagaggagtgtccttcatggtggacaactgctcgaccacagcaagattgggatcgaggaaatgggcaccacggtttgactacaacctgacacaacaagctttggtggctgtggacaatggtgcaccaatcaacaaagacttgatcagcaacttcttcgctgatccagtccatggtgctatccaggtctgtgcggagctcaggcccaccgtggatatctcagtgcctcaagatgcagatttcgttcgaccagagctccgtcagtccaactgagtgaagggtttgaaatgttatcagtctctttcaatgtaatcgtgttttgaagaaagacaatggtctttggaagttgtaggcgtgaatgaatgtttttgtttggactacttcagtaataatgatgtttcgttgtctctttctaattccactaatgggatcttctgttatgttc

SEQ ID NO: 2099 - DNA, 2138 bp, Castanea mollissima
cagctgtcatttctctctctctctctctgcctcacactctcagcgcctctcttttttgagtgttcgtcgatgtcggcggctacttcatcgttcgctccagcagcagctatatcagccccttcatcgtcgatctccaagaccctaaaccccgtttccaagcccttctctctaggcttcgccacctccttttctaagggcctcaaagctctcagagccacctctggtgttactggttccactgggtcctctctcggcgctaaaatggtctctgttccagccatcaagccccccactttgcttgatttcgacactaaggtcttcaacaaggagaaagttaaccttgccggccatgacgagtatattgtgagaggaggaagagatctgttccctttgttgccagaagcgttcaagggaattaagcagattggtgttattggctggggttcacagggacctgctcaagcacagaatttaagggattctcttgttgaagcaaaatctgatattgttgtcaagattggactcagaaagggctcccgttcttttgctgaagctcgcgcagctggttttactgaagaaagtggcactctaggcgatatttatgaaactgtctctggcagtgatcttgtgttgctactaatttctgattctgcacaggctgacaattatgagaaaatattctcccacatgaagccaagcagcatacttgggctttcccatgggtttcttcttggccatttgcaatcgataggacttgacttccccaagaacatcagtgtgattgctgtctgtccaaagggaatgggtccttccgtaaggagactttatgtccaaggcaaagaaataaatggtgcagggattaattccagttttgccgtccaccaggatgttgatggtagagccaccgatgttgcccttggatggtcagttgctcttggttctcctttcacgtttgccactactctggagcaggaatataaaagtgacatatttggggagcgtggcattttacttggtgcggtccatggaattgtggagtccttgtttagaaggtacacggaaaatggaatgagtgaagatctggcttacaagaacactgttgagtgcatcacagggataatatcaaagaccatctcaacgaagggcatgttggctgtatacaattccttgtctgaagaggacaaaagggtatttgagactgcatatagtgcttcatattacccatgcatggacatcttgtatgaatgctatgaagatgtggccagcggtagtgagatccggagtgttgtcttggctgggcgtcgcttttatgaaaaggatggtctaccagctttcccaatgggtaaaattgatcagacccggatgtggaaagtcggtgaacgtgttcgatcatcacggccagcaggagacctaggtccattatatccattcactgctggtgtttatgtgtcattaatgatggcccagattgagatattgaggaagaaaggtcactcgtactctgagatcattaatgaaagtgtgattgagtcagttgattccttgaatccctttatgcatgctcgtggagtttccttcatggtggataattgttcaacaacagcacggttgggatctaggaaatgggctccacgttttgattacatccttactcagcaggccttggttgcagtggacagtggtgtacccataaaccaggatctaattagcaacttcctgtcggatccagtgcatggagccattggaatatgcgcccaactgagacctaccgttgacatttcagtgcctgcagatgcagactttgtgcgaccggagttacgtgcatctggcagttaaaggctttaaaattctgtaccctgagatgtccagcaatgccttttgagatgttttgagcgtgaagacttaaaatttaggggtactgtagttttttcattctaggcttcttggttgaactattccatgtatttgcagagccactatatgttcctatttgaccggtgaggaaataaagacgtggcaatgtgtgtacttcttgtagctttggtgtgactaaattattctgagttatctttgttagacttcgttatgtgcaactttaatgaaagttatgtgaaaatggggtagttgtgataataaaa

SEQ ID NO: 2100 - DNA, 1899 bp, Arnica chamissonis
atatttcaccaccgtaatggcagcggcgacaactaccttctcaaccttggcccctgccacctcatcctccgcagctgcagcgcctctgaagattgctcccaaaaccctagggtttaagtcgggatttctctcttccaaaactacatccaaatccctcaaagctcgttccaatggcggatctggatctgctctcggagctcgtatggtttcagcgccagcaataagcagaccaacgcttctcgatttcgagacctccattttcaaaaaggagaagattaaccttgctggtcatgatgagtatatcgtgagaggaggaagagatttgttccatttgttgcctgatgcctttaaaggtatcaagcagattggtgttatcggttggggttctcagggtcctgctcaagctcaaaatcttagggattcacttgcagaagcaaaatctgatattgtagtgaagattggcttacgaaagggttcgagttcattcaacgaggctcgtgctgctggattttctgaagaaaccggaactcttggagatatttatgagactatctcaagcagtgacttggtcctgctcttaatttctgattcagcgcaggctgataattatgagaaaatcttttcacacatgaaaccaaacagcatacttggactgtcccatgggttccttcttggtcatttgcaatcagctggtcttgattttcccaaaaacataagtgtggttgctgtgtgtcccaaaggaatgggtccatctgtcaggaggttgtatgttcaaggaaaagaagtaaatggagctggaatcaatgcaagttttgctgtccatcaggatgttgatggaagagccaccgatgttgcccttggatggtcggttgcgcttggttcaccgtttacgtttgccactacacttgagcaggaatacaagagtgatatctttggggagcgaggtattttacttggtgcggtgcatggtattgtggaatctttgtttagaaggtatacagaaggcggcatgagcgaagtattggcttacaaaaatactgtagagtgcataactggcataatatcgaggacaatatcgtctcagggcatgaaggctgtatacgagtcattgacagaagaaggcaaaaaagagtttttgacagcatatagtgcctctttctatccttgtatggaaattctatatgagtgctatgaggatgtagcaagtggcagtgagataagaagtgtcgttttggctggtcgtcgattttatgaaaaggagggtttgccagcgttccctatgggaaagattgaccagactcggatgtggaaagtaggtgaacaggttcgggctgtccggcctgcgggtgatttaggcccgttatatcctttcaccgctggtgtctacgttgcactaatgatggcccagatcgaggtgttgaggaagaaagggcattcttattctgagatcatcaatgaaagtttgatcgagtcagtggattccttgaacccattcatgcatgctcgaggtgtgtcgtttatggtggacaactgttcaacaactgcaaggttgggatcgaggaaatgggcgcctcgttttgattatatacttacccaacaggctttagttgctatagacaatggtgcaccactaaaccaggacctcatcagcaacttctttgaagacccggtgcatgaagctgtcaaagtttgtgcagagttgagacccactgttgatatctcggtgcctgctgatgctgattttgtcagacctgagttgcgtcaatctagcaactagagatggtaatcgttcatgcccaggtatgattctcaccttagtttcagatcaatgcaggtgttatgcataatgtttcttacggatgttttcatgggattcgtggttttgaataataaaagtta

SEQ ID NO: 2101 - DNA, 1827 bp, Flaveria ramosissima
aacctcctttgctccgccgttccccctcctccaccacattttccggcaatgtcgacggcgaccaccaccttctccaccgtagccccaacaacctcatcatcaccgtctctcaaaatctcccccaaaaccctagggtttaacgtagggttttcgttgtccaaaacctccaccaaatcgctcaaagctcgttccaatggtagctgtggttctgctattggagctcgtatggtttcagctccggcgataagcaaacctccaatgcttcttgattttgagacctctgttttcaaaaaggagaagattaaccttgctggtcatgatgagtatattgtgagaggagggagagatttgtttcatttgttacctgaggcttttaaaggtatcaagcagattggtgttattggatggggttctcagggtcctgctcaagctcagaatcttagggattctcttgcagaagcgaaatctgatattgttgtgaagattggcttacgaaaggggtcgagttcatttaacgaggctcgtgctgctggctttactgaggaaactggaacccttggagatatatacgagactatctctggcagtgacttggttctgctcttgatttctgattcagctcaggctgataactatgagaaaatcttttcccacatgaagccaaacagcattcttggactttcacatgggttccttcttggtcatctgcaatcagttgggcttgatttccccaagaacataagtgtagttgctgtgtgtcccaaaggaatgggtccatctgtcaggaggttgtatgttcaaggaaaagaggtcaatggagccggaatcaatgcaagttttgctgtccatcaggatgttgatggaagagccactgatgttgcacttgcatggtcagttgctcttggctcaccctttacattcgccactacacttgagcaggagtacaggagtgatatattcggggagcgaggcattttacttggagcggtgcatggtattgtggagtctttgtttagaaggtatacagaaggtggtatgagtgaagatttggcttacaaaaacaccgtagagtgcattactggcataatatcaaagataatatcgactcagggcatgaaagctgtatacgagtcattgacagaagaaggcaaaaaggagttcttgacagcatacagtgcatcttactatccatgtatggacattttgtatgagtgctatgaggatgtggcgactggaagtgagattagaagcgttgtgttggctggccgtcgattttatgaaaaggagggtttgccagcattccctatgggcaagatcgatcagactcgaatgtggaaagtaggtgaacgtgttcgggctgcccgatctgcaggtgatttaggcccattgtatcctttcacggctggcgtctatgttgcactaatgatggcccagattgaggtgttgaggaagaaaggacattcttattctgagatcatcaatgaaagcttgatcgagtcagtggattcactgaatccattcatgcacgctcgaggtgtgtcgtttatggtggataactgttcaacaactgcaagactgggatcaaggaaatgggctccccgctttgattatattcttacccaacaggctttagttgctgtagacaatgggaccccacttaaccaggacctaatcagcaacttctttgaagatccggtgcatgaagctgtcaaagtttgtgcagagttgagacccactgttgacatctctgtgcccgctgatgctgattttgtcagacccgagttgcgtcaagctagcaactaagtattgactcccaggctcttgtct

SEQ ID NO: 2102 - DNA, 2025 bp, Tabernaemontana elegans
cagttgcagatggcggcggcagcaccaactactcctttctctgcctccaccactccgttatccaaaaccctaaaccaacataccaaaaatttagcacacaatctcagtttcatttcttcatcaacgccttctctgcacgcactcatggctcgggcctctggaccagtgtctggaacatcccacggcggagccgttgctgcttgtatggtgtctacacctagcgctgttgcaaaggtgcaaccgctaactcttgattttgtcacaagtgtcttcaagaaggagaaggtcaatctagcgggacacgaagagtatattgtgagaggaggcagggatttattcaagctgttgccggacgctttcaagggaatcaagcagattggtgttattgggtggggttcacaggggcctgctcaggctcagaatctaagagactcacttgctgaggcgaaatctgatatcgtggttaaggttggtttgaggaaaggttctcgctcattcgttgaggcccgtgcagctggcttcagtgaggaggacggaacccttggagacatatatgagactatatctggtagtgatcttgtgctactcttaatttctgatgcagcacaggctgataattatgagaacgtgttttcccacatgaagccaaatagtatccttgggctttcgcatggttttcttcttggccatttgcagtcaatgggtcttgatttccccaagaatattagtgtaatagctgtatgtcccaagggtatgggtccatcagtgagaaggttatatgtgcaagggaaagaaatcaacggagctggcatcaattctagttttgcagttcatcaggatgttgatgggagggctacagatgttgctcttgggtggtcagttgcccttggttctccttttacctttgctactaccttagaacaggagtacaaaagtgacatcttcggggagcgaggcattttactgggtgctgtacatggcattgtggagtcattgttcagaaggtacactgaaaaaggaatggctgaagatcttgcatacaaaaacactgtggagtgtattacaggaattatttcgaaaaccatatccacgaagggcatgttggctgtttacaattcattaacggcagaaggaaagaaggaatttgagactgcctatagtgcttcatattatccctgtatggatatcttatatgaatgctatgaagatgtggctgctggaagtgagattcggagtgttgtcttagctggacgtcgcttctatgaaaaggagggtctccctgccttccctatgggcaagatcgaccaaacaaggatgtggaaagtaggtgagcgagtccgggcttcacgatcagctggtgatttgggccctttataccctttcacagctggtgtttatgtggcattgatgatggcacagattgagatcttgaggaagaaagggcactcctattccgagatcataaatgagagtgtgattgagtccgtggattctctaaatcctttcatgcatgctcgtggggtttcattcatggttgacaattgttcaacaactgcacgggtagggtcaaggaagtgggctccccggtttgattacattctaactcagcaggctcttgtggcagtggacaacaaaactcccattaacagggatctgatcagcaacttcctatccgatccggtgcatggagctattgaagtgtgtgcccagttgagacctactgttgacatttcagtgcctcaagatgctgattttgtgcgcccagagcttcgccagtctaactaaagctgtctcaggtcttgagttcaactacctagagctctgccagttcaggaactgaatagttttagttagatctagttgaatgtatgcatttgaggtgtaggctttttggatatccatgagcatatttctgtccagcgtgctgtgctgcactcctgttagtgtgggagaattgttctgtatgttgtgctttttaccattggtgcaaggagatttgataatcgttctgttagtaatttcaag

SEQ ID NO: 2103 - DNA, 2108 bp, Aquilegia formosa
ctcactgcagctaaaccatttgagtgctgagtcatcatcatcatcaatggcggcggcgacttctgcatcaatctcttcatctctttatgtttctaaaaccctaaaaccaacttctccacaaactaatcttgggtttatctctaaatcttctaaaaccctgaaaccccttttttctaaaatttctagaactaatctatcatctaatggtagtggagctgttgttagagctcaaatggtttcagttcctgctactaaaccaaccatttgtcttgatttcgaaacatctgtgtttaataaggagaaagtcacacttgctggtcatgatgagtttattgtaagaggaggaagggatttgtttcatttgcttcctgatgcattcaaaggaattaagcagattggtgtcattggatggggttctcagggtccagcccaggctcagaatttgagagattctcttgcagaagcaaagtcagacattgttgtgaagataggattgagaaaaggctccagttcttttgctgaagcacgcgcttctggattttcggaagaaaatggaactttgggtgacatatggcagactatttcaggcagtgatcttgtattgttattgatttctgatgcagcacaggcagataattatgagaggattttctcacacatgaagccaaacagcatccttgggctgtctcatgggtttcttcttggacacctgcagtcagctgggcttgattttcctaagaatatcagtgtgattgcagtatgccccaagggaatgggtccatctgttagacgattatatgttcaaggaaaggaaattaacggggcaggaataaatgccagttttgctgttcaccaggatgttgatggtagagccacagacgttgcccttggatggtcagttgctcttggttctcctttcacatttgccacaacattagaacaggaatacaagagtgacatttttggggaacgaggaattttgcttggggctgtgcatggagttgtggagtccttattcagaaggtataccgaaaatggaatgcccgaggatgcggcttacaagaacactgttgagagcatcacaggcatcatatcgaggaccatttctacaaagggtatgctagcagtatacaactctttgtcagaggatggtaaaaaggaatttcagactgcttatagtgcttcttactacccttgtatggatatcttgtatgagtgctatgaggatgtagcctctgggaatgagatcagaagtgttgtcctagctgggcgccggttttatgaaaaggatgggcttccagcttttccaatgggtaagattgatcaaacacgcatgtggaaggttggtgagagtgtgcgctcaacccgaccacaaggtgatctgggtccattgcaccctttcactgctggggtttttgtcgctttaatgatggctcagattgaggtactgagaaagaaaggacactcgtactcagagattattaatgaaagtgtgattgagtcagtagattcgttgaaccccttcatgcatgctcgtggtgtcgctttcatggttgacaattgctccacaactgcacgattgggatcgagaaagtgggctccccgctttgattatattctcacccaacaggccttggttgcggtggacaaagatacttcaatcaatcaggacctcattagcaacttcttgtctgatcctattcatggggccattgaagtttgtgcccagttgaggccaactgtggacatatcagtgcctgaagatgcagattttgtgcgaccagagctacgataagtctagcaattaggctacagtagatcccacttgatggcttgatctgaaggctatgtgtatttaggagtatcagaggttctgcgtcaacatgaccgttgtcccaagatgattgtcctttagaggcacatcttaactattctaggagagcttggtaattatgttacctaaagaatgttttgcaggaagacactactcgtttgttatttgctatgttacgtgtttatgtaactttgaaagataatattgagcttattagagttgtttttagcattctgtgttcctttccccattattaatatattaatattaatgg

SEQ ID NO: 2104 - DNA, 2076 bp, Vinca minor
ctcactcttcctcgcacccaatcgcagttatggcggcgtcggcgtcagcagctacctccctctccgtctcgaccgctccggcaaccaaaatcctaaaataccaaacaacatccgtacataatctcagttttctttcttcctcgacgccttctctgaagcctttagcagctcgtgcagcctctacagctgtttctgtatcatctcacggcggatctttcgctgctcgtatggtctctacacctgccgctgtgaagccgctaacttctcttgattttgagacctcagtcttcaagaaggagaaagtcactcttgctggccacgaggagtatattgtgagaggaggaagggatttattccatctgttgccagacgcattcaaaggaataaagcagattggtgtcatcgggtggggttcacagggacccgctcaagctcagaatctaagagattcacttaccgaggcaaaatctgatattgttgtcaagattggattgaggaaaggttctcgttcatttgctgaggcccgtgcagtcgggtttagtgaggagaatggtacccttggtgagatatacgagactatatctggtagcgatctagtgcttctcttaatttctgatgcggcacaggctgataattatgagaaagtgttttcgcacatgaagccaaatagtatccttggactttctcatggctttcttcttggccatttgcagtcgatgggaaccaactttcccaagaatattagtgtaatagctgtatgtcccaagggaatgggtccatcagtgagaaggttatatgtgcaaggcaaacaaatcaatggtgctggaatcaatgctagttttgctgttcatcaggatgttgatgggagggctacagatgttgctctcgggtggtcagttgcccttggttctccgtttacctttgctactactttggaacaggagtacaagagtgacatctttggggagagaggaattttactgggtgctgtacatggcattgtggagtcactgttcagaaggtacactgagaatggaatggctgaagatcttgcttacaaaaacactgtggagtgtatcacgggaatcatttcgaaaaccatatctactaagggcatgttggctgtctacaatgcattaactgaagaaggaaagaaggaatttgaggctgtctatagtgcttcatactatccttgtatggatatcttgtatgaatgctatgaagatgtggctactggaagtgagattcgaagtgttgtcttagctggacgtcgcttttatgaaaaggagggtctccctgccttcccaatgggcaagatcgaccaaacaagaatgtggaaagtaggtgagcgagtccgagcagttcgaccagctggtgatttgggccctttatacccattcacagccggtgtttatgttgctttgatgatggcacagattgagatcttgaggaagaaagggcactcctattctgaaatcataaatgaaagtgtgatcgagtctgtggattctctaaaccctttcatgcatgctcgcggggttgcgtttatggtcgacaattgttcaaccactgcacggttgggatctaggaaatgggctccccggtttgattacatcctcacacagcaggctctggttgctgtggacaacaaaactccgattaacagggatctcatcagcaatttcctatccgatccagtgcacggagctattgaagtgtgtgcccagttgagacctactgttgacatttcagtgcctcaagatgctgattttgtgcgcccggagcttcgtcagtctaactaaaagctatatctcaaatattgatgtcgaactaccgagagctaagtcaattatagaaccaaatagagttagctgcttaaaagtttgcatttgagatgtagggcttttttggggactttccggtgcatatttttctatcatctgcccttctcttattagtatgtgagaattgttacgtatgttgtgcttttcattgtgcaaggagattcaataatcattcctagtaatttcacaataataatgtgttttttcgagatatttgtgaattgtgattgct

SEQ ID NO: 2105 - DNA, 2199 bp, Brassica napus
gtgcgcttgttgtctctccaccctaattagcaacactctgaggctcaaatggcggctgcgacttcatccatcgctccttccctctcatgcccatctgcttcttcttcctccaaagcccttaggtcatcgaaagtctcaacctttgctttccccaacatcggtttcatctcctctgcttccaagtctctgaggtctctcaccgccaccgtttctggaaatggcaccggatcttccctctccgcgagaatggtcgcgtcggctgcggtcagagcccctctttctctcgattttgagacgtctgtgttcaaaaaggagaaagtctctcttgctggtcacgaagagtacattgtgagaggaggaagggacttgttcaagcatcttcctgatgctttcaaagggattaagcagattggtgtcattggctggggatctcagggacctgctcaagctcagaatttaagggattcacttgtggaggcaaagtctgacatcgttgttaagattgggcttagaaagggctctaaatcgttcgaggaggcacgtgctgttggcttcaccgaagaaagtggtaccttgggtgatatatgggaaactatctccggcagtgatcttgtattgcttttgatctctgacgctgctcaggctgataactatgagaaaatattctctcacatgaaaccaaacagcattctcggtttgtcacacgggtttctactggggcatttacagtcaatgggacttgacttcccaaagaacatcagcgtggtagctgtttgccctaaaggaatgggtccatctgtgagaaggctttatgtccaaggcaaagaaatcaacggtgctggaatcaacgctagttttgctgtccaccaggatgttgatggtagagccgcagatgttgctctaggatggtcagtagcacttggttctccttttacctttgctactactcttgagcaagagtacaagagtgacatctttggagaaagaggtattttgcttggtgccgttcacggaatagtggagtctctgttcagaaggtacaccgagaacggaatgagtgaagacttggcttacaagaatacagtagagtgcatcacaggaaacatttcgaggactatctctactcagggaatgttggctgtctacaactccttgtccgaagaaggcaaaaaagatttcgagactgcctacagtgcatccttctatccttgcatggagattctctatgaatgttacgaggacgtagcagctggcagcgaaattaggagtgttgtcttagccggtcgccgtttctacgacaaggagggcttgcctgcattcccaatgggaaagattgatcagacaagaatgtggaaggtcggtgaacgcgtcaggaagtcaagaccagctggtgacttgggtccgttgtatcccttcactgctggagtttacgttgctcttatgatggctcagatcgagatcttgaggaagaagggtcactcatactcagagatcatcaacgagagtgtgattgaatctgttgactctctaaacccgtttatgcatgctagaggagtgtccttcatggtggacaactgctcgaccactgcaagattgggatcgaggaaatgggcaccgaggttcgactacaacctgactcaacaagctttggtggctgtggacaatggtgcaccaatcaacaaagacttgatcagcaacttctttgctgatccagtccatggtgctattgaggtttgtgcacagctaaggcctacggtcgatatctctgttcctgaagatgcagatttcgttcgaccagagctgcgtcagtccaactgagtgtaagggttgttaaacttatcagcttcaatgaaaattgtaatcgtgttttgaaaagatagacaagagcttttggaagttgtaggcgtgaatgttttgtttgaataaatgatctctttggagttccacatgtgatgttctctctgctttcagtattgatgtctcttgtgaatgttagtctggagagattaaaagaattggagctcttcctttacttgttgaagatacatgagaaaaggaataaagaaactttcaagcggtttagatccagagatgatctagcatttgaagtgtggtgagagcacaatgctttggtctctctctttactgtgaaatgaaagaatctaaattataagaatcacatgtaatggacattttcat

SEQ ID NO: 2106 - DNA, 2442 bp, Populus trichocarpa
ttttccagttccaagttcaagacgacaaaatctaaatgacaaaacagaagcaaacgacttttcattccaaacaaaggccaccagagacacctactcctctattctacacgagcttactgtaaagctccctgactaaaacactaatggcggcggcggctacatccttctccaccactctcaccactccaaccccatcaaaaaccctaaaatctgcaccatcaaggtcacttctatgcaacagcaatttagggttttcatcatcagtgtcttccaagaccttcaaaccactcaaggcgagtaatggtaacgttactggtggagttttgggtgctaagatggtgtcatcggttcccagtgtaaaacccttgatttctcttgattttgagacctctgtgtttaagaaggagaaggtatctctcgctggccacgatgagtacattgttagaggagggagggacttattccacttgctgccggatgcatttaaggggattaagcagataggcgttctcggttggggttctcagggtcctgctcaagctcagaatttaagggattctcttgctgaagcaaagtctgatattaaagtcaagattggactgaggaaaggctctcgttcttttgctgaagctcgtgctgctggttttacagaagagaatgggactttgggtgatatatgggaaactgtttctggcagtgatctagtattgctattgatttctgatgctgcacaggctgataactatgagaaagttttctcccacatgaagccaaacagcattcttgggctttctcatggatttcttcttgggcatttgcagtccatgggacttgattttccaaagaacatcagtgtcattgctgtgtgtcccaagggaatgggtccttctgtaaggaggctctatgttcaaggaaaagaggtcaatggtgctggaattaattccagttttgcagtccaccaggatgttgatggtagagccacagatgttgccctgggatggtctgttgcccttggttcacctttcacatttgccactacactagagcaggagtacaggagtgatatctttggggagaggggcattttgcttggtgctgttcatggaattgtggagtccttgtttagacggtatactgaaaatggaatgagtgaagacgaggcctacaagaacactgttgagtgcataactggaatcatatcaaggacaatatcgaccaagggcatgctggctgtttacaattccttgactccagaaggcaaaaaggaattcgagactgcatacagtgcctcgttttatccctgcatggacatcttgtatgagtgctatgaagacgtagcctctggaagtgagattcgcagtgttgtgctggccggacgtcgcttttatgaaaaggaaggtctaccagattttccaatgggtaaaattgatcagacacgtatgtggaaggtcggtgagcgagtccgagctacccggccagcaggggacttgggtccattgcatccattcactgcaggtgtctatgtggcgctaatgatggctcagattgaaatattgaggaagaaaggccattcttactctgagatcataaatgaaagtctgattgaatctgtggattccttgaatccatttatgcatgcccgtggagtttctttcatggttgataactgctcaaccacggcaagattgggatcaaggaagtgggcacctcgttttgactatatcgtcacccagcaggccctggtcgctgtggacaatggtactcccatcaaccgtgacctcatcagcaacttcttttcagatccagtgcatggagctgttgaagtctgtgcccaattaagacccacagttgacatttccgtgccaccagatgctgactttgtgcgacctgagcttcgccaatctagcaactgagatttgaaggagttgaaataaccaggaggattcttccatattagttctgtttgagaagctctcttgaattattagcagagtacggttttatttaagaacaactagtgtgagcttaagtattatgtctgcctgtcctgtccggcatgaaacacaagcatgtagttttgtccatcagtattgcgagagtaggcgcgtgtattagtaacttttttgactttccgttctgcaaagaagagaggagtgcactctttttactgctgctgtgtcctttctgttgcttagacgctaaaacgaggcatgatagctctgtgctacaatctcccatgaagatgctgccgaagtagaactggaacctggatggtatttgatgagcaactttgtatcaattctgtgttcgttgcagtgttgaaagaacaaccagatccaacccccaaccccacctatgatgtcaaagtgagattgtgttgttttgaaacaactgccacaatcatccatgaatgattatgaatgacaaatccaaccatccaaa

SEQ ID NO: 2107 - DNA, 1978 bp, Chelidonium majus
gcaacttccttcacaccaacagtggcttctccttcatcgtgttcatctaaaaccctaaaacctgtccacacatccttgggtttcaacctagggtttctatcttcatcttctaaaaccctaaaacctctcgttgcacgggtctcttccaataacaacaatgcagttggatcttctcttgcatctcgcatgatggtttcagtgcctgcggtcaagcccttgactactctagattttgaaacctctgtcttcaataaggagaaggtcacacttgctggtcatgacgagtatattgttaaaggaggaagggatttgttccatttgttacctgatgctttcaagggaattaagcagatcggtgttattggttggggttctcagggacctgcccaagctcaaaacttgagggattcacttgtagaggcgaagtctgacattgttgtcaagattgggttgaggaagggctcccgttcttttgctgaagcacgtgctgctggttttacagaggagactgggacattgggggatatatatgaaactatctcaggcagtgatctcgtgttgctattgatttctgatgctgcacaggcagataattatgagaaaatattttcccacatgaagcctaacagcatacttgggctctcccacggatttcttcttggacatttgcagtccttggggcttgatttccccaagaatattagtgttattgctgtgtgccccaagggaatgggtccatctgtaagaaggctctatgtgcaaggcaaagagataaatggtgctggaattaatgctagctttgctgtacaccaggatgttgatggtagagcaacagatgttgccctagggtggtcagttgctcttggttctcccttttcatttgccactactctagagcaggagtacaagagtgacatttttggtgaacggggcattttactcggagctgttcatggagttgtggagtccttgtttagaaggtacactgagaacggaatgaacgaagaccttgcttacaagaacactgttgagtgcatcactggaattacatcaaagaccatctcaactgagggcatgctagctgtatacaactctttgtcagaggaaggtaaaaaggactttcaaactgcatacagtgcctcatattatccttgtatggagatactgtacgagtgctatgaggatgtagcttgtgggagtgagatccggagtgttgtcttggccgggcgtcgattttatgaaaaggagggccttccagcttttcccatggggaagattgatcaaacacgaatgtggagagttggtgaacgagtccgttcaacacgaccagcaggtgatttgggtccgctgtatcccttcactgctggaattttcatagctttaatgatggctcagattgaggtattgaggaagaaggggcactcttactcagagatcatcaacgaaagtgttattgagtcagtggattctttgaatcccttcatgcatgcacgtggagtctccttcatggttgataactgttccacaacagcacgattggggtcgaggaagtgggctccacgatttgactacattctcacccaacaggccttggtggcagttgacaataatagtcccatcaaccaggaccttattagcaacttcttgtctgaccctatccacggagcgatcgaagtctgtgcccaattgagaccaactgttgacatatctgtgccagcaaatgcagattttgtaaggccagagcttcgtcagtctagcaattaaacttggaagagagtcaacaatgaccctgtttaaagggatatcttgagtaagtactcgaaggctgttaccaatttaggtatccagagtgatttgcataatatgagctctgtaagttgtgatgtttgttgttgaaaggtgcagacattaagcatctgcgtgctattttatccagagtgttttgttttcttgaatatatttgaataactgggatggg

SEQ ID NO: 2108 - DNA, 2056 bp, Solanum tuberosum
cttatccctctctgtaacactctcatttgtctgctttccacttcacaatcatggcggcggcggcggcgacttccttctccatcaccacttccactcctccttcctcctcctcctcaaccaaatccctaaagccttctcttgttggtaacttagggtttctatcctcgtcaacaccatcgcttaagcctctcagagctcaagccgccatttcatctggcagctcaaactccggcggcggcgcgcttgcggctcgcatggtcgccgcacctgctaccgtcaaagctcctgcttcgtttgattttgaaacttccgtttttaagaaggagaaagtaaccctcgctggaaatgatgagtacattgtgaggggagggagagatttgttcaagtatttgcctgatgcttttaaaggaatcaagcagattggagttattggctggggttctcagggacctgctcaagcccagaacttgagggattctctcgcagaaataaaatctgacatagttgttaagattggtttaaggaagggttcaagctcatttgcagaggcccgcacagctgggtttactgaagagagtgggacccttggtgacatatatgagactatctctggcagtgatctagtgctgcttttgatttctgatgctgctcaggctgataattatgagaaagtattttctcacatgaagccaaacagcatacttgggctttcacatggattcctccttggccatttgcagtcaatggaccttgacttcccgaagaacattagtgtgattgctgtatgtcccaagggaatgggtccctcagtcaggagattatatgttcaaggaaaagaagttaatggtgctggaattaattcaagttttgcagttcaccaggatattgatggaagagccacagatgttgctctagggtggtctgttgcccttggttctccctttacttttgctactactctagagcaggaatataaaagtgacatttttggagaacgaggcattttacttggtgctgtccatggagttgtggagtcacttttcagaaggtacactgagaacggaatgaatgaggagcttgcatacaagaacactgtagagtgcataacaggagtcatttcaaagaccatatcaacaaagggcatgttggctgtgtacaactcattgactgaagagggcaagagggagtttgaagctgcatacagtgcttcattttacccatgcatggagattttgtatgagtgctatgaagatgtagctacaggtagcgagatcaggagtgttgtcttggcaggccgccgcttttatgaaaaggagggcttacctgccttcccaatggggaaaattgaccaaacaaggatgtggaaggttggtgagcgcgttcgagcaacccggccagctggtgatcttggtcctctgtatcctttcactgctggtgtctttgtggcattgatgatggcccagattgaggttctgaggaagaaaggtcactcttactccgagattatcaatgaaagcgtcatcgagtctgtagattctttgaatccgtttatgcacgctcgtggagtatcattcatggttgacaattgctctacaacagcacgtttaggttccaggaagtgggcccctcgatttgattacaatctcacccagcaagcacttgtagctgtggataataacgcccctatcaatcaagatctcatcagcaacttccttgcagatcctgtgcatggagctattaaagtctgtgctgaactgagacccacagttgatatttctgtaacagcagatgctgattttgtccgccctgagctcaggcaatctggcaattaagggctttacgggtgggaattttgtggaattgtgaggtttagattttattttgttgatgtgtgttggtgaaggcaagaatacttaaatctgttagcttataagaatcttagcctttttcgttgcttagttacgccggtactagcactttctttatgtaacctttttctgaataacagattcgaaatttgggaacccctttagcaactataaaatgtaggtcatgt

SEQ ID NO: 2109 - DNA, 1952 bp, Cleome gynandra
accctaatttggtctctcttttgcagctttcgcagacacgttaccgtcttcgctcagcaaaatggcgtcggctacttcctccattgctcctcccctctcctctacttctccttcttcctccaaaaaccttcgatcctccaatcccagaactgtaacgcttcctacaatcgggtttctctcctcttttccaaacctctgcgtccgctgatggccgccgttgcaagaaatgttggctctggctcttccgtcggtgctcgcatggtggccgctccggcgattaagactccagttactctcgattttgagacctccgtattcaaaaaggagaagatctctctcgctggccacgatgagtacattgtgagaggaggaagggatttgttcaagctacttccagatgctttcaaggggattaagcagattggtgtaattggttggggctctcagggacctgcccaagctcagaatttgagggattcacttgctgaggcaaaatctgacatcgttgttaagattggacttagaaagggctctggttcttttgatgaagcccgtgctgctggctttaccgaagagaatggcacattaggtgacatatgggagactatctctagcagtgatcttgttttactcttgatctccgatgctgctcaggctgatagctatgagaaaatattctcccacatgaagccaaacagcattcttgggttatcacatgggtttctcctaggacatttgcagtccatggggcttgatttcccgaagaacatcagtgttgtcgccgtatgtcctaagggaatgggtccttcggtgaggaggctttacgtccaaggaaaagaaatcaatggtgctggaatcaattcaagttttgcagttcaccaggatgttgatggccgagctaccgatgttgccctaggatggtcagttgctcttggttctccgtttacttttgctactacgcttgagcaggagtacaaaagtgacatcttcggggaacggggcattctgctcggtgccgttcacggaattgtcgaagctctgttcagaagatacactgacaatggaatgagtgaagacttagcttacaagaacacagtggagtgcataactggaactatatcgaggacaatctcaacacagggtatgttggctgtctacaactccttgtccgaggaagaacaaaaagattttcgagactgcctacagtgcttcttactatccttgtatggacatcctctacgaatgttacgaggacgtagcaactggtagtgaaatccgaagtgttgtcttagcgggtcgccgtttctacgaaaaggaaggtttaccggcattcccaatgggaaaaatcgatcagacacgtatgtggaaggtcggtgagcgtgtacggaagaccagaccagctgatgatttgggtccattgtatcccttcaccgcaggtgtatatgttgcacttatgatggctcagatcgaggtattgaggaagaaagggcactcctactcagagatcatcaacgagagtgtgatcgaatccgtggattcgcttaacccgttcatgcatgccaggggagtgtcattcatggttgacaactgctcgaccactgcccgtctgggttcgaggaagtgggcaccgaggttcgactacattctgacccaacaagccctcgtggctgtggacaatggtacgccggtgaacagagacctcgtcagcaacttcttctctgacccagtccatggtgccattgaagtctgcgctcagctcaggcccaccgtcgacatctcggtgcctccggatgccgatttcgtacgacccgagctccgtcagtccggcaactgagatgatcatatcatcgtttctgtaatctgagataatctagttgagatctttagccggagtttgtgttttttgcgtgtcctggaagaaaaccgaaaacacttctgtctcttggaagaag

SEQ ID NO: 2110 - DNA, 1947 bp, Ambrosia trifida
gacactctcattaacgccgccgtctctcctcatcacattcaatcacaccatgacaacagcaacacacaccttctcaaccttaaccccaccacctcctcatcaccttccctcaaaaccccttccaaaaccctagccttttcttctcttccaaaccctccattaaacccctcaaagctcgctccaatggctctgctcttggtgcccgtatggtttcagccccagccatatccaaaccccctactcttcttgattttgatacctctgtttttaaaaaagaaaagattaaccttgctggtcatgatgagtatattgtgagaggtggacgggatttgttccatttgttgcctgatgcttttaaaggtattaagcagattggtgttattggttggggttctcagggtcctgctcaagctcaaaaccttagggattctcttgcagaagcaaagtctgatattgtagtcaagatcggtttacgaaagggttcgagttcgtttaatgaggctcgggctgctggattttcggaagaaagcggaacgcttggagatatctatgagactatctctggtagtgatttggttctgcttttgatttctgattccgctcaggctgataactatgagaaaatcttttcacacatgaagccaaacagcatacttggactttcgcacgggttccttcttggtcatctgcaatcagctgggcttgatttccccaagaacattagtgtggttgctgtgtgtcccaaaggaatgggtccatctgtcaggagactgtatgtacaaggcaaagaggttaacggagccggaatcaatgcaagttttgctgtccaccaggatgttgatggaagagccactgacgttgcacttgcgtggtcggtcgctcttggttcaccttttactttcgccactacacttgagcaggagtataaaagtgatatattcggggagcgaggtattttacttggtgcggtgcatggtattgtggagtctttgtttagaaggtataccgaagatggtatgagtgaagaattggcttacaaaaatacggtggagtgcattactggcattatatcaaagataatctcgactcagggcatgaaggctgtatacgagtcattggacgaagaaggcaagaaagagttcttgacagcgtacagtgcgtcttactatccttgtatggacattctgtacgagtgctatgaggatgtggcgactggcagtgagataagaagcgttgtgttggccggccgtcgattttatgaaaaggagggtctgccagcattccctatgggcaagattgatcaaactcgaatgtggaaagtaggtgaacaggttcgggctgtccgacccgcgggtgatttaggccccttgtatcctttcaccgctggtgtctatgtcgcactaatgatggcccagattgaggtgttgaggaagaaaggacattcttattctgagattatcaatgaaagcttgattgagtcggtggattcattgaacccgttcatgcatgctcgaggcgtgtcgtttatggtggacaactgctcaacaactgcaaggctgggatcaaggaaatgggctccacggtttgattatattcttacccaacaagctttagttgctgtagacaataaagccccagttaaccaggacctgatcagcaacttctttgaagatccagtgcacgacgcggttaaagtttgtgctgagttgagaccgactgttgacatctcagtgcctgctgatgctgattttgccgacctgagctgcgtcaaggtagcaactgagtatgagtcccaggctcttgtctagttaatctgtcatggtgctatgcggtattttttctgttatctgtgtcttcttatgtagtgttgtgttccgtacttttgttgtaattttgtaaattaaaagtttgttacgtcgttagtcgttttgttagaactaaaaaaag

SEQ ID NO: 2111 - DNA, 1993 bp, Ambrosia trifida
tatttttttatttcatttagaacacgacatacacagtaggtgaacacgacgaacacaaaatttaataacggccataattacacaatttcatatcaacatccaacggctgtcattccacctaaccctcactccatcgtccacacaccacatataataattagggttacagacactaacctcagacactctcattaacgccgccgtctctcctcatcacattcatccacaccatgacaacagcaacacacaccttctccaccttaacccccaccacctcctcatcccttccctcaaaacccctaccaaaccctagcctttttcttctcttccaaaccctccattaaacccctcaaagctcgctccaatggctctgctcttggtgcccgtatggtttcagccccagccatatccaaaccccttcccttcttgattttgatacctctgtttttaaaaaagaaaagattaaccttgctggtcatgatgagtatattgtgagaggtggacgtgatttgttccatttgttgcctgatgcttttaaaggtattaagcaaattggtgttattggatggggttctcagggtcctgcacaagctcagaatcttagggattctcttgcagaagcaaagtctgatattgtagtgaagatcggtttacgtaagggttcgagttcgtttaatgaggctcgggccgccggattttcggaggaaagcggaacacttggagatatttatgagactatctctggtagtgatttggttctgcttttgatttctgattccgctcaggctgataactatgagaaaatcttttcacacatgaagccgaacagcatacttggactttcgcacgggttccttcttggtcatctgcaatcagctgggcttgatttccctaagaacattagtgtggttgctgtgtgtcccaaaggaatgggtccatctgtcaggagattgtatgtacaaggcaaagaggttaacggtgccggaatcaatgcaagttttgctgtccaccaggatgttgatggaagagccaccgatgttgcacttgcatggtcagtcgctcttggttcaccttttactttcgccactacacttgagcaggagtataagagtgatatatttggagagcgaggtattttacttggtgcggtgcatggtattgtggagtctttattcagaaggtataccgaagacggtatgagcgaagaattggcttacaaaaatacagtggagtgcattactggcattatatcaaagataatctcgactaagggcatgaaagctgtatacgagtcattggatgaagaaggcaagaaagagttcttgacagcatacagcacctcctactatccttgtatggacattctgtacgagtgctatgaggatgtggcgactggcagtgagataagaagcgttgtgttagccggccgtcgattttatgaaaaggagggtttgccagcattccctatgggcaagattgatcaaactcgaatgtggaaagtaggtgaacaggttcgggctgtccgacccgcgggtgatttaggccccttgtatcctttcaccgctggtgtctatgtcgcactaatgatggcccagattgaggtgttgaggaagaaaggacattcttattctgagattatcaatgaaagcttgattgagtcagtggattcattgaacccgttcatgcatgctcgaggcgtgtcgtttatggtggacaactgctcaacaactgcaaggctgggatcaaggaaatgggctccacggtttgattatattcttacccaacaggcgttagttgctgtagacaataaagccccagttaaccaggacctgatcagcaacttctttgaagatccagtgcacgacgcggttaaagtttgtgctgagttgagaccgactgttgacatctcagtgcctgctgatgctgattttgtccgacctgagctgcgtcaaggtagcaactgagtatgagtcccagggtcttgtctagttaa

SEQ ID NO: 2112 - DNA, 1919 bp, Flaveria ramosissima
tactcaacgcgagagtacatacgggccgtctgcctccgccgtttccctcctccaccacttttccggcaatggcgacggcgaccaccacgttctccaccgtggcccccaccacctcatcatcagcgtctctcaaaatctcccccaaaaccctagggtttaacgtagggtttccgtcgtccaaaacctccaccaaatcgcttaaagctcgttccaatggtggttgtggatctgcaatcggagctcgcatggtatcagcgcctgtgataagcaaacctccaatgcttcttgattttgagacctctgttttcaaaaaggagaagattaaccttgctggtcatgatgagtatattgtgagaggaggtagagatttgtttcatttgttacctgaggcttttaaaggtatcaagcaaattggtgttattggatggggttctcgagggtcctgctcaagctcagaatcttagggattctcttgcagaagcaaaatctgatattgtagtgaagattggcttacgaaaggggtcgagttcatttaacgaggctcgtgctgctggctttactgaggaaagtggaacccttggagatatatatgagactatctctggtagtgacttggttttgctcttaatttctgattcagctcaggctgataattatgagaaaatcttttcccacatgaagccaaacagcattcttggactttcacatgggttccttcttggtcatctgcaatcagttgggcttgatttccccaagaacataagtgtggttgctgtgtgtcccaaaggaatgggtccatctgtcaggaggctgtatgttcaaggaaaagaggtcaatggagccggaatcaatgcaagttttgctgtccatcaggatgttgatggaagagccactgatgttgcacttgcatggtcagttgctcttggctcaccctttacatttgccactacacttgagcaggagtacaggagtgatatattcggggagcgaggtattttacttggagcggtgcatggtatcgtggagtctttgttcagaaggtataccgaaggtggtatgggtgaagatttggcttacaaaaacaccgtagaatgcataactggcataatatcaaagataatatcaactcagggcatgaaagctgtatatgagtcactgacagaagaaggcaaaaaggagttcctgacagcatatagtgcatcttactatccttgtatggacattctgtatgagtgctatgaggatgtggcaactggaagtgagataagaagcgttgtgttggctggccgtcgattttatgaaaaggagggtttgccagcgttccctatgggcaagattgatcagacccgaatgtggaaagtaggtgaacgggttcgagctgcccggcctgcaggtgatttaggcccgttatatcctttcacagctggtgtctatgttgcactaatgatggcccagattgaggtgttgaggaagaaaggacattcttattctgaaatcatcaatgagagcttgatcgagtcggtggattctctgaacccatttatgcatgctcgaggtgtgtcgtttatggtggataactgttcaacaactgcaaggttgggatcaaggaaatgggctccacgctttgattatattcttacccaacaggctttagttgctgtagacaatgaggcgccacttaaccaggacctcatcagcaacttctttgaagatccagtgcatgaagctgtcaaagtttgtgcagagttgagacccactgttgacatctcagtgcccgctgatgctgattttgtcagacccgagcttcgtcaagctagcaactaagtatgactctcaggctcttgtctagtttataattgtgctatgcagtaattttctgtatgattgttgtgttacgactttgttgtaatttggtaaat

SEQ ID NO: 2113 - DNA, 2259 bp, Gossypium raimondii
agttaggctacaaaaggatcggcttaaattacgtgtcgctctctgtttctctatatagcctggccgccctttccgctaaagctgactatcatttctacttctgctacgatggcggctactaccttctcttcttctttctccactccctcgctcaattcgtcctccagaacccacaaaactttaaccacccctaatctaggcttcttggcctcagtgtcgagatccttgaggtctctcaaagcaaccaggctgactactgataatgcttgtggctcagctatggcctctcgtatggtctccattcctgctgtccagacacacatatctctcgattttgagacctctgtcttcaagaaggagaaagtctccctcgctggtcaggacgagtacattgtgagaggaggaagagatttgtttaagttgctgcctgacgctttcaaagggattaagcagattggtgttattggttggggttcgcagggacccgctcaagctcaaaatttaagggattctcttgctgatgcaaaatctgatatcattgtcaaggttggactcaggaagggttctcgttcttttgatgaagctcgtgctgctgggttctctgaagagaatggcactttgggtgatatatgggaaactatttctggaagtgatcttgtgttactgttaatttctgatgctgcacaggcagacaattatgagaagatattctcctacatgaaaccaaatagcatcctggggctttcacatggctttcttcttggacacttgcagtcaaagggacttgattttccaaagaacattagtgtaattgctgtgtgccccaaaggaatgggtccatctgtaaggagactctatgtccaaggcagggagatcaatggtgctggaatcaattctagttttggagtccatcaggatgttgatggtagagctactgatgttgccttggggtggtcggtcgcccttggatcacctttcacctttgctactactttagagcaggaatacaagagtgacatctttggggagcggggcattcttcttggtgctgttcatggaattgtggagtctttgtttagaagatacactgaaaatggaatgagtgaggatcttgcttacaaaaacactgttgaatgcattacaggaattatatcaaagaccatctcaacacagggcatgttggctgtatacaactccttgtccgaagagggaaaaagggaatttgagactgcctatagcgcatcttattacccgtgcatggatatactgtatgagtgctatgaagatgtagccagcggaagtgaaatccgcagtgttgtattggctgggcaacggttttatgagaaggatggtctccctgcttttccaatgggaaaaattgatcagacacgcatgtggaaagttggtgagcgagtccaaaaggcacgcccatctggtgatttagggccattgtatccttttactgccggtgtctatgtggccttgatgatggctcagatcgagatattgaggaagaaaggacactcgtactctgagatcatcaacgagagtgtgatagaggcagtggattccttaaatccatttatgcatgctcgtggagtttccttcatggttgataactgctctaccacagcacgattgggatccaggaaatgggccccacggtttgattacatcctaacccaacaggctttggtggctgtcgacaagggcactcccatcaaccaagatcttctcagcaacttcttgtcagacccagtgcatggtgccatcgaagtctgtgctcaattgaggccgacggttgacatttcagtgacccccgatgctgattttgtgcgaccggagttgcgtcaatctggcaattgagtcggtagaatctcagaactggaatgagcaactatatttatagtgtgtttgagccagaacttgctcgtcatgtatgtagtgatgtagtttttgcaatgtcttggggctggctgtctttttatgtttcatttttaaatgttttatataattgtaggaccaaaaccatcagctgttttgagataatgagacttaataatgcatatctagcttgtttttgggcagttagataatgatgcttaataatgtactccttatttgttttgtggtagtaggttgccaatttcctccggctgttaaaaaattcagagtgaatcggcctgttcaacccgaaatttgtagtttgttaaaaatttcagagggaattagggaataataatcagtctatttgtatga

SEQ ID NO: 2114 - DNA, 2386 bp, Ricinus communis
ttcaaacattatttgcatatctttctcctccaaaagaatctttatcacccgaaaatatttgaattcgaatatgttaaaactcttgaatgtaaaaatatgatataattccaaaatatgatctcttcttttcatcccatttgtttcttcgacaaaacccacaatagaagtattacggtaacggcgcacaatagcaggcaatagaaaataggagacgtatctaactacaaattagtataaaacgactgttacgagtacaagtgtcgtcatccttttagctaaactcactgaaaactagtcgctggaatctctccttctcttctcagctcttatcgtcctcacaaatgtctgccactgcctcattttctgctactcttcctaaaccgacgccgtttctatcaactccgaaatccatctcatcctcctctagtctcagtactttaggatttctttcaattaggtccaagtcctttaagtcgcttagagctaatggcggcggcggttcagctgttggtgcttgtagtatggtctcgatgccagctgttaagcctttgatttctcttgattttgaaactactgttttcaagaaagagaaaatctctcttgctggccatgacgagtacattgtaagaggggggagagatctgttcaagttgctacctgatgctttcaaaggaatcaagcagattggtgttattggttggggttcccagggtcctgctcaagctcagaatttaagggattctctaggagaagccaagtctgatattgtagtaaagattggactcaggaagggatctcgttcatttgctgaagctcgttctgctggttttactgaagagaatgggactttgggtgacatttgggaaactgtttctggcagtgatcttgtactcctattgatatctgatgctgcgcaggctgataattatgagaaagtgttctcccatatgaagccaaacagcatacttggtctttcccatggatttcttcttggacatttgcagtcaatgggactcgacttcccaaagaatattagtgttattgctgtgtgtcccaagggaatgggtccatctgtgaggagactttatgttcaaggcaaagagataaatggtgctggaataaattctagttttgcagtccaccaggatgttgatggtagagccacagatgttgccttgggatggtcggttgcccttggttctcctttcacttttgccactacactagaacaggagtacaagagtgacatctttggagagcgcggcattttacttggcgctgttcatggaatcgtagagtctttatttagacgatacactgaaaacggaatgagtgaagatgaggcttacaagaatactgttgagtgcataacaggaattatatcaaagaccatctcaacccagggcatgttggctgtatacaattccttgtctgaagaaggcaaaaaacagtttgagactgcatacagtgcctcgtattatccttgcatggacatcttgtatgagtgctatgaggatgtagcttgtggtagtgagatccgcagtgttgtcttggctgggcgtcgcttttatgaaagggatggtttgccagctttcccaatgggtaaaattgaccagacacgcatgtggaaggttggtgagcgagttcgatcaactcgggctgcaggggacttaggtcctttagatcctttcactgctggagtctatgtggcactaatgatggctcagattgaaatcttgagaaagaaagggcactcctactctgagatcattaatgagagtgtgatcgagtcggtggattctttgaatccatttatgcatgctcgtggggtttcttttatggttgacaactgctcgacaacagcaagattgggatcaagaaaatgggctcctcgttttgactatatcctcacacagcaagctatggtatcagtggacaatggtactcccgtcaaatgtgatcttatcagcaacttcatgtcagatccagtgcatggtgccatagaggtatgcgcccaattgagacctacagttgacatctcagttcccccagatgccgactttgtgagacctgaattgcgccaatctagcaattgagatctaggggaaaaaaaattttcttcgatcggctagtagaattctaatttgtaaggttgagtgagaagcttgcttccaataacaacttatggtctagtttttagttcttatttgtaaggttgagtgagaaggttgctttgaataacaacttatggtctagttttatgaacttactcgtgtgatgtttgtagtactcaaatatttctatgtacgagacatgtctgtgcgcttctattacatggatgttaaaactgggaaatatatgtgataatacaaaactagaattcctc

SEQ ID NO: 2115 - DNA, 2074 bp, Arabidopsis thaliana
atatctgtctcttggtggtgatgagtaggtaaactgtgtgcgcttattaacttctctcacactgactctgcgaccctaatttgtgagctctcttctctttgcgcagtcaatttgctacaacttagaaaatggcggcggctacttcatccatcgctccttctctttcatgcccatctccttcttcttcatccaaaaccctttggtcttccaaagccagaaccttggctctacccaatatcggtttcctctcgtcttcttccaagtctctgaggtcgcttactgccaccgtcgctggaaatggcgccactggatcctcccttgccgctcgcatggtttcttcgtctgcggtcaaagcccctgtttctctcgattttgagacatctgtcttcaaaaaggagaaagtttctcttgctggttacgaagagtacattgtgagaggaggaagagacttgttcaagcatctcccagatgctttcaaggggattaagcagattggtgtgattggctggggatctcagggacctgcccaggctcagaatttaagggattcacttgtggaggcaaagtctgacattgttgtcaagattggtctcagaaaagggtctcgctcatttgaggaggcacgtgctgctggcttcactgaagaaagtggtactttgggtgatatatgggaaactatcgctggcagtgatcttgtattgcttttgatctctgatgctgctcaagctgataactatgagaaaatattctctcacatgaagccaaacagcattcttggtttatcacacgggtttctactagggcatttacagtcctcgggactcgatttcccaaagaacatcagtgtggtcgctgtatgccctaagggaatgggtccttctgtgaggaggctttacgtccaaggaaaagaaattaacggtgctggaatcaacgccagttttgcagtccaccaggatgttgacggtagagccgccgatgttgcattgggatggtcagtagcacttggttctccgtttacttttgctactactcttgaacaggagtacaggagtgacatctttggagaaagaggaattttgcttggtgctgttcacggaatcgtggagtctctgtttagaagatacaccgaaaatgggatgagtgaagacttggcttacaagaacacagtagaatgcatcacaggaacaatttcaaggactatctctacccagggaatgttggctgtgtacaactccttgtctgaagaaggtaaaaaagattttgagactgcatacagcgcatccttctatccttgtatggagattctctatgaatgttacgaggatgtacaaagtggcagcgaaatccgaagtgttgtcttagccggtcgtcgcttctatgaaaaggaaggcttgccagcattccctatgggaaatattgaccagacaagaatgtggaaggtgggtgaacgcgtcaggaagtccagacctgctggtgacttgggtccattgtatcccttcaccgctggagtttatgtagcacttatgatggctcagattgagatcttgaggaagaaaggtcactcttactcagaaatcatcaacgagagtgtgattgaatccgtggactctctaaacccatttatgcacgccaggggagtgtccttcatggttgacaactgctcaaccacagcaagattgggttcgaggaaatgggcgccacggtttgactacatcctgacccaacaagctcttgtggctgtggacagtggtgcagcaatcaacagagacctaatcagtaacttcttctctgatccagtccatggtgccattgaggtctgcgcacagctcaggcctaccgttgatatctctgtgcctgctgatgcagactttgttcgacctgagttgcgtcaatctagcaactgagtgaagggttgaaagtttgtcagtctcttatttgtaatcggagtattaagtcgagagtttgtgatgttttcttaggcgtgactgtttgttttgtttgaaggattatgtctctttgctttggtcttaaaatctacttaaatcaataaaatagtttaacgaaatttcgcttt

SEQ ID NO: 2116 - DNA, 2002 bp, Brassica napus
gacctaatttgctccctcccgcagacatttgctattacacagagagaagagactcaaatggcggctgcgacttcatccatcgctccttccctctcatgcccatctccttcttcttcctccaaatcccttaggtcctccaaagccacaacctttgctttccccaacatcggttccctctcgtctacttcaaagtctctgaggtccctcactgccaccgtcgctggaaatggtgccggatcttccctctccgcgcgaatggttgcgtcctctgcggttagagcccctatgtctctagatttcgagacgtctgtgttcaaaaaggagaaagtctctcttgctggtcacgaagagtacattgtgagaggaggaagggacttgttcaagcatcttcctgatgctttcaaggggattaagcagattggtgtcattggctggggatctcagggacctgctcaagctcagaatttaagggattcccttgtggaggcaaagtctgacattgttgttaagattgggcttagaaagggctctcgctcatttgaggaagcacgtgctgttggcttcaccgaagaaagcggtactctgggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagtgtggtagctgtttgccctaagggaatgggtccatctgtgagaaggctttatgtccaaggcaaagaaatcaacggtgctggaatcaacgccagttttgctgtccaccaggatgttgacggtagagccgctgatgttgctttgggatggtcagtagcacttggttctccttttacctttgctactactcttgagcaagagtacaagagtgacatctttggtgaaagaggtattttgcttggtgctgttcacggaattgtggagtctctgttcagaaggtacactgaaaatggaatgagtgaagacttggcctacaagaacacagtagagtgcatcacaggaacaatctcaaggactatctctacccagggaatgttggctgtctacaactccttgactgaagaaggcaaaaaggatttcgagactgcatacagtgcatccttctatccttgtatggagatcctctatgaatgctacgaggatgtagcagctggcagcgaaatcaggagtgttgtcttagccggtcgtcgcttctacgataaggagggtttacctgcattcccaatgggaaagattgatcagacaagaatgtggaaggtcggtgaacgcgtcaggaagtccagaccagctggtgacttgggtcccttgtatcccttcaccgctggagtttacgttgccctcatgatggctcagattgagatcttgaggaagaagggtcactcttactcagagatcatcaacgagagtgtgattgagtctgttgattctctgaacccgtttatgcacgctagaggagtgtcgttcatggtggacaactgctcgaccacagcaagattgggatcgaggaaatgggcaccaaggttcgactacaacctgacccaacaagctctggtggctgtggacaatggtgcaccaatcaacaaagacttgatcagcaacttcttcgctgatccagtccatggtgctatccaggtctgcgcagagctcaggcctaccgtggatatctcagtgcctcaagatgcagattttgttcgaccagagctgcgtcagtccaactagagtgtgttatcagtgtttgaaatgttatcagtctctttcctatgtaatcttgttttgaagaaagacgatggttttggaagttgtaggcgtgagtgaatgcttttgtttggactactttaataataatgatgtctctttgtcactttcgaattccattaatgggatgctctcttat

SEQ ID NO: 2117 - DNA, 2060 bp, Cucumis sativus
actcctttgctgactcatccatggccgccgccaccacccatttcgctccctctatctctgcctcttcagccaaaaccctaaagcatgctgctgctctgcaccctctagctccttcctccttatcctttctgtcttcttcttcctctggcctcaacgctctcaaagctgttggtatttctgctgccaatggcatcggctctgctcttggtgctcgcatggtctctgttcctgccatcaagcccttaatctccctcgattttgatacgtctgttttcaagaaggagaaagttaacctcgctggccatgatgagtatattgtcagaggaggcagagatctttttcccttgctgccggaggcctttaaggggatcaagaaaatcggtgtcattggctggggttcacaggctcctgcacaagctcagaatttgagggactcccttgctgaagccaagtctgatattgtggttaagattggtctgaggaagggttcccgctcttttgcagaagctcgtgcagttggattttctgaagagaatggaactttgggtgatatatatgaaactatatccgaaagtgatcttgtcatgcttctgatttctgattctgcacaggctgataactatgagaaaatattttctcacatgaaaccaaacagcattcttggtctttcccatgggtttcttcttggccatttgcagtcatcggggcttgatttccctaagaatatcagcgtgattgctgtttgtccaaaggggatgggtccatctgtgaggagactttatgtgcaaggaaaagaggtcaatggtgcgggaattaattctagttttgcagttcaccaggatgttgatggcagagccacagatgtcgcattgggttggtccattgcacttggttctccattcacatttgctacaacactagagcaagaatacagaagtgacatctttggcgagcgaggtattctacttggtgctgttcatggaattgtggagtccttgttcagaaggtacactgaaaatggaatggcggaagagctggcttacaagaacaccgttgaaagcataacaggaattatatcaaggaccatttccaccaagggaatgttggcagtgtacaattccttctctcctgatgagaaaaaggaattcgagagagcatacagtgcatcatactacccatgtatggatattctctatgaatgttatgaagatgttgccagtggaagtgagatccgcagtgttgtgcttgctggtcgacgattttatgaaaaggagggtctcccagctttcccaatgggcaacattgaccagacccggatgtggaaagttggcgagcgtgtccgacaatcacgtcctgcaggtgaccttggtccgctgtatcctttcactgctggtgtatatgtggcattgatgatggcacagattgagattctgaggaaaaagggccactcttactctgagatcatcaacgaaagtgtgatcgaatcagtcgactctttgaacccgttcatgcatgctcgtggtgtttctttcatggttgacaattgttccacaactgcaagattgggatctcgaaagtgggctcctcgctttgactacattctcacccaacaagctctggttgccattgacaacggttcagccgttaaccaagaccttatcagcaacttcctctctgacccagttcacggagcaattgaagtttgcgcccagttgagacctactgttgacatttctgttccagctgatgccgattttgttcgcccagaactacgtcaaagcaactaaaatgtgccaaccggaactaactagcttgatcatgctggatggactcctgtatgtatctacacaatatgtactgttatcctgatcttcttcaagatctagttttttcaagtttattataagagttagttgagcgcgtggtagtaataaatataatgttcctgagttttcgtggttgttttgcccaagttgttatgtagacctgtgaggattgtgctagaattatcaactactttcatggcttctaatattagtttcatcctaaattccattcta

SEQ ID NO: 2118 - DNA, 2045 bp, Plantago ovata
agtgagccatccgccgcacagtatctctcactcactcactcccattcctaaccctttcgagctcgaaaagccacaccagaaccaaccatggtggctgccaccaccacctccttctccaccaccgccacctctaaagccctcaaatcaacaacaaccaacaacaaggcaatccctcactccttgggctttctctcatcgtcgtctccttccatgaaatccctcagagccgccgtttactcttcccgtgcttccggctcttccatgtcagcagcggctagtatggtctctgcaccttctaccgtcaaggcaccagccaccttcgatttcgacacttccgtcttctccaaggagaaaatcaatttagccggccacgatgagtacatcgtgagaggaggaagaaacttgtttaagctgttgcctgacgcctttaagggcatcaagcagattggtgtcattggctggggttcacagggacctgctcaagctcagaatctgagggattcactatcagaaatcaattctgatattgtcgtgaagattggtctgaggaagggttctcgatcatttgctgaagctcgtggcgctgggtttacagaagagaatgggaccttgggagatatctatgagaccatctctaccagtgatttagtgcttcttttgatatcagattcagctcaggctgataattatgagaaaattttctctcacatgaagccgaacagtattcttggtctgtcccatggatttctgttgggtcatttacaatccatgggacatgatttccctaaggatatcagtgtcattgcagtatgccccaagggaatgggcccttcggtgcgaaggttgtatgtgcaaggaaaagaagttaatggtgctggtattaatgccagttttgctgttcaccaggatgttgatggcagagctacagatgttgctctaggatggtcagttgcccttggttctccgtttacattcgcaactaccctcgagcaggagtacaagagtgacatcttcggggagagaggtattttgcttggtgctgtgcatggtatagtggaatctttatttcgaagatacacagaaaatggaatggctgaggaacttgcttacaagaacactgtcgaaagtatcactggagttatatctaagaccatatcaacacagggtatgctggcagtctataacgcactgagtgaagaaggtaaaagagactttgaagctgcatacagtgcttcatattatccttgcatggatattctatatgagtgctatgaagacgtagccagtggaagtgaaataaggagtgttgtcttggctggacgccgcttctatgaaaaggatggacttcctgcattcccaatgggcaagattgaccagacacgaatgtggaaggtcggtgaacgtgtaagagcaacacgcccggcaggtgacatgggacctctttatcctttcacagcaggtgtcttcgtggcactgatgatggcccagattgaagttcttaggaagaaaggacattcttactctgaaattattaacgagagtgtgattgagtctgtggattcattgaacccattcatgcatgctcgtggtgttgcattcatggttgataactgttcaacaactgctcgcctgggatccaggaaatgggctccaagattcgattacgtccttacccagcaggcacttgttgctgttgacagcaaagccccaattaaccaagatctgattagcaattttatgtcggatccggttcacggtgctattgatgtgtgcgcccagttgaggccaactgtggacatttcagtgcccgcagatgctgattttgtccgtccggagttgagataggccactttggacaatgttactattgtctttagcattttgaaccaagcctagtttgttgagtgattttatctttcgactgtttaatttaagtctgaaccgttttgttgtcttgcatgcgagagactaatgcagtgtgatggtgtttgttataaaataagtatattactgcataatgtactcagcatagcaactttcgttgt

SEQ ID NO: 2119 - DNA, 2060 bp, Solanum tuberosum
tggcttatccctctctgtacactttcatttgtctgctttccacttcacaatcatggcggcggcggcggcgacttccttctccatcaccacttccactcctccttcctcctcctcctcaaccaaatccctaaaaccttctcttgttggtaacttagggtttctatcctcgtcaacaccatcgcttaagcctctcagagctcaagccgccgtttcatctggcagctcaaactccggcggcggcgcgcttgcggttcgcatggtcgccgcacctgctaccgtcaaggctcctgcttcgttcgattttgaaacatccgtttttaagaaggagaaagtaaccctcgctggaaatgatgagtacattgtgaggggagggagagatttgttcaagtatttgcctgatgctttcaaaggaatcaagcagattggagttatcggctgggggtctcagggacctgctcaagcccagaacttgagggattctctcgcagaaataaaatctgacatagttgttaagattggtttaagaaagggttcaagctcatttgcagaggcccgcacagctgggtttactgaagagaacggaacccttggtgacatatacgagactatctctggcagtgatttagtgctgcttttgatttctgatgctgctcaggctgataattatgagaaagtgttctctcacatgaagccaaacagcatacttgggctttcacatggattcctccttggccatttgcagtcaatgggccttgacttcccaaagaacattagtgtgattgctgtatgtcccaagggaatggggccctcagtcaggagattatatgttcaaggaaaagaagtcaatggtgctggaattaattcaagttttgcagttcaccaggatattgatggaagagccacagatgttgctctagggtggtctgttgcccttggttctccctttacttttgctactactctagagcaggaatataaaagtgacatttttggagaacgaggtattttacttggtgctgtccatggagttgtggagtcacttttcagaaggtacactgagaatggaatgaatgaggagcttgcatacaagaacactgtagaatgcataactggagtcatttcaaagaccatatcaacaaagggcatgttggctgtgtacaactcattgactgaggagggcaagagggagtttgaagctgcatacagtgcttcattttacccctgcatggagattttgtatgagtgctatgaagatgtagctacaggtagcgagatcaggagtgttgtcttggctggccgccgcttttatgaaaaggagggcttacctgccttcccaatggggaaaattgatcaaacaaggatgtggaaggttggtgagcgcgtccgagcaacccgaccagccggtgatcttggtcctctgtatcctttcactgctggtgtctttgtggcattgatgatggcccagattgaggttctgaggaagaaaggtcattcttactccgagattatcaatgaaagtgtcattgagtctgtagattcattgaatccgttcatgcacgctcgtggagtatcattcatggttgacaattgctctacaacagcacgtttaggttccaggaagtgggcccctcgatttgattacaacctcacccagcaagcacttgtagctgtggataataatgcccctatcaatcgagatctcatcagtaacttccttgcagatcccgtgcatggagctattaaagtatgtgcggaactgagacccacagttgatatttctgtaacagcagatgctgattttgtccgccccgagctcaggcaatctggcaattaagggatttacgggtcactttgtgagcgagttagaattttgtgtaattgtgaggttgagatttcatattgttgatgtgtgttggtgaaggcaagaatacttaaatctgttagcttataagaatcttagcctttttcgggtactaggcactttctttatgtaaccttttgctgaataacagattcgaaatttgggaacccttttagcaactataaaatgtgggttatgt

SEQ ID NO: 2120 - DNA, 2070 bp, Panicum virgatum
cacttcgccaccccgccgctcgccatctgcttccctgcggctgcgacttcgagacatggcagcgcaaacttcggcggcctcgacccttgccttcgggcaccacaaaaccctagccgccgccgcggtgcccaaaatcctgccggccgcggcctccgtctccttcccggccacccagccggcgtgcctcctctccgcgtccgccgcccgccgccgggatgtcgccgccatggtctcggcgccgccggccgtcggcaccgccatgccgtcgctcgacttcgagaccaccgtcttcaagaaggagaaggtctcgctcgccggccacgaggagtatattgtcaggggcgggaggaacctgttcccgctgctcccggaggcgttcaagggggtcaagcagatcggtgtcattggatggggctcgcagggtcctgcacaagcccagaacctgagagattcactggccgaagcaaagtcagacattgttgtgaagattggtctccggaaaggttccaaatcttttgaggaagcacgtgctgctggattcaccgaagagagtggaaccttgggcgatatttgggagactgtttcaggcagcgatctcgtgttattgttgatatcagatgctgcacaggcagacaactatgagaagatcttctcttacatgaaaccaaatagcattcttggtttatctcatggatttcttctgggacatttgcaatcgcttgggcttgatttcccaaagaacatcagtgtgattgctgtatgccccaagggaatgggtccatccgtccgtaggctttatgttcagggcaaggaagtaaatggagctggcatcaactctagctttgccgtgcaccaggacgttgatggaagggcaactgatgttgctctagcatggtcaattgcacttggctctcccttcacatttgctaccactttggaacaggagtacaagagtgatatctttggagagcggggcattttgctgggtgctgtacatggcattgtggaggctctgtttaggaggtacactgaacagggaatggatgaagagtcagcctacaaaaacactgtcgagggcattactgggattatctcgaaaacaatctcaaagaaggggatgcttgaagtctacaactctttgagcgaggaaggtaagaaggagttcaacaaggcttacagtgcctcattttatccttgcatggatatactcttcgagtgctatgaagatgtggcctccggaagtgaaatccggagcgtggtgttggctgggcggaggttttatgagaaagagggactaccagcatttccaatgggcaacattgatcaaactcgcatgtggaaggttggtgaaaaggtgcgctcgacacgtccagagggcgatcttggcccactgcatcccttcactgctggagtgtacattgctctgatgatggctcagattgagatcctgaggaagaaggggcactcctactcggagatcatcaacgagagcgtgatcgagtcagtggattcgctgaaccccttcatgcatgcccgcggcgtggccttcatggtggacaactgctccacgacggctcgcctaggatccaggaagtgggcgccgcgcttcgactacatcctgacgcagcaggcctttgtgacggtggacaaggatgccccgatcaaccaggacctcatcagcaacttcatgtccgaccccgtgcacggtgccattgaggtctgcgcagagctgaggcccaccgttgacatctccgtccctgccaacgcagactttgtgcgcccggagctccggcagtcttcctagattgaggtggtgcgcagagagaaagagagaaagtttgcctccggagttaagagtgggtggtgtatgtgttgagcgactgcttgaagtcctgaacgtgtgtgagctgctagacctgaggaagtttgggtatttgtttccggaataaaataggcccttcatcgaatagcatgggggagggtctgtgtgaaagttttgtaagaaaagatctgtgtgaaagtatggactgaataagtgatcttgcttcgcatgggttgcgtctgatcatc

SEQ ID NO: 2121 - DNA, 2032 bp, Setaria italica
caaggagccaagtccccaacaaccactcgccgcccgccgctcgccatcccagtgccgcgcgacgacatggcagcgcacacctcggcggcctccaccctcgccttcgggcaccccaaaaccctagccgccgccgccgccgccgggcccaaaaccctgccggccgcggcctccgtctccttcccggccacccagcccgcgtgcctcctctccgcgtcagccacccgccgccgggatgtcgccgccatggtcgcggcgccgtcggccgtcggcacggccatgccgtcgctcgacttcgagacctccgtcttcaagaaggagaaggtctccctcgccggccacgaggagtatattgtgaggggcgggaggaacctgttcccgctgctcccggaggcgttcaagggggtgaagcagatcggagtgattggatggggctcgcagggtcccgcccaagctcagaacctgagggattcactggctgaagcaaagtcggacattgttgtcaagattggtctccggaaaggttccaaatcatttgaggaagcacgtgctgctggattcactgaagagaatggaacattgggtgatatctgggagactgtttcaggcagcgatcttgtgttgctattgatatcagatgctgcacaggcagacaactatgagaagatcttctcgcacatgaaaccgaacagtatccttggtttatcccatggatttcttctgggacatttgcaatcgcttggacttgatttcccaaagaacatcagtgtgattgctgtatgtcccaagggaatgggtccatctgtccgcaggctttatgtccaaggcaaggaagtaaatggtgccggcatcaactctagctttgctgtgcaccaggatgttgatggaagggcaactgatgttgctctagcatggtcagttgcacttggctctcccttcacatttgctactactttagaacaggagtacaagagcgatatcttcggagagcgaggcattttgctgggtgctgtccatggcattgtggaggctctgttcaggagatacacagaacaaggaatggatgaagagtcagcctacaaaaacactgtggagagcatcactggaattgtctcgaagaccatctcaaagaaggggatgcttgaagtctacaactctttaagcgaggaaggcaagaaggagttcaacaaggcttacagtgcctcgttttatccttgcatggatattctctatgagtgctatgaagatgtggcctctggaagtgaaatccgcagcgtggtgttggctgggcgaagattttatgagaaagagggactgccagcttttccaatgggcaacattgatcaaactcgcatgtggaaggttggtgagaaggtgcgctcgacccgtccggagggcgatcttggcccgctgcatcccttcactgctggagtgtacattgccctgatgatggctcagattgagatcctgaggaagaaggggcactcctactcggagatcatcaacgagagcgtgatcgagtcggtggactcgctgaaccccttcatgcacgcccgcggggtggccttcatggtggacaactgctccacaacggctcgcctgggatccaggaagtgggctccccgcttcgactacatcctgacgcagcaggccttcgtgacggtggacaaggacgccccgatcaaccaggacctcatcagcaacttcatgtcggacccagtccacggcgccatcgaggtctgcgctgagctgaggcccaccgtcgacatctccgtgcctgccaacgccgacttcgtgcggccggagctccggcagtcttcctagattgaggtggcgcgctgaggctgagggagggagtttccctccgagttaagagtagtgttgtatgtgttgagcgactgcttgaagtctgaacctgtgtgagctgctaccttgggacctgaggaagcttgggtatctgttccccgaataaaatgagcccttcatcgaataaacttgcaagggtttcttactttctttaaaagtgtggagtgag

SEQ ID NO: 2122 - DNA, 2053 bp, Panicum virgatum
cgtcaccccgccgcgcgccatctcccctgcggctgcgacctgcgactacgagacatggcggcgcaaacttcggcggcctccactcttgccttcgggcgccacaaaaccctagccgccgccgccgccgcggggcccaaacccctgccggccccgggctccgtctccttcccggccgcccagccggcgtgcctcctctccgcgtccgccgcccgccgccgggatgtctccgccatggtctcggcgccgccggccgtcggcaccgccatgccgtcgctcgacttcgagacctccgtcttcaggaaggagaaggtctcgctcgccggccacgaggagtatattgtcaggggcgggaggaacctgttcccgctgctcccggaggcgttcaagggggtaaagcagatcggagtgattggatggggctcgcagggtcctgcacaagctcagaacctgagagattcactggccgaagcaaagtcagacattgttgtgaagattggtctccggaaaggttccaaatcttttgaggaagcacgtgctgctggattcactgaagagagtggaactttgggtgatatttgggagactgtttcaggcagcgatcttgtgttgctgttgatatcagatgctgcacaggctgacaactatgagaagattttctctcacatgaaaccgaatagcattcttggtttatctcatggatttctgctgggacatttgcaatcgcttggacttgatttcccaaagaacatcagtgtgattgctgtatgccccaagggaatgggtccatccgtccgtaggctttatgttcaaggcaaggaagtaaatggtgctggaatcaactctagctttgccgtgcatcaggatgttgatggaagggcaactgatgttgctctagcatggtcagttgcacttggctctcccttcacatttgccaccactttagaacaggagtacaagagcgatatcttcggagagcgaggcattttgctgggtgctgttcatggtatcgtggaggccttgtttaggaggtacacagaacaaggaatggatgaagagtcagcctacaaaaacactgttgagggcatcactgggattatctcgaaaaccatctcaaagaaggggatgcttgaagtctacaactctttgagcgaggaaggcaagaaggagttcaacaaggcttacagtgcctcattttatccttgcatggatatactctacgagtgctatgaagatgtggcctctggaagtgaaatccggagtgttgtgctggctgggcggaggttttatgagaaagagggactaccagcgtttccaatgggcaacattgatcaaactcgcatgtggaaggttggtgaaaaggtgcgctcgacccgtccagagggcgatcttggcccgctgcatcccttcactgctggagtgtacattgctctgatgatggctcagattgagatcctgaggaagaaggggcactcctactcagagatcatcaacgagagcgtgatcgagtcggtggactcgttgaaccccttcatgcacgcccgtggggtggcctttatggtggacaactgctccacaacggctcgcctgggatcaaggaagtgggcgccgcgcttcgactacatcctgacgcagcaggccttcgtgacggtggacaaggacgccccgatcaaccaggaccttattagcaacttcatgtccgaccccgtccatggtgccatcgaggtctgcgccgagctgaggcccaccgtcgacatctcagtgcctgccaatgctgattttgtgcgcccggagctccggcagtctaactagatggaggtggtgagctcagagagaaagtgggagtttgcctccggggttggtgttgtatgtgttgagcttgagccactgcttgaaagtatgaacctgtgtgagctgctggacctgaggaagcttaggtatctgtttcccgaataaacccttcatcgaatagcttgggagtgtatctgtgaaacagtgaaagtgtggagtgaataagtgattgcttcgcatcggttgtgcctgatcatcgatgcct

SEQ ID NO: 2123 - DNA, 1949 bp, Flaveria ramosissima
gttagcccagaccacatataactagggttactgacacacccttcagccacctttgctccgccgttccccctcctccaccacattttccggcaatggcgacggcgacggcgacggcgaccaccaccttctccaccgtagtccccaccacctcatcatcaccgtctctcaaaactctcccccaaaaccctagggtttaacgtagggtttccgttgtctaaaccctcagccaaatcgctcaaagctcgttccaatggtggctgtggttctgctattggagctcgtatggtttcagctccggcgataagcaaacccccaatgcttcttgattttgagacctctgttttcaaaaaggagaagattaaccttgctggtcatgatgagtatattgtgagaggagggagagatttgtttcatttgttgcctgaggcttttaagggtatcaagcagattggtgttattggatggggttctcagggtcctgctcaagctcaaaaccttagggattctcttgcagaagcaaaatctgatatcgttgtgaagattggcttacgaaaggggtcgagttcatttaacgaggctcgtgctgctggctttactgaggaaactggaacccttggagatatatacgagactatctctggcagtgacttggttctgctcttgatttctgattcagctcaggctgataattatgagaaaatcttttctcacatgaagccaaacagcattcttggactttcacatgggttccttcttggtcatctgcaatcagttgggcttgatttccccaagaacataagtgttgttgctgtgtgtcccaaaggaatgggtccatctgtcaggaggttgtatgttcaaggaaaagaggtcaatggagccggaatcaatgcaagttttgccgtccatcaggatgttgatggaagagcgactgatgttgcacttgcatggtcagttgctcttggctcaccctttacattcgccactacacttgagcaggagtacaggagcgatatattcggggagcgaggtattttacttggagcggtgcatgggattgtggagtccttgtttagaaggtatacagaaggtggtatgagtgaagatttggcttacaaaaacaccgtagagtgcattactggcataatatcaaagataatatcgactcagggcatgaaagctgtatacgagtcattgacagaagaaggcaaaaaggagttcttgacagcatacagtgcatcttactatccttgtatggacattctgtatgagtgctatgaggatgtagcgactggaagtgagattagaagcgttgtgttggctggccgtcgattttatgaaaaggagggtttgccagcattccctatgggcaagattgatcagactcgaatgtggaaagtaggtgaacgtgttcgggctgcccgacctgcaggtgatttaggcccattgtatcctttcacggctggcgtctatgttgcactaatgatggcccagattgaggtgttgaggaagaaaggacattcttattctgagatcatcaatgagagcttgatcgagtcggtggattcactgaacccattcatgcatgctcgaggtgtgtcgtttatggtggataactgttcaacaactgcaaggttgggatcaaggaaatgggctccccgctttgattatattctcacccaacaggctttagttgctgtagacaatggtaccccacttaacctaggacctaatcagcaacttctttgaagatccggtgcatgaagctgtcaaagtttgtgcagagttgagacccactgttgacgatctcagttcctgctgatgctgattttgtcagacccgagttgcgtcaagctagcaactaagtattgactcccaggctcttgtctagtttatcattcgtgctatgcagtatttttctgtatgatgtgttatgtacttctgttgttaag

SEQ ID NO: 2124 - DNA, 2145 bp, Brassica rapa
atatttgtctcttggtggtgttgagtaggtaaaagctgagtgtactttaaaaacctcctctatcagcttctgtgtgtgaccctaatttgctctctcccgcagacattttgctattacacagagagaagagactcaaatggcggctgcgacttcatccatcgctccttccctctcatgcccatctccttcttcttcctccaaatcccttaggtcctcgaaagccacaacctttgctttccccaacatcggttccctctcgtctacttcaaagtctctgaggtccctcactgccaccgtcgctggaaatggtgccggatcttccctctccgcgcgaatggttgcgtcctctgcggttagagcccctatgtctctcgatttcgagacgtctgtgttcaaaaaggagaaagtctctcttgctggtcacgaagagtacattgtgagaggaggaagggacttgttcaagcatcttcctgatgctttcaaggggattaagcagattggtgtcattggctggggatctcagggacctgctcaagctcagaatttaagggattcccttgtggaggcaaagtctgacatcgttgttaagattgggcttagaaagggctctcgctcatttgaggaagcacgtgctgttggcttcaccgaagaaaccggtactctcggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagtgtggtagctgtttgccctaagggaatgggtccatctgtgagaaggctttatgtccaaggcaaagaaatcaacggtgctggaatcaacgccagttttgctgtccaccaggatgttgacggtagagccgctgatgttgctttgggatggtcagtagcacttggttctccttttacctttgctactactcttgagcaagagtacaagagtgacatctttggtgaaagaggtattttgcttggtgctgttcacggaattgtggagtctctgttcagaaggtacactgaaaatggaatgagtgaagacttggcctacaagaacacagtagagtgcatcacaggaacaatctcaaggactatctctacccagggaatgttggctgtctacaactccttgactgaagaaggcaaaaaggatttcgagactgcatacagtgcatccttctatccttgtatggagatcctctatgaatgctacgaggatgtagcagctggcagcgaaatcaggagtgttgtcttagccggtcgtcgcttctacgataaggagggtttacctgcattcccaatgggaaagattgatcagacaagaatgtggaaggtcggtgaacgcgtcaggaagtccagaccagctggtgacttgggtcccttgtatcccttcaccgctggagtttacgttgccctcatgatggctcagattgagatcttgaggaagaagggtcactcttactcagagatcatcaacgagagtgtgattgagtctgttgattctctgaacccgtttatgcacgctagaggagtgtcgttcatggtggacaactgctcgaccacagcaagattgggatcgaggaaatgggcaccaaggttcgactacaacctgacccaacaagctctggtggctgtggacaatggtgcaccaatcaacaaagacttgatcagcaacttcttcgctgatccagtccatggtgctatccaggtctgcgcagagctcaggcctaccgtggatatctcagtgcctcaagatgcagattttgttcgaccagagctgcgtcagtccaactagagtgtgttatcagtgtttgaaatgttatcagtctctttcctatgtaatcttgttttgaagaaagacgatggttttggaagttgtaggcgtgagtgaatgcttttgtttggactactttaataataatgatgtctctttgtcactttcgaattccattaatgggatgctctcttatctactttggttaaatcttgttagagagtttactttctagagaagcaaatgactatatttggcta

SEQ ID NO: 2125 - DNA, 2119 bp, Theobroma cacao
ggtgcttgctaaggccaacaattgcagggcaggcccacctggaagctgatttgtagtataaaaggctcccgtgagagaatgcctcgccctctctttcatttgctagcctcgcctccccccttcgcccttacccttgaaagttgaatatctgcttctgctatggcggcggctacttccttctctccctccatctccaccaccccctctcataattcttcctccaaaacgcacaaaaccttagctaccccttctactcttggcttcttgtcctctacttccaaatccttgagttctctcagagctaccagactcacttcccgtaatggatgcggctcagctctcgcctcaaggatggtctccgttcctgctgttaagcctctgacttctctggatttcgagacctccgtcttcaagagggagaaaatctctcttgccggtcacgacgagtacattgtgagaggaggaagggatttgttcaagttgctgcccgatgctttcaaaggaattaagcagattggtgttattggttggggttcacaggggcctgctcaagctcaaaatttgagggattctcttgctgaagcaaaatctgatattgttgtcaagattggacttaggaagggttctcgttcgtttgctgaagctcgagctgctggcttctcagaagagaatggcactttgggtgacatatgggaaactatttctggaagtgatcttgtgttactgttgatttctgacgctgcacaggcggacagtcatgagaagatattctcccacatgaaaccgaatagcatccttgggctttcccatggctttcttcttggacatttgcagtcaaagggacttgatttcccaaagaacattagtgtaattgctgtgtgccccaaaggaatgggtccatctgtgaggagactttatgttcaaggcaaagagatcaatggtgctggaatcaattctagttttggagttcatcaggatgttgatggtagagctactgatgttgccttggggtggtcagttgcccttgggtctcctttcacttttgctactactctagagcaggagtacaagagtgacatttttggggagcggggcattctactcggtgcggttcatggacttgtggagtgtttatttagaagatacacggaaaatggaatgagtgaggatcttgcttacaaaaacactgttgaatgcgttacaggaattatgtcaaagaccatctcaactcagggcatgttgtctgtgtacaattcgttttctgaagagggcaaaaaggaatttgaggcggcctatagtgcctcatattatccatgcatggatatactgtatgagtgctatgaagatgtagccagtggaagcgaaatccgcagtgttgtcttggctgggcaacgcttttatgaaaaggatggtctaccagcttttccgatggggaaaattgatcaaactcgtatgtggaaagttggtgagcgagtccgaaagtcacgaccagcaggtgatctagggccattatatccatttacagctggtgtctatgtggccttgatgatggcacagattgagatcttgaggaagaaagggcactcatactctgagatcatcaatgagagtgtgatagaggcagtggattctttaaatccttttatgcatgctcgtggagtttcgttcatggttgacaactgctctacaacagcacgattgggttcaaggaaatgggcccctcgattcgattacatccttacccaacaggctttggtggcagttgataagggcacccccatcaaccaagatctgatcagcaacttcctgtcagacccggtgcacggtgccattgaagtgtgtgctcagttgaggcccacagttgacatttcagtgcccccagatgctgattttgtgcgaccagagttgcgtcaatctggcaattgagccctagaatctttggaacttgagtgagcaactacttatacaggttgttgaggcaaaaattgcttgaatgtacgagtgatgtagttctacctatatgtgttattgggctagccctatgttttatgtaattgtaggaccaaaattatggttgttttgagttgagaaaataagacgtgggaatgtattttcttac

SEQ ID NO: 2126 - DNA, 1990 bp, Brassica napus
ggtcgtcttgagtagagaggtgtgtgctcgttgtctctccaccctaattagcaatacacactgtgagactcaaaatggcggctgcgacttcatccatcgctccttccctcacatgcccatctgcttcttcctcctccaaagccctcaggtcatcgaaagtctcaacctttgctttccccaacatcggtttcacctcctctgcttccaagtctctgaggtctctctccgccgccgtctccggaaatggcaccggatcttccctcgccgcgagaatggtcgcgtcgtctgcggtcagagcgcctatttctctagacttcgagacgtctgtgttcaaaaaggagaaagtatctcttgctggtcacgaagagtacattgtgagaggaggaagggacttgtttaagcatctccctgatgctttcaaagggattaagcagattggtgtcattggctggggttctcagggacctgctcaagctcagaatttaagggattcacttgtggaggcaaagtctgacattgttgttaagattggtcttagaaagggttctaaatcgtttgaggaggcacgtgctgttggcttcaccgaagaaagtggtactttgggtgatatatgggaaactatctccggcagtgattttgtattgcttttgatctctgatgctgctcaagctgataactatgagaaaatattctcccacatgaaaccaaacagcattctcggtttgtcacacgggttcttactggggcatttacagtcaatgggacttgacttcccaaagaacatcagcgtggtagctgtttgccctaaaggaatgggtccatctgtgagaaggctttatgtccaaggcaaagaagtcaacggtgctggaatcaacgccagttttgctgtccaccaggatgttgatggtagagccgcagatgttgctctaggatggtcagtagcacttggttcgccttttacctttgctactactcttgagcaagagtacaagagtgacatctttggagaaagaggtattttgcttggtgccgttcacggaatagtggagtctctgttcagaaggtacactgagaacggaatgagtgaagacttggcttacaagaacacagtagagtgcatcacaggaaacatttctagaactatctctactcagggaatgttggctgtctacaactccttgtccgaagaaggcaaaaaagatttcgagactgcctacagtgcatccttctatccttgcatggagattctctatgaatgctacgaggatgtagcagctggcagcgagatcaggagtgttgtcttagccggtcgtcgcttctacgataaggagggcttgcctgcctttccaatgggaaagattgatcagacaagaatgtggaaggtcggtgaacgtgtcaggaagtcaagaccagctggtgacttgggtccgttgtatcccttcactgctggagtttacgttgcccttatgatggctcagatcgagatcttgaggaagaagggtcactcttactcagagatcatcaacgagagtgtgattgagtctgttgactctctaaacccgtttatgcatgccagaggagtgtcattcatggtggacaactgctcgaccactgcaagattgggatcgaggaaatgggcaccgagattcgactacaatctgactcaacaagctttggtggctgtggacaatggtgcaccgatcaacaaagacttgatcagcaacttctttgctgatccagtccatggtgctattgaggtgtgtgcacagctcaggcctaccgttgatatctctgtgcctgaagatgctgattttgttcgaccagagctccgtcagtccaactgagtgcaagggttgttaaacttatcagtttctatgaaaatgtaatcgtgttttaaaaaaatgacgagagcttttggaagttgtaggcgtgagaatgttttgtttgaatggtttgaataaatgatgtttctttggagttccacatgtga

SEQ ID NO: 2127 - DNA, 1906 bp, Flaveria ramosissima
ctaacacttgttacttgttactccaccggtgttactcatggcggccgccgcacctaccttctccgccgcacctaccacccaatctccaccgtcgtcgtcatcttcacccactctcaaaacagctcctcaaaccctaggtttcgccacaacgtttctatcatccaaaacctcattcaaatcgcttcaaagtcgcgtgttatctttcaacggtggctccgccctcggagctcgtatggttgcagctccggtgatcagcaagtcgccggtgtctcttgatttcgatacgtcggttttcaaaaaggagaaagtcaacctcgctggtcatgaagagtacattgtgagaggaggtagagatttgtttcatttgttgcctgatgcgtttaaggggattaagcagattggcgtgatcggttggggctctcagggtcctgcacaggcgcagaatttgagggattctcttgctgaagcaaaatctgatattgtagtgaagattggcttaaggaagggttcgagttcatttgctgaggcgcgtgctgctggtttcagtgaagaaaatgggactcttggagatatttatgagactatttctggtagtgatttggtcctgctcttgatatctgattcagctcaggctgataattatgagaaaatcttctcccacatgaaaccaaacagcatccttggactttcccatggtttccttcttggtcatttacaatcaatcggtcttgatttccccaaaaatgttagtgtggttgctgtgtgtcccaaaggaatggggccatcagttagaaggctatatgttcaaggaaaagagatcaatggtgccgggattaatgcaagttttgctgtccatcaggatgtcgatggcagagccactgatgttgcactaggatggtcagttgctcttggttcaccttttacatttgctactaccctagaacaggagtataaaagtgatatattcggtgaaagaggtattttacttggtgctgtgcatggtattgtggagtcattatttagaaggtacacagagcaaggtatgactgaagatttggcttacaagaacactgtagaatgcataaccggagtaatttcaaagaccatatcgaccaagggtatgaaagctgtctatgagtcactctcagaagaaggcaagaaagatttcttgattgcatacagtgcttcgtattatccctgcatggaaatcttgtacgagtgttatgaggatgtggctagtggcagtgagatcaggagtgttgttttggctggccgccgcttttatgaaaaagagggtctaccagccttcccaatgggtaaaattgatcaaacccgcatgtggaaagttggcgaacgggttcgcgctacacgacctgctggcgatttaggcccgctgtatcctttcacagcaggtgtctacgtggcgctaatgatggcccagattgaggtactgaggaagaaagggcactcttattctgaaatcatcaacgaaagtctaatcgaatctgtggattcattgaaccctttcatgcatgctcgaggtgtctcgttcatggtggacaactgctccaccactgcacggttagggtcaaggaaatgggctccacggttcgactacaatctgacccaacaggccttggtagcagtagacaatggcaccccagtgaaccaggaccttgttaaagccttctttgaagatccggttcatgaagcagtcaaagtgtgcgcagagttgagacccacggtcgacatctcggtgcctgcagatgctgattttgtgagacctgagctgcgtcaatctagcaactagaaagagatggattagtcatttgcatttacacatgccatggtgttatgttatgtatgaaagttgttgttatggatatgattctggtggtttgttgaa

SEQ ID NO: 2128 - DNA, 1960 bp, Brassica rapa
tgctctctcccgcagacattttgctattacacagagagaagagactcaaatggcggctgcgacttcatccatcgctccttccctctcatgcccatctccttcttcttcctccaaatcccttaggtcctcgaaagccacaacctttgctttccccaacatcggttccctctcgtctacttcaaagtctctgaggtccctcactgccaccgtcgctggaaatggtgccggatcttccctctccgcgcgaatggttgcgtcctctgcggttagagcccctatgtctctcgatttcgagacgtctgtgttcaaaaaggagaaagtctctcttgctggtcacgaagagtacattgtgagaggaggaagggacttgttcaagcatcttcctgatgctttcaaggggattaagcagattggtgtcattggctggggatctcagggacctgctcaagctcagaatttaagggattcccttgtggaggcaaagtctgacatcgttgttaagattgggcttagaaagggctctcgctcatttgaggaagcacgtgctgttggcttcaccgaagaaaccggtactctcggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagtgtggtagctgtttgccctaagggaatgggtccatctgtgagaaggctttatgtccaaggcaaagaaatcaacggtgctggaatcaacgccagttttgctgtccaccaggatgttgacggtagagccgctgatgttgctttgggatggtcagtagcacttggttctccttttacctttgctactactcttgagcaagagtacaagagtgacatctttggtgaaagaggtattttgcttggtgctgttcacggaattgtggagtctctgttcagaaggtacactgaaaatggaatgagtgaagacttggcctacaagaacacagtagagtgcatcacaggaacaatctcaaggactatctctacccagggaatgttggctgtctacaactccttgactgaagaaggcaaaaaggatttcgagactgcatacagtgcatccttctatccttgtatggagatcctctatgaatgctacgaggatgtagcagctggcagcgaaatcaggagtgttgtcttagccggtcgtcgcttctacgataaggagggtttacctgcattcccaatgggaaagattgatcagacaagaatgtggaaggtcggtgaacgcgtcaggaagtccagaccagctggtgacttgggtcccttgtatcccttcaccgctggagtttacgttgccctcatgatggctcagattgagatcttgaggaagaagggtcactcttactcagagatcatcaacgagagtgtgattgagtctgttgattctctgaacccgtttatgcacgctagaggagtgtcgttcatggtggacaactgctcgaccacagcaagattgggatcgaggaaatgggcaccaaggttcgactacaacctgacccaacaagctctggtggctgtggacaatggtgcaccaatcaacaaagacttgatcagcaacttcttcgctgatccagtccatggtgctatccaggtctgcgcagagctcaggcctaccgtggatatctcagtgcctcaagatgcagattttgttcgaccagagctgcgtcagtccaactagagtgtgttatcagtgtttgaaatgttatcagtctctttcctatgtaatcttgttttgaagaaagacgatggttttggaagttgtaggcgtgagtgaatgcttttgtttggactactttaataataatgatgtctctttgtc

SEQ ID NO: 2129 - DNA, 1944 bp, Tragopogon dubius
ttgcctttgctcagacaacactcagccgtttctcctcatctattacacttgtagacgataatggcggcggccacaacctctttctccaccttggcacctaccgcttcatcgtcggcagcgtcggcttctctcaaggtcgctcccaaaaccctagggtttaacgtgggatttctttcttccaaaactccctccaaatccctcaaagttcgctctaatggcgggtgtggatctgctctcggggctcgtatggtttctgcgccagcaataaccaaacctcccacgctgcttgatttcgaaacatcggttttcaaaaaggagaagattaacctcgctggttatgatgagtatattgtgagaggaggaagagatttgttccatttgttgcctgatgccttcaaaggtatcaaacagattggtgttatcggatggggctctcagggtcctgctcaagctcaaaatctcagggattcccttgttgaagcaaaatctgatattgtagtgaagattggattacgaaagggttcaagctcttttaacgaggcccgtgctgctggctttactgaagaaaatggaaccctaggagatatttatgagactatctctggcagtgacttggttctgcttctaatttctgattcagctcaggctgataactatgagaaaatcttctcccacatgaaaccaaacagcatccttggactttcccacggattccttctaggtcaccttcaatcagccggccttgatttccccaagaacataagtgtggttgctgtttgccccaaaggaatgggtccatcagtaagaagactctacgttcaaggaaaagagataaacggagctggaatcaacgcaagttttgcagtccatcaggatgttgatggaagagccactgatgttgcacttgcatggtcggtagctctcggttcacctttcacatttgccactacactcgagtcagagtacaggagtgatatattcggggaacgaggtattttacttggtgcggttcatggtattgtggagtctttgtttagaaggtacacagaaggcggtatgaccgaagaattggcatacaaaaacaccgtcgaatgcatcaccggaaacatatcaagaacaatatcaactcagggaatgaaagccgtatatgagtcgttatcggaagaaggcaagaaagagtttttaaccgcatacagtgcctcatactatccatgcatggacattttgtacgagtgctatgaagatgtagccagtggtagtgaaatccgaagcgttgtgttggccggtcgtcgattttatgaaaaggaggggctaccagcttttcccatgggcaagattgaccagacccgaatgtggaaagtgggtgagcgtgttcgtgcggtccgacccgcgggtgatttaggcccgttatacccattcacagcgggtgtatacgttgcactaatgatggcccagatcgaggtgttgagaaagaaagggcattcgtattctgaaatcattaacgaaagtttgattgagtcggttgattcgttgaacccgttcatgcatgcacgcggtgtgtcgttcatggtggacaactgttcaacaaccgcgagacttggatcgaggaagtgggctccgcggtttgactatgtgctgacccaacaggcgttggttgcggttgacaacgggagcgcgcttaaccaggatttgattagcaacttttttgaggatccggttcatgaagcggttaaggtttgtgcggagttgagacctacggttgacatatctgatgctgattttgttagaccagagttgcgtcaagctagcaactagggtttggtttgtgtggaatgtttgtgttgtgatgtttttgcttttgatggagtttgttggattttatgattttctaataatggaagttgcccggtcttgcggttgtaccaaaaaaaaaaaaaaaaaaag

SEQ ID NO: 2130 - DNA, 2037 bp, Gossypium hirsutum
agactatcatttctacttctgttacgatggcggctactaccttctctccttccttctccactccctcggtcaattcttcctccagagcccacaaaactttaaccaaccctaatctaggctttttggcctcagtttcgagatccttgaggtctctcaaagcaaccaggctgactactgataatgcttgtggctcagctatggcctctcgtatggtctccgttcctgccgtccagacacacatatctctcgattttgagacctttgtcttcaagaaggagaaagtctccctcgctggtcaggacgagtacattgtgagaggaggaagagatttgtttaagttgctgcctgacgctttcaaagggattaagcagattggtgttattggttggggttcgcagggacccgctcaagctcaaaatttaagggattctcttgctgatgcaaaatctgatatcattgtcaaggttggactcaggaagggttctcgttcttttgatgaagctcgtgctgctgggttctctgaagagaatggcactttgggtgatatatgggaaactatttctggaagtgatcttgtgttactgttaatttctgatgctgcacaggcagacaattatgagaagatattctcctacatgaaaccaaatagcatcctggggctttcacatggctttcttcttggacacttgcagtcaaagggacttgattttccaaagaacattagtgtaattgctgtgtgccccaaaggaatgggtccatctgtaaggagactctatgtccaaggcagggagatcaatggtgctggaatcaattctagttttggagtccatcaggatgttgatggtagagctactgatgttgccttggggtggtcggtcgcccttggatcacctttcacctttgctactactttagagcaggaatacaagagtgacatctttggggagcggggcattcttcttggtgctgttcatggaattgtggagtctttgtttagaagatacactgaaaatggaatgagtgaggatcttgcttacaaaaacactgttgaatgcattacaggaattatatcaaagaccatctcaacacagggcatgttggctgtatacaactccttgtccgaagagggaaaaagggaatttgagactgcctatagcgcatcttattacccgtgcatggatatactgtatgagtgctatgaagatgtagccagcggaagtgaaatccgcagtgttgtattggctgggcaacggttttatgagaaggatggtctccctgcttttccaatgggaaaaattgatcagacacgcatgtggaaagttggtgagcgagtccaaaaggcacgcccatctggtgatttagggccattgtatccttttactgccggtgtctatgtggccttgatgatggctcagatcgagatattgaggaagaaaggacactcgtactctgagatcatcaacgagagtgtgatagaggcagtggattccttaaatccatttatgcatgctcgtggagtttccttcatggttgataactgctctaccacagcacgattgggatccaggaaatgggccccacggtttgattacatcctaacccaacaggctttggtggctgtcgacaagggcactcccatcaaccaagatcttctcagcaacttcttgtcagacccagtgcatggtgccatcgaagtctgtgctcaattgaggccgacggttgacatttcagtgacccccgatgctgattttgtgcgaccggagttgcgtcaatctggcaattgagtcggtagaatctcagaactggaatgagcaactatatttatagtgtgtttgagccagaacttgctcgtcatgtatgtagtgatgtagtttttgcaatgtcttggggctggctgtctttttatgtttcatttttaaatgttttatataattgaaggaccaaaaccatcagctgttttgagataatgagacttaataatgcatatctagcttgtttttgggtagttggataatgatgcttaataatgtacttctt

SEQ ID NO: 2131 - DNA, 2093 bp, Gossypium hirsutum
aagctgactatcatttctacttctgctacgatggcggctactaccttctcttcttctttctccactccctcgctcaattcttcctccagaacccacaaaactttaaccacccctaatctaggcttcttggcctcagtgtcgagatccttgaggtctctcaaagcaaccaggctgactactgataatgcttgtggctcagctatggcctctcgtatggtctccattcctgctgtccagacacacatatctctcgattttgagacctttgtcttcaagaaggagaaagtctccctcgctggtcaggacgagtacattgtgagaggaggaagagatttgtttaagttgctgcctgacgctttcaaagggattaagcagattggtgttattggttggggttcgcagggacccgctcaagctcaaaatttaagggattctcttgctgatgcaaaatctgatatcattgtcaaggttggactcaggaagggttctcgttcttttgatgaagctcgtgctgctgggttctctgaagagaatggcactttgggtgatatatgggaaactatttctggaagtgatcttgtgttactgttaatttctgatgctgcacaggcagacaattatgagaagatattctcctacatgaaaccaaatagcatcctggggctttcacatggctttcttcttggacacttgcagtcaaagggacttgattttccaaagaacattagtgtaattgctgtgtgccccaaaggaatgggtccatctgtaaggagactctatgtccaaggcagagagatcaatggtgctggaatcaattctagttttggagtccatcaggatgttgatcgtagagctactgatgttgccttggggtggtcggtcgcccttggatcacctttcacttttgctactactttagagcaggaatacaagagtgacatctttggggagcggggcattcttcttggtgctgttcatggaattgtggagtctttgtttagaagatacactgaaaatggaatgagcgaggatcttgcttacaaaaacattgttgaatgcattacaggaattatatcaaagaccatctcaacacaggggatgttggctgtatacaactccttgtccgaagagggaaaaagggaattcgagactgcctatagcgcatcttattacccgtgcatggatatactgtatgagtgctatgaagatgtggccagcggaagtgaaatccgcagtgttgtattggctgggcaacggttttatgagaaggatggtcttcccgcttttccaatgggaaaaattgatcagacacgcatgtggaaagttggtgagcgagtccgaaaggcacgcccatctggtgatttagggccattgtatccttttactgccggtgtctatgtggccttgatgatggctcagattgagatattgaggaagaaaggacactcgtactctgagatcatcaacgagagtgtgatagaggcagtggattccttaaatccatttatgcatgctcgtggagtttccttcatggttgataactgctctaccacagcacgattgggatccaggaaatgggcccctcggtttgattacatcctaacccaacaggctttggtggctgtcgacaagggcactcccatcaaccaagatcttctcagcaacttcttgtcagacccagtgcatggtgccatcgaagtctgtgctcaattgaggccgacagttgacatttcagtgacccccgatgctgattttgtgcgaccagagttgcgtcaatctggcaattgagtcggtagaatctcagaacttgaatgagcaactatatttatggtgtgtttgagccagaacttgctcgtcatgtatgtagtgatgtagtttttgctatgtcttagggctggctgtctttttatgtttctttttttaaatgttttaaataattgtaggaccaaaaccatcagctttttttgagataatgagacttaataatgtatttctagcttgtttttgggcagttagataatgatgcttaataatgtactccttatttgttttgtggtagtaggttgttcatttccaaaaaaaaaaaaaaccta

SEQ ID NO: 2132 - DNA, 1906 bp, Brassica napus
gcgacttcatccatcgctccttccctctcatgcccatctccttcttcttcctccaaagcccttaggtcatcgaaagccacaacctttgctttccccaacatcggttccctctcgtctacttccaagtctctgaggtccctcactgccaccgtcgctggaaatggtaccggatcttccctctccgcgcgaatggttgcttcgtctgcggttagagcccctatgtctctagatttcgagacgtctgtgttcaaaaaagagaaagtctctcttgctggtcacgaagagtacattgtgagaggaggaagggacttgttcaagcatcttcctgatgctttcaaagggattaagcagattggtgtcattggctggggatctcagggacctgctcaagctcagaatttaagggattcccttgtggaggcaaagtctgacatcgttgttaagattgggcttagaaagggctctcgctcatttgaggaagcacgtgctgttggcttcaccgaagaaaccggtactctcggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagcgtggtagctgtttgccctaagggaatgggtccatccgtgagaaggctttatgtccaaggcaaagaaatcaacggtgctggaatcaacgccagttttgctgtccaccaggatgttgacggtagagccgccgatgttgctctgggatggtcagtagcacttggttctccttttacttttgctactactcttgagcaagagtacaagagtgacatctttggtgaaagaggtatcctgcttggtgctgttcacggaatcgtggagtccctgttcagaaggtacaccgaaaatggaatgagtgaagacttagcttacaagaacacagtagagtgcatcacaggaacaatctcaaggactatctctacccagggaatgttggctgtgtacaactccttgtctgaagaaggcaaaaaggactttgagattgcatacagtgcatccttctatccttgtatggagatcctctatgaatgctacgaggatgtagcagctggcagcgaaatcaggagtgttgtcttagccggtcgtcgcttctacgataaggagggtttgcctgcattcccaatgggaaagattgatcagacaagaatgtggaaggtcggtgaacgtgtcaggaagtccagaccagctggtgacttgggtcccttgtatcccttcacagcaggagtttacgttgcccttatgatggctcagatcgagatcttgaggaagaagggtcattcctactcagagatcatcaacgagagtgtcattgagtctgttgattctctgaacccctttatgcacgctagaggagtgtccttcatggtggacaactgctcgaccacagcaaggttgggatcgaggaaatgggcaccaaggttcgactacaacctgacccaacaagctctggtggctgtggacaatggtgcaccaatcaacaaagacttgatcagcaacttcttcgctgatccagtccatggtgctatccaggtctgtgcagagctcaggcctaccgtggatatctcagtgcctcaagatgcagattttgttcgaccagagctgcgtcagtccaactagagtgttatcagtgtttgaaatgttatcggtctcttttaatgtactcgtgtgtttggaagaaagacaatggttttggaagttgtaggcgtgagtgagtgaatgtttttgtttggactactttaataataatgatttctctttgtct

SEQ ID NO: 2133 - DNA, 1934 bp, Brassica napus
ccctctcgtctacttcaaagtctctgaggtccctcactgccaccgtcgctggaaatggtaccggatcttccctctccgcgcgaatggttgcgtcgtctgcggttagagcccctatgtctctagatttcgagacgtctgtgttcaaaaaggagaaagtctctcttgctggtcacgaagagtacattgtgagaggaggaagggacttgttcaagcatcttcctgatgctttcaaggggattaagcagattggtgtcattggctggggatctcagggacctgctcaagctcagaatttaagggattcccttgtggaggcaaagtctgacattgttgttaagattgggcttagaaagggctctcgctcatttgaggaagcacgtgctgttggcttcaccgaagaaagcggtactctgggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagtgtggtagctgtttgcccctaagggaatgggtccatctgtgagaaggctttatgtccaaggcaaagaaatcaacggtgctggaatcaacgccagttttgctgtccaccaggatgttgatgggagagccgctgatgttgctctgggatggtcagtagcacttggttctccttttacttttgcaactactcttgagcaagagtacaagagtgacatctttggagaaagaggtatcttgcttggtgctgttcacggaatcgtggagtccctgttcagaaggtacactgaaaatggaatgagtgaagacttagcttacaagaacacagtagagtgcatcacaggaacaatctcaaggactatctctacccagggaatgttggctgtctacaactccttgactgaagaaggcaaaaaggatttcgagactgcatacagtgcatccttctatccatgtatggagatcctctatgaatgttacgaggatgtagcagctggcagcgaaatcaggagtgttgtcttagccggtcgtcgcttctacgataaggagggcttgcctgcattcccaatgggaaagattgatcagacaagaatgtggaaggtcggtgaacgcgtcaggaagtccagaccagctggtgacttgggtcccttgtatcccttcaccgctggagtttacgttgccctcatgatggctcagattgagatcttgaggaagaagggtcactcctactcagagatcatcaacgagagtgtgatcgagtctgttgattctctgaacccgtttatgcacgctagaggagtgtccttcatggtggacaactgctcgaccacagcaaggttgggatcgaggaaatgggcaccaaggtttgactacaacctgacccaacaagctctggtggctgtggacaatggtgcaccaatcaacaaagacttgatcagcaacttcttcgctgatccagtccatggtgctatccaggtctgcgcagagctcaggcctaccgtggatatctcagtgcctcaagatgcagattttgttcgaccagagctgcgtcagtccaactagagtgttatcagtgtttgaaatgttatcagtctctttcctatgtaatcgtgttttgaagaaagactatggttttggaagttgtaggcgtgagtgaatgtttttgtttggactactttaataataatgatgtctctttgttctctttcgtaattacctattaattagggagtgtttcttcttattcttattctactttggtttaaatacttgttagtagagtttactttcttttgttcgtttggtggcggagacgacacgacggaggtaggtagcccccc

SEQ ID NO: 2134 - DNA, 2175 bp, Gossypium hirsutum
gactatcatttctacttctgttacgatggcggctactaccttctctccttccttctccactccctcggtcaattcttcctccagagcccacaaaactttaaccaaccctaatctaggctttttggcctcagtttcgagatccttgaggtctctcaaagcaaccaggctgactactgataatgcttgtggctcagctatggcctctcgtatggtctccgttcctgccgtccagacacacatatctctcgattttgagacctttgtcttcaagaaggagaaagtctccctcgctggtcaggacgagtacattgtgagaggaggaagagatttgtttaagttgctgcctgacgctttcaaagggattaagcagattggtgttattggttggggttcgcagggacccgctcaagctcaaaatttaagggattctcttgctgatgcaaaatctgatatcattgtcaaggttggactcaggaagggttctcgttcttttgatgaagctcgtgctgctgggttctctgaagagaatggcactttgggtgatatatgggaaactatttctggaagtgatcttgtgttactgttaatttctgatgctgcacaggcagacaattatgagaagatattctcctacatgaaaccaaatagcatcctggggctttcacatggctttcttcttggacacttgcagtcaaagggacttgattttccaaagaacattagtgtaattgctgtgtgccccaaaggaatgggtccatctgtaaggagactctatgtccaaggcagggagatcaatggtgctggaatcaattctagttttggagtccatcaggatgttgatggtagagctactgatgttgccttggggtggtcggtcgcccttggatcacctttcacctttgctactactttagagcaggaatacaagagtgacatctttggggagcggggcattcttcttggtgctgttcatggaattgtggagtctttgtttagaagatacactgaaaatggaatgagtgaggatcttgcttacaaaaacactgttgaatgcattacaggaattatatcaaagaccatctcaacacagggcatgttggctgtatacaactccttgtccgaagagggaaaaagggaatttgagactgcctatagcgcatcttattacccgtgcatggatatactgtatgagtgctatgaagatgtagccagcggaagtgaaatccgcagtgttgtattggctgggcaacggttttatgagaaggatggtctccctgcttttccaatgggaaaaattgatcagacacgcatgtggaaagttggtgagcgagtccaaaaggcacgcccatctggtgatttagggccattgtatccttttactgccggtgtctatgtggccttgatgatggctcagatcgagatattgaggaagaaaggacactcgtactctgagatcatcaacgagagtgtgatagaggcagtggattccttaaatccatttatgcatgctcgtggagtttccttcatggttgataactgctctaccacagcacgattgggatccaggaaatgggccccacggtttgattacatcctaacccaacaggctttggtggctgtcgacaagggcactcccatcaaccaagatcttctcagcaacttcttgtcagacccagtgcatggtgccatcgaagtctgtgctcaattgaggccgacggttgacatttcagtgacccccgatgctgattttgtgcgaccggagttgcgtcaatctggcaattgagtcggtagaatctcagaactggaatgagcaactatatttatagtgtgtttgagccagaacttgctcgtcatgtatgtagtgatgtagtttttgcaatgtcttggggctggctgtctttttatgtttcatttttaaatgttttatataattgaaggaccaaaaccatcagctgttttgagataatgagacttaataatgcatatctagcttgtttttgggtagttggataatgatgcttaataatgtacttcttgtttgtttttggtagtaggttgccaatttcctccggctgttaaaaaattcagagtgaatcggcctgttcaacccgaaatttgtagtttgttaaaaatttcagacggaattagggaataataatcagtctatttgtatga

SEQ ID NO: 2135 - DNA, 1898 bp, Flaveria ramosissima
cccatgccacatataactagggctactgacacccctcagctacctttgctccgccgttccccctcctccaccacattttccggcaatggcgacggcgacggccaccaccaccttctccaccgtgtcccccaccacctcatcatcaccgtctctcaaaatctcccccaaaaccctagggtgtaacgtagggttttcgttgtccaaaacctccaccaaatcgctcaaagctcgttccaatggtggctgtggttctgctattggagctcgtatggtttcagctccggcgataagcaaacccccaatgcttcttgattttgagacctctgttttcaaaaaggagaagattaaccttgctggtcatgatgagtatattgtgagaggagggagagatttgtttcatttgttgcctgaggcttttaagggtatcaagcagattggtgttattggatggggttctcagggtcctgctcaagctcaaaaccttagggattctcttgcagaagcaaaatctgatatcgttgtgaagattggcttacgaaaggggtcgagttcatttaacgaggctcgtgctgctggctttactgaggaaactggaacccttggagatatatacgagactatctctggcagtgacttggttctgctcttgatttctgattcagctcaggctgataattatgagaaaatcttttctcacatgaagccaaacagcattcttggactttcacatgggttccttcttggtcatctgcaatcagttgggcttgatttccccaagaacataagtgttgttgctgtgtgtcccaaaggaatgggtccatctgtcaggaggttgtatgttcaaggaaaagaggtcaatggagccggaatcaatgcaagttttgccgtccatcaggatgttgatggaagagcgactgatgttgcacttgcatggtcagttgctcttggctcaccctttacattcgccactacacttgagcaggagtacaggagcgatatattcggggagcgaggtattttacttggagcggtgcatggtattgtggagtctttgtttagaaggtatacagaaggtggtatgagtgaagatttggcttacaaaaacaccgtagagtgcattactggcacaatatcaaagataatatcgactcagggcatgaaagctgtatacgaatcattgacagaagaaggcaaaaaggagttcttgacagcatacagtgcagcttactatccttgtatggacattctgtatgagtgctatgaggatgtggcgactggaagtgagataagaagcgttgtgttggctggccgtcgattttatgaaaaggagggtttgccagcattcccaatgggcaagattgatcagactcgaatgtggaaagtaggtgaacgggttcgggctgcccgacctgcaggtgatttaggcccattatatcctttcacagctggtgtctatgttgcactaatgatggcccagattgaggtgttgaggaagaaaggacattcttattctgagatcatcaatgagagcttgatcgagtcggtggattcactgaacccattcatgcatgctcgaggtgtgtcgtttatggtggataactgttcaacaactgcaaggttgggatcaaggaaatgggctccccgctttgattatattctcacccaacaggctttagttgctgtagacaatggtaccccacttaaccaggacctaatcagcaacttctttgaagatccggtgcatgaagctgtcaaagtttgtgcagagttgagacccactgttgacatctcagttcctgctgatgctgattttgtcagacccgagttgcgtcaagctagcaactaagtattgactcccaggctcttgtctagtttatcattgtgctatgcagtatttt

SEQ ID NO: 2136 - DNA, 1969 bp, Brassica rapa
ggagtagagaggtgtgtgctcgttgtctctccaccctaattagcaatacacactgtgagactcaaaatggcggctgcgacttcatccatcgctccttccctcacatgcccatctgcttcttcctcctccaaagccctcaggtcatcgaaagtctcaacctttgctttccccaacatcggtttcacctcctctgcttccaagtctctgaggtctctctccgccgccgtctccggaaatggcaccggatcttccctcgccgcgagaatggtcgcgtcgtctgcggtcagagcgcctatttctctagacttcgagacgtctgtgttcaaaaaggagaaagtatctcttgctggtcacgaagagtacattgtgagaggaggaagggacttgtttaagcatctccctgatgctttcaaagggattaagcagattggtgtcattggctggggttctcagggacctgctcaagctcagaatttaagggattcacttgtggaggcaaagtctgacattgttgttaagattggtcttagaaagggttctaaatcgtttgaggaggcacgtgctgttggcttcaccgaagaaagtggtactttgggtgatatatgggaaactatctccggcagtgatcttgtattgcttttgatctctgatgctgctcaagctgataactatgagaaaatattctcccacatgaaaccaaacagcattctcggtttgtcacacgggttcttactggggcatttacagtcaatgggacttgacttcccaaagaacatcagcgtggtagctgtttgccctaaaggaatgggtccatctgtgagaaggctttatgtccaaggcaaagaagtcaacggtgctggaatcaacgccagttttgctgtccaccaggatgttgatggtagagccgcagatgttgctctaggatggtcagtagcacttggttcgccttttacctttgctactactcttgagcaagagtacaagagtgacatctttggagaaagaggtattttgcttggtgccgttcacggaatagtggagtctctgttcagaaggtacactgagaacggaatgagtgaagacttggcttacaagaacacagtagagtgcatcacaggaaacatttctagaactatctctactcagggaatgttggctgtctacaactccttgtccgaagaagtgttaaaaaagatttcgagactgcctacagtgcatccttctatccttgtatggagattctctatgagtgctacgaggacgtagcagctggcagcgagatcaggagtgttgtcttagccggtcgtcgcttctacgataaggagggcttgcctgcctttccaatgggaaagattgatcagacaagaatgtggaaggtcggtgaacgtgtcaggaagtctagaccagctggtgacttgggtccgttgtatcccttcactgctggagtttacgttgcccttatgatggctcagatcgagatcttgaggaagaagggtcactcttactcagagatcatcaacgagagtgtgattgagtctgttgactctctaaacccgtttatgcatgccagaggagtgtcattcatggtggacaactgctcgaccactgcaagattgggatcgaggaaatgggcaccgagattcgactacaatctgactcaacaagctttggtggttgtggacaatggtgcaccgatcaacaaagacttgatcagcaacttctttgctgatccagtccatggtgctattgaggtgtgtgcacagctcaggcctaccgtcgatatctctgtgcctgaagatgctgatttcgttcgaccagagctgcgtcagtccaactgagtgcaagggttgttaaacttatcagtttctatgaaaatgtaatcgtgttttaaaaaaatgacgagagcttttggaagttgtaggcgtgagaatgttttgtttgaatggtttgaataaatgatgtttctttg

SEQ ID NO: 2137 - DNA, 1993 bp, Panicum virgatum
tcacgccgtcacgcttcaccctagtccctcccaaatggcggcggccacctcctccaccaccacccacctcgccgtcgcccgcaaaaccctaaaccacgccccctccggagccccaggccgccgccgccggctccgtctccttccccgccgcgcaggccccatgccgcctcgccgcctccgcgggctgccgccgcaccgtggccgcgaaggtcgcgtcgccgtcggtcgtcggcaccgccatgccgtcgctcgacttcgagacctccgtcttcaagaaggagaaggtgtccctggcgggccatgaggagtatattgtcaggggtgggagggatctgttcccgctgctgccggaggcgttcaaggggatcaaacagattggcgtcattggctggggctcgcagggtcctgcacaagctcagaacttgagggactcacttgttgaggcaaagtcagacattgttgttaagattggtctccggaaaggttctaaatctttcgaagaagcccgtgcagctggattcactgaagagagtgggactctgggtgatatatgggagactatatcaggcagtgatcttgtattgcttctgatatccgattctgctcaggcagataactatgagaaaattttctcacacatgaaacccaacagtattcttggtttgtcacacggatttctccttggacatttgcaatccctgggcctagatttccctaagaacatcagtgtgatcgctgtctgccccaagggaatgggcccatcagttagaaggctttatgttcagggaaaagagataaatggtgctggtatcaatgctagctttgctgttcaccaggatgttgatggaagggctacagatgtagctctggggtggtcagttgctctaggttcccctttcacatttgctactactctagagcaggagtacaggagcgatatttttggagagcgaggtattttgctcggtgctgttcatggcatggtggaggctcttttcaggagatacacagagcaaggaatggacgaggattcagcatataagaacactgtagagagtatcactggaatcatctctaaaactatttcaaagaagggtatgcttgaagtgtacaactccttgaccgaagaaggaaagaagcagttcattgaggcttatagcgcggcatactacccatgcatggacatcttgtatgagtgctatgaagatgtttcttctggaagtgagattagaagcgtggtattggccgggaggagattttatgaaaaggaaagggcttcctgcttttcccatgggcaatattgatcaaacacgtatgtggaaggtgggtgaaagggtgcgttcaaccaggccacaaggtgaccttggcccattgcatcccttcactgctggagtgtatgttgcattaatgatggctcagattgaggtccttaggaagaagggccactcttactccgagatcatcaatgagagcctgattgagtctgtggactcgctgaacccattcatgcatgctcgtggggttgccttcatggttgataactgctccacgactgctcgcttgggatcaaggaagtgggcaccgcgtttcgactacatcctgactcaacaagcttttgttactgttgataagaaggcaccaatcaaccaagacctcattagcaacttcatgtctgatcccgtccatggtgccattgaagtctgtgctcagctgaggcccaccgtcgacatctcagtgactgctgatgcagattttgtgcgcccagagctccggcagtcttcctaaagtttgtatcgatctgcagtccgtctcagtggttaggttatataagggtattatgagtgtgggcgtttgagctcttattagaccatgtattactgctgtttgcgaacaggaaaagtaaactctctgagtgtaggacaactgttgtgtgatgcactgtacttatatttggcatgaataaaaataagtggttggtctgagtatctgtttc

SEQ ID NO: 2138 - DNA, 1993 bp, Helianthus annuus
tttcccttcttccccacatttcaccactcaccataatggcggcggcaacaaccacaacaaccttctccaccttagcccccaccacctcctccgcaaccaccaccgcatctctcaaggccgctcccaaaaccctagggtttaacgtcggacttttctcctccaaaactgcatccaaaaccctcagagctcgctctaatggcggatctggatccgctctcggagctcgtatggtttcagctccagcaataaccaaacctacgcttcttgattttgaaacctccgtgtttaaaaaggagaagattaaccttgctggtcatgatgagtatattgtgagaggaggaagagatttgttccatttgttgcctgatgcatttaaaggtatcaagcagattggtgttattggttggggctctcagggtcctgctcaagctcaaaatcttagggattcacttgtagaggcaaagtctgatattgtagtgaagattggcttacgaaagggttcgagttcgtttaacgaggctcgtgctgctggatttactgaagaaagtggaacccttggagatatttatgagactatctctggcagtgacctggttctgttattgatttctgattcagctcaggcggataactatgagaaaatcttttcacacatgaagccaaacagcatactcggactgtcccacgggttccttctcggtcacctgcaatcagctggtcttgatttcccgaaaaacattagtgtggttgctgtgtgtcccaaaggaatgggtccatctgttaggaggctgtatgttcaaggaaaagaaataaacggagctggaatcaatgcaagttttgccgttcatcaggatgttgatggaagagccactgatgttgctcttggatggacggttgcccttggttcaccctttacatttgccaccacacttgagcaggaatacaggagtgatatctttggggagcgaggtattttacttggtgcggtgcatggtattgtggagtctttgtttagaaggtatacagaaggcggcatgagcgaagaattggcgtacaaaaataccgtagagtgcataactggcataatatcgaagacaatatcgactcagggcatgaaggctgtatacgattctttaacagaagaaggcaaaaaagagttcttgaccgcatacagtgcctcatattatccatgtatggacattctgtatgagtgctatgaggatgtacaaagcggtagtgagatacgaagtgttgttttggccgggcgtcgattttatgaaaaggagggtttgccagctttccctatgggaaagattgatcagacccggatgtggaaggtaggtgaacgggttcgcgctacccgacccgcaggtgatttaggcccgttatatcctttcaccgctggtgtctatgttgcactaatgatggctcagattgaggtgttgaggaagaaaggacattcttattccgagatcatcaacgaaagtttgatcgagtcagtggattccttgaacccattcatgcatgctcgaggtgtgtcgtttatggttgacaactgttcgacaaccgcacggttgggatcaaggaaatgggccccacgtttcgattacattcttacccaacaagctttagttgctgtagacaacgggaccccgctaaaccaggacctcattagcaacttctttgaagacccggtgcatgaagctgtgaaggtttgtgcagagttgagacccacggttgacatctcggtgcctgctgatgctgattttgtccgacccgagttgcgtcaatctagcaactagagatggtggtggttcatatgcaggtttggttctatgatagtttaagatcagtgcagacattatgtctgctttgctagagtgttatgcaaaatgtttcttatggatgttgtgatcggattttcggtgattttgaataatgaaagttattaggccttgcggtcattatcagtgattcgcatattgaccaggtt

SEQ ID NO: 2139 - DNA, 1965 bp, Helianthus annuus
cgtttccttcttccccacatttcaccaccataatggcggcggcaacaaccacaaccaccttctccaccttagctcctaccacctcctccgcaaccaccaccgcatctctcaaggccgctcccaaaaccctagggtttaacgtcggacttttctcctccaaaatcgcatccaaaaccctcagagctcgctccaatggcggatctggatctgctctcggagctcgtatggtttcagctccagcaataaccaaacctacgcttcttgattttgaaacctccgtgtttaaaaaggagaagattaaccttgctggtcatgatgagtatattgtgagaggaggaagagatttgttccatttgttgcctgatgcatttaaaggtatcaagcagattggtgttattggttggggctctcagggtcctgctcaagctcaaaatcttagggattcacttgtagaggcaaagtctgatattgtagtgaagattggcttacgaaagggttcgagttcgtttaacgaggctcgtgctgctggatttactgaagaaagtggaacccttggagatatttatgagactatctctggcagtgacctggttctgttattgatttctgattcagctcaggcggataactatgagaaaatcttttcacacatgaagccaaacagcatactcggactgtcccacgggttccttctcggtcacctgcaatcagctggtcttgatttcccgaaaaacattagtgtggttgctgtgtgtcccaaaggaatgggtccatctgtcaggaggctgtatgttcaaggaaaagaaataaacggagctggaatcaatgcaagttttgccgttcatcaggatgttgatggaagagccactgatgttgctcttggatggtcggttgctcttggttcaccctttacatttgccaccacacttgagcaggaatacaggagtgatatctttggggagcgaggtattttacttggtgcggtgcatggtattgtggagtctttgtttagaaggtatacagaaggcggcatgagcgaagaattggcgtacaaaaataccgtagagtgcataactggcataatatcgaagacaatatcgactcagggcatgaaggctgtatacgattctttaacagaagaaggcaaaaaagagttcttgaccgcatacagtgcctcttattatccttgtatggacattctgtatgagtgctatgaggatgtacaaagcggcagtgagatacgaagtgttgttttggctgggcgtcgattttatgaaaaggagggtttgccagctttccctatgggaaagattgatcagacccggatgtggaaggtaggtgaacgggttcgcgctacccgacccgcaggcgatttaggcccgttatatcctttcaccgctggtgtctatgttgcactaatgatggctcagattgaggtgttgaggaagaaaggacattcttattccgagatcatcaacgaaagtttgatcgagtcagtggattccttgaacccgttcatgcatgctcgaggagtgtcgtttatggttgacaactgctcaacaaccgcacggttgggatcaaggaaatgggccccacgtttcgattacattgttacccaacaagctttagttgctgtagacaacgggaccccgctaaaccaggacctcattagcaacttctttgaagacccggtgcatgaagctgtcaaggtttgtgcagagttgagacccacggttgacatctcggtgcctgctgatgctgattttgtccgacccgagttgcgtcaatctagcaactagagatggtggtggttcatatgcaggtttggttctatgatagtttaagatcagtgcagacactatgtctgctttgctagagtgttatgcaaaatgtttgttatggatgttgtgatcggatttttggtgattttgaataatgaaagttattaggccttgcggtcattat

SEQ ID NO: 2140 - DNA, 2027 bp, Arabidopsis lyrata
atatctgactcttggtggtgatgagtagtttgagtctgtgaccctaatttcagagctctcttctctttgcgcagtcaatttgctacaactgagaaaatggcggctgcgacttcatccatcgctccatctctttcatgcccatctccttcttcttcatccaaaacccttaggtcttcgaaagccagaaccttggctcttcccaatatcggtttcctctcgtcttcttccaagtctctgaggtcgcttactgccaccgtcgctggaaatggtatcggttccgccactggatcctccctttccgctcgtatggtttcgtcgtcggcggtcaaagcccctgtttctctcgattttgagacatctgtcttcaaaaaggagaaagtttctcttgctggttacgaagagtacattgtgagaggaggaagggatttgttcaagcatctcccagatgctttcaaggggattaagcagataggtgttattggctggggatctcagggacctgcccaagctcagaatttaagggattcacttgtggaggcaaagtctgacattgttgtcaagattggtctcagaaaagggtctcgctcatttgaggaggcacgtgctgctggtttcactgaagaaactggtactttgggtgatatatgggaaactatttctggcagcgatctcgtattgcttttgatctctgatgctgctcaagctgataactatgagaaaatcttctctcacatgaagccaaacagcattcttggtttatcacacgggtttctactagggcatttacagtcctcaggacttgatttcccaaagaacatcagtgtggtcgctgtatgccctaagggaatgggtccttctgtgaggaggctttatgtccaaggaaaagaaatcaacggtgctggaatcaatgccagttttgcagtccaccaggatgttgacggtagagccgccgatgttgcattgggatggtcagtagcacttggttctccttttacttttgctactactcttgaacaagagtacaggagtgacatctttggagaaagaggcattttgcttggtgctgttcacggaattgtggagtctctgtttagaaggtataccgaaaatgggatgagtgaagacttggcttacaagaacacagtagaatgcatcacaggaacaatttcaaggactatctctactcagggaatgttggctgtgtacaactccttgtctgaagaaggtaaaaaagattttgagactgcatacagcgcatccttctatccttgtatggagattctctatgaatgttatgaggatgtacaaagtggcagcgaaatccgaagtgttgtcttagctggtcgtcgcttctatgaaaaagaaggcttgccagcattcccaatgggaaatattgaccagacaagaatgtggaaggtgggtgaaggcgtcaggaagtccagacctgctggtgacttgggtccattgtatcccttcaccgctggagtttatgtagcacttatgatggctcagattgagatcttgagaaagaaaggtcactcttattcagaaatcatcaatgagagtgtgattgaatcagtggactctctaaacccatttatgcacgccaggggagtgtccttcatggttgacaactgctcgaccacagcaagattggggtccaggaaatgggctccgcggtttgactacatcttgacccagcaagctcttgtggctgtggacagtggtgcagcaatcaacagagacctaatcagtaacttcttctcggatccagtccacggtgccattgaggtctgtgcacagctcaggcctaccgttgatatctctgtgcctgctgatgcagactttgttcgacctgagttgcgtcaatctagcaactgagtgaagagttgaaagtttgtcagagtctcttatttgtaatcggaggtttaagtatgtcgagagtttgtgatgttttttaggcgtgactgttttttatgtctctttgctttggtcttaaaatctactcaagtcaataaaatagtttc

SEQ ID NO: 2141 - DNA, 2034 bp, Elaeis guineensis
  misc_feature (1162)..(1162): n is a, c, g, or t
  misc_feature (1190)..(1190): n is a, c, g, or t
  misc_feature (1214)..(1214): n is a, c, g, or t
  misc_feature (1220)..(1220): n is a, c, g, or t
  misc_feature (1229)..(1229): n is a, c, g, or t
  misc_feature (1265)..(1265): n is a, c, g, or t
  misc_feature (1277)..(1277): n is a, c, g, or t
  misc_feature (1298)..(1298): n is a, c, g, or t
ctctctctcttaccccttcatccatggcggcggcgacatccttcaagccttcttccatcgccgccgcttccccagccaaaaccctaaagccggcccccaaaaccctagctttggggttgggattctcgtcgtcgtcctccagatccctgaggcttctcctctcccggatgcacatggatgcggccgcggcagggcggggtggcgccgccgccctcggagctcgaatggtctccgtgccatccatcagcaagcccgctccctctcttgacttcgagacctccgtctttaagaaggagaagatcaccctcgccggtcaaaatgagtatattgttagaggtgggagggatttattccatttgttgccagatgccttcaaggggatcaagcaaattggcgtgattggttggggatcccagggtcctgcccaagcacagaacttgagggattcacttgcagaggcacaatcagacattgtggtcaagattggtctgagaaaaggttctcgttcctttgaggaagcacgtgctgctgggtttactgaagaaaatggaaccttgggtgatatctgggagacaatttcaggcagtgaccttgtcttgttgctgatttcggattctgcacaggcagacaactacgagaaagtattctctcacatgaaaccaaacagcattctggggctgtctcatggttttcttcttgggcatttgcaatcccttcgccttgatttccccaaaaacatcagcgtgattgctgtatgtcctaaggggatgggtccatcagtgagaaggttgtatgttcagggaaaagagataaatggtgcaggaatcaattccagttttgctgtccatcaggatgttgatggcagggccacagatgttgctctggggtggtcagttgctctaggatctccttttacatttgccactactttagagcaggagtacaagagtgacatttttggggagcgtggtattttgcttggtgctgtgcatggaattgtggaggccttgtttagaaggtacactgagaatggaatgagtgaagaaaaggcttataaaaacacagttgagtgcatcacaggaattatgtcaaagaccatttcaacaaagggtatgctctctgtatacaactctctgactgaagaagagaaaaaggaatttantgctgcatatagtgcatcatactatccntgcatggatatcttgtatgagtgntatgangatgttgcntgtggcagtgaaattcgcagtgttgttttagctggncgacgcttttangaaaaggaagggcttcctgcnttcccaatgggtaaaatcgatcagacacgaatgtggaaagttggtgagcgagtccgtgcggctcgacctgagggtgacttgggccccttgcacccgtttactgctggggtttatgtggctctaatgatggctcagattgaggtcctaagaaagaagggacattcttactcagagatcattaatgagagtgtgatcgagtcagtggattccctaaatcctttcatgcatgctcgcggggtgtcattcatggtggacaactgttccacaaccgcgcgcctggggtcaagaaagtgggctccgcgttttgattatatccttactcagcaagcattagtagctgtcgacaagaacgctcctatcaatcaggacctactcagcaacttcttttccgatccagtgcatggtgctattgaagtctgtgcagagttgaggccaactgttgatatatctgtgccacctgatgcagattttgtgcgtccagaattgcgacaaactggcaattgagaaatggcaatagattttgatagatagcctacagccattgtgatattttgagagggtaatcttagcatgaaagctctttaaacatctaggttgtatgtgcatgcgaacattgtgcggtctctgagtgcgtagtgtctgaataaattggtgcgtggctgggcatcagttgtgtgtacgttgcacttgtttgacggtaattgagtaatccctgggagtcgtttgtagctttcgg

SEQ ID NO: 2142 - DNA, 2067 bp, Helianthus annuus
actacaccctgtcgtatataagtagggctacacacgcatatctccacctacctctgctccgccgtttcccttcttacaccacatttctacaaccataatggcggcggcaacaaccacaacaaccttctccaccttagcccccaccacctcctcttcaaccaccaccgcatctctcaaggccgctcccaaaaccctagggtttaacgtcggacttttatcctccaaaactgcatccaaaaccctcagagctcgctccaatggcggatctggatctgctctcggagctcgtatggtttcagctccagcaataaccaaacctacgcttcttgattttgaaacctccgtgtttaagaaggagaagattaaccttgctggtcatgatgagtatattgtgagaggaggaagagatttgttccatttgttgcctgatgcatttaaaggtatcaagcagattggtgttattggttggggctctcagggtcctgctcaagctcaaaatcttagggattcacttgtagaggcaaagtctgatattgtagtgaagattggcttacgaaagggttcgagttcgtttaacgaggctcgtgctgctggatttactgaagaaagtggaacccttggagatatttatgagaccatctctggcagtgacctggttctgttattgatttctgattcagctcaggcggataactatgagaaaatcttttcacacatgaagccaaacagcatactcggactgtcccacgggttccttctcggtcacctgcaatcagctggtcttgatttcccgaaaaacattagtgtggttgctgtgtgtcccaaaggaatgggtccatctgtcaggaggctgtatgttcagggaaaagaaataaacggagctggaatcaatgcaagttttgccgttcatcaggatgttgatggaagagccactgatgttgctcttggatggtcggttgctcttggttcaccctttacatttgccaccacacttgagcaggaatacaggagtgatatctttggggagcgaggtattttacttggtgcggtgcatggtattgtggagtctttgtttagaaggtatacagaaggcgggatgagcgaagaattggcgtacaaaaataccgtagagtgcataactggcataatatcgaagacagtatcgactcagggcatgaaggctgtatacgattctttaacagaagaaggcaaaaaagagttcttgaccgcatacagtgcgtcttattatccttgtatggacattctgtatgagtgctatgaggatgtacaaagcggcagtgagatacgaagtgttgttttggctgggcgtcgattttatgaaaaggagggtttgccagctttccctatgggaaagattgatcagacccggatgtggaaggtaggtgaacgggttcgtgctacccgacccgcaggcgatttaggcccgttatatcctttcaccgctggtgtctatgttgcactaatgatggctcagattgaggtgttgaggaagaaaggacattcttattccgagatcatcaacgaaagtttgatcgagtcagtggattccttgaacccgttcatgcatgctcgaggagtgtcgtttatggttgacaactgctcaacaaccgcacggttgggatcaaggaaatgggcaccacgtttcgattacattgttacccaacaagctttagttgctgtagacaacgggaccccgctaaaccaggacctcattagcaacttctttgaagacccggtgcatgaagctgtcaaggtttgtgcagagctgagacccacggttgacatctcggtgcctgctgatgctgattttgtccgacctgagttgcgtcaatctagcaactagagatggtggtggttcatatgcaggtttggttctatgatagtttaagatcagtgcagacactatgtctgctttgctagagtgttatgcaaaatgtttgttatggatgttgtgatcggatttttggtgattttgaataatgaaaggtattaggccctccgggccatcccgaccgaaaagaataacaagaaaaatatccgttttgg

SEQ ID NO: 2143 - DNA, 2309 bp, Tabernaemontana elegans
atccctctcccacccacccttgctctagcacagttgcagatggcggcggcagcaccaactactcctttctctgcctccaccactccggtatccaaaaccctaaaacaacataccaaaaatttagcacacaatctcagtttcatttcttcatcaacgccttctctgcacgcactcatggctcgggcctctggaccagtgtctggaacttcccacggcggagccgttgctgcttgtatggtgtctacacctagcgctgttgcaaaggtgcaaccgctaactcttgattttgtcacaagtgtcttcaagaaggagaaggtcaatctagcgggacacgaagagtatattgtgagaggaggcagggatttattcaagctgttgccggacgctttcaagggaatcaagcagattggtgttattgggtggggttcacaggggcctgctcaggctcagaatctaagagactcacttgctgaggcgaaatctgatatcgtggttaaggttggtttgaggaaaggttctcgctcattcgttgaggcccgtgcagctggcttcagtgaggaggacggaacccttggagacatatatgagactatatctggtagtgatcttgtgctactcttaatttctgatgcagcacaggctgataattatgagaacgtgttttcccacatgaagccaaatagtatccttgggctttcgcatggttttcttcttggccatttgcagtcaatgggtcttgatttcccccagaatattagtgtaatagctgtatgtcccaagggtatgggtccatcagtgagaaggttatatgtgcaagggaaagaaatcaacggagctggcatcaattctagttttgcagttcatcaggatgttgatgggagggctacagatgttgctcttgggtggtcagttgctcttggttctccttttacctttgctactaccttagaacaggagtacaaaagtgacatcttcggggagcgaggcattttactgggtgctgtacatggcattgtggagtcattgttcagaaggtacactgaaaaaggaatggctgaagatcttgcatacaaaaacactgtggagtgtattacaggaattatttcgaaaaccatatccacgaagggcatgttggctgtttacaattcattaacggcagaaggaaagaaggaatttgagactgcctatagtgcttcatattatccctgtatggatatcttatatgaatgctatgaagatgtggctactggaagtgagattcggagtgttgtcttagctggacgtcgcttctgtgaaaaggagggtctccctgccttccctatgggcaagatcgaccaaacaaggatgtggaaagtaggtgagcgagtccgagcttcatgaccagctggtgatttgggccctttataccctttcacagctggtgtttatgtggcattgatgatggcacagattgagatcttgaggaagaaagggcactcctattccgagatcataaatgggagtgtgatcgagtccgtggattctctaaatccattcatgcatgctcgtggggtttcattcatggttgacaattgttcaacaactgcacgggtagggtcaaggaagtgggctccctgatttgattacattctaactcagcaggctcttgtggcagtggacaacaaaactcccattaacagggatctcatcggcaacttcctatctgacccggtgcatggagctatcgaagtgtgcgcccagttgagacctactgttgacatttcagtgccacaagatgctgattttgtgcgcccagagcttcgtcagtctaactaaagctgtctcaggtattgatttcaactacctagagctctgccagttcaggaactgaatagttttagttatatctagttgaatatatgcacttgaagtgtgggcttttggatatccgtgagcatatttctctccagcgcgctgtgctgcactgctgtgctgttagtatgggagaattgttctgtaggttgtgctttttactatcggtgcaaggagattagataatcgttctgggagtaatttcaagacaataaatctgtgtttttatcagttctcagaaatttgtgattgcattcacttttggaagcacgtttgcagtatagaagttcaagaacatgtatatgtagtgagaatcccttaaccaagagcaaagccttccttcgaaacgtccatgctaatgccttttgtaagtgagagatcatttctgacctccttttttcattgacctagaatttagtagtacaattgatcatgaattggacaagtttgcctatcgt

SEQ ID NO: 2144 - DNA, 2088 bp, Tabernaemontana elegans
cagcaccaactactcctttctctgcctccaccactccggtatccaaaatcctaaaacaacataccaaaaatttagcacacaatctcagtttcatttcttcgtcaacgccttctctgcatgcactcatggctcgcgcatccggacccgtatctgcagcatcccacggcggagccgttgctgctcgtatggtgtctacacctagcgctgctgtaaaggtgcaaccgctaactctggattttgtcaccagtgtcttcaagaaggagaaggtcaatctggcgggacacgaagagtatattgtgagaggaggcagggatttattcaagctgttgccggacgctttcaagggaatcaagcagattggtgttattgggtggggttcacaggggcctgctcaggctcagaatctaagagactcacttgctgaggcgaaatctggtatcgtggttaaggttggtttgaggaaaggttctcggtcatttgttgaggcccgtgcagctgggtttagtgaggaggacggaacccttggagacatacatgagactatatctggtagtgatcttgtgctactcttaatttctgatgcagcacaggctgataattatgagaaagtgttttcccacatgaagccaaatagtatccttgggctttcgcatggtttccttcttggccatttgcagtcaatgggtcttgatttccccaagaatattagtgtaatagctgtatgtcccgaggggatgggtccatcagtgagaaggttatatgtgcaagggaaagaaatcaacggagctggcatcaattctagttttgcagttcatcaggatgttgatggagggctacagatgttgctcttgggtggtcagttgcccttggttcttcttttacctttgctactactttagaacaggagtacaaacgtgacatcttcagggagcgaggcattttactgggtgctgtacatggcattgtggaatcattattcagaaggtacactgagaatggaatggctgaagatcttgcatacaaaaacactgtggagtgtattacaggaattatttcgaaaaccatatcaacaaagggcatgttggctgtttacaattcattaacgtccgaaggaaagaaggaatttgaggctgcctatagtgcttcatattatccctgtatggatatcttatatgaatgctatgaagatgtggctagtggaagtgagattcggagtgttgtcttagctggacgtcgcttctatgaaaaggagggtctccctgccttccctatgggcaagattgaccaaacaaggatgtggaaagtaggtgagcgagtccgagcttcacgaccagctggtgatttgggacctttataccctttcacagctggtgtttatgtggcattgatgatggcacagattgagatcttgaggaagaaagggcactcctattccgagatcataaatgagagtgtgatcgagtccgtggattctctaaatcctttcatgcatgctcgtggggtttcattcatggttgacaattgttcaacaactgcacgggtagggtcaaggaagtgggctccccgatttgattacattcttactcagcaggctcttgtggcagtggacaacaaaactcccattaacagggatctcatcagcaacttcctatctgatccggtgcatggagctatcgaagtgtgcgcccagttgagacctactgttgacatttcagtgcctcaagatgctgattttgtgcgcccagagcttcgtcagtctaactaaagctatctcaggtcttgatttcaacgacctagagctctgccagttcaggaactgaatagttttagttatatctagttgaatatatgcatttgaggtgtaggctttttggagatccatgagcatatttctctccagcgtgctgtgcttcattcctgttagcatgggagaattgttctgtatgttgtgctttttactattggtgcaaggaaatttgataatcgttctgtgagtaatttcaagacaatagatctgtgtttttatcagttctcagaaatttgtgattgcattaacttgtggaaacacgtttgcagtatagaagttca

SEQ ID NO: 2145 - DNA, 2169 bp, Brassica rapa
gtcgtcttgagtagagaggtgtgtgcttgttgtctctccaccctaattagcaataatacactgtgagactcaaaatggcggctgcgacttcatccatcgctccttccctctcatgcccaccttcttcttcttcctccaaagccctcaggtcatcgaaagtctcaacctttgctttccccaacatcggtttcaccttctctgcttccaagtctctgaggtctctcaccgccgccgtctctggaaatggcaccggatcttccctctccgcgagaatggtcgcttcttctgcggtcagagcccctctttctctagacttcgagacgtctgtgttcaaaaaggagaaagtatctcttgctggtcacgaagagtacattgtgagaggaggaagggacttgtttaagcatctccctgatgctttcaaagggattaagcagattggtgtcattggctggggttctcagggacctgctcaagctcagaatttaagggattcacttgtggaggcaaagtctgacattgttgttaagattggtcttagaaagggctctaaatcgtttgaggaggcacgtgctgttggcttcaccgaagaaagtggtactttgggtgatatatgggaaactatctccggcagtgatcttgtattgcttttgatctctgatgctgctcaagctgataactatgagaaaatattctcccacatgaaaccaaacagcattctcggtttgtcacacgggttcttactggggcatttacagtcaatgggacttgacttcccaaagaacatcagcgtggtagctgtttgccctaaaggaatgggtccatctgtgagaaggctttatgtccaaggcaaagaagtcaacggtgctggaatcaacgccagttttgctgtccaccaggatgttgatggtagagccgcagatgttgctctaggatggtcagtagcacttggttcgccttttacctttgctactactcttgagcaagagtacaagagtgacatctttggagaaagaggtattttgcttggtgccgttcacggaatcgtggagtctctgttcagaaggtacaccgagaacggaatgagtgaagacttggcctacaagaacacagtagagtgcatcacaggaaacatttctagaactatctctactcagggaatgttggctgtctacaactccttgtccgaagaaggcaaaaaagatttcgtgactgcctacagtgcatccttctatccttgtatggagattctctatgagtgctacgaggacgtagcagctggcagcgagatcaggagtgttgtcttagccggtcgtcgcttctacgataaggagggcttgcctgcctttccaatgggaaagattgatcagacaagaatgtggaaggtcggtgaacgtgtcaggacgtctagacccgctggtgacttgggtccgttgtatcccttcactgctggagtttacgttgcccttatgatggctcagatcgagatcttgaggaagaagggtcactcttactcagagatcatcaacgagagtgtgattgagtctgttgactctctaaacccgtttatgcatgccagaggagtgtcattcatggtggacaactgctcgaccactgcaagattgggatcgaggaaatgggcaccgagattcgactacaatctgactcaacaagctttggtggttgtggacaatggtgcaccgatcaacaaagacttgatcagcaacttctttgctgatccagtccatggtgctattgaggtgtgtgcacagctcaggcctaccgtcgatatctctgtgcctgaagatgctgatttcgttcgaccagagctgcgtcagtccaactgagtgcaagggttgttaaacttatcagtttctatgaaaatgtaatcgtgttttaaaaaaatgacgagagcttttggaagttgtaggcgtgagaatgttttgtttgaatggtttgaataaatgatgtttctttggagttccacatgtgatgttctctctctgctttcaataatgatgtctcttgtgaatgtttagtttggagagattaaaagaactgtagctcttcctttacttgttgaagatacatgagaaaatgaataaagaactttcaagaggtttagattcagagatgatcagtgtggtgagagcacaatgatttggtctctct

SEQ ID NO: 2146 - DNA, 2151 bp, Aristolochia fimbriata
ttttctgtcctcgagggtttttagcagtgtgtgggtttcttcaatcaatggcggcggcttcgaccttctcaccctgtcttgctccttcatcttccaaaatcctaaagtcagctcctaaatctctcagtggggtggggttcctctcctcttctgctaagacccttaaaccgctcctctcttcggtatctacaggggctgccgcaccgtctcggggtgctgtcggagcacgcatggtctccatgccggctattaggcactccaccactctagattttgagacatctgttttcaagaaggagaaggtcacactcgctggacaggatgagtacattgtgaaaggagggagggatctgtttaagttgttgccagacgcgttcaagggtattaagcagattggcgtcattggttggggttctcagggacctgcgcaagcccagaatttgagagattcacttgccgaggtgaagtctgacattgttgtgaagattggattgcggaaaggttctagttcctttgctgaagcacgatctgctggattttctgaggaaaatggaactttgggtgatatatgggagacagttgcaggcagtgacctcgttttgcttctaatatctgatgctgcacaggcggataactatgagaaagtattttctcacatgaaaccaaacagcatccttgggctttcacacggattccttcttggacatttgcagtctctggggcaagacttccctaagaacatcagtgtgattgcagtctgcccaaaagggatggggccatctgtaagaaggctgtatgtgcaggggaaagagataaatggtgctggaataaattctagttttgctgttcaccaggatgtcgatggtagagctacagatgttgcactcggatggtctgttgctctcggttctccttttacatttgccactacattggagcaggagtacaagagtgacattttcggggagagaggaattttgcttggtgccgtacatggcattgttgaggccctgtttagaaggtacacagaaaatggaatgaatgaggatttggcatacaagaacactgttgagtgcatcacaggaattatatcaaggactatttcaactcagggcatgctggctgtttacaactcactgtctgaggaaggtaaaaaggaattccagacagcatacagtgcatcatactatccttgcatggacattttatatgagtgttacgaggatgttgccagtggaagtgaaattcgaagtgttgtcttggctggccgtcgattttatgaaaaggagggtttgcctgccttccctatgggcaaaattgaccagaccagaatgtggaaagttggtgaacgagttcgatcgacaagacctcaaggtgatctaggccctttgcatcccttcacagctggtgtttacgtggctctaatgatggcccagattgaagttttgagaaagaagggacactcgcactcagaaatcatcaacgaaagtgtcatagagtctgtggattcgttgaaccccttcatgcatgctcgcggtgtctccttcatggttgataattgttccacaacggcaaggttgggatccagaaagtgggctccccggtttgactatattctcacccaacaggcgttggtagctgtggacaagagtacgtcaatcaaccaggatctcctcagcaacttcttctctgatccggttcacggtgctattgaagtttgtgcgcagctgaggccagcagtggacatctcagtcccagcagatgcagactttgtccgccccgagttacgttaatcaggcaactatggtaatcatcatcaataaggagttgatagccagtgctagttttcccatgagccctattgttgaagcagttctttgtcttataagttattagtcagtactccagcgaatggattttctttttgccccagtgagaccagtttcaatgttagaggagcaaaatgttttttttattcagtatatagccaaccttttgggtcaatatttgtgggaaaaggttgatcatgtttcagggtcttgcctggacttgactatctcaccttggtagtgactgcatcctaggatttagagtctgcaagcgtaatggaatatgacttttaagttttaatgtattattcatattcgccgt

SEQ ID NO: 2147 - DNA, 1952 bp, Euphorbia peplus
aaatggccgccgccgccgccaccacattctccggcactctatcatctccgtcgccgtcaaaatgtccggcgaaatcgctttcctggagctcgggattaggatatactccggtgagtgagaagaagtcattgaaggcccttaaagctagtaacggaggtgctaggatgatcgtgtcaatgccagctgtcgctaagcctttgatatctcttgactttgagacctctgtcttcaataaagagaaagtctctcttgctggtcatcaagagtacattgtgagaggaggtagggatttgttcaagttgttacccgatgcgtttaagggtatcaaccagattggtgtcattggttggggttctcagggtcctgctcaagctcaaaacttaagggattcccttgcagaagccaattccgatattgtagtgaagattggattgagaaaggggtctcggtcatttgctgaagctcgtgctgcaggtttcactgaagagactggaactttgggtgatatttgggaaactgtttcaggcagtgatctcgttttgctattaatttctgatgctgcacaggctgataattacgagaaggtgttctcacatatgaagccaaacagcattcttggactgtctcatgggtttttgcttggacatctccaatcaagtggacttgacttcccaaagaacatcagtgtggttgctgtatgtccaaagggaatgggtccatctgtaagacgtctctatgttcaagggaaagaagtcaacggtgctggaatcaatgctagttttgcagtccaccaggatgttgatggtagagctacagatgttgccttgggatggtcagttgccctcggttctcccttcacttttgccactactctagagcaggagtacaagagtgacatctttggggaacgaggcatcttgcttggtgctgttcacggaattgtggagtccttgtttagacggtatacagaaaatggcatgggtgaagaggaggcttacaaaaataccgttgagggcataacaggaaatatatcaaagaccatttcgactcagggcatgttggcggtatacaattctctctctgaagaaggcaaaaaagaatttgaaattgcatacagtgcctcattttatccttgcatggaaattttgtacgagtgctatgaagacgtggccagtggtagcgagatccgcagtgttgttttggctggacggcgcttttatgagaaagaaggtctaccagcttttcccatgggcaatattgatcaaacacgcatgtggaaggtcggtgaacgtgtccgctcaactcggcctgcaggggacttgggtccattgtatcctttcactgctggtgtatacgtggcattgatgatggcacagattgaaatcttgaggaagaaaggacactcatactctgaaatcattaacgaaagtgtgattgagtccgtcgattccttgaacccattcatgcacgcacgtggagtttcctttatggtcgacaactgctctacaacagcaagattgggatcaaggaaatgggcaccccggttcgattacatcctgacccagcaagctttggtagctgttgacagcggcacccctgtgaaccgagatctcatcagcaatttcctatcagaccctgttcatggagccatcgaagtatgcgcccagttgagacctaccgttgatatctcaattcctgcagatgccgactttgtaagacccgagttgcgttaatctagcagtcagtgatctgaagtaccatggttaggttgaatgggtttgctaatcctattattatgatgtatggttgagagagaagttaagtttgaatttttaggtatggtctagttttttggtcggtatattgtgatgtttttgtagtgttgtgatttctatcttaatatgtttttatcttctatgtactgtctttcaacttatgaactatttgctact

SEQ ID NO: 2148 - DNA, 2043 bp, Zea mays
caatccgtcaatcccacacataaagagctcacggacgcatctccggaaatcctctctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccggaggccttcaagggaatcaaacagatcggtgtaatcggctggggctcgcagggtcctgcgcaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacagtattcttggtttgtcacatggatttctccttggacatttgcaatctctgggttttgatttccctaaaagcatcagtgtgattgctgtatgccccaagggaatgggcccatcagtcagaagactttatgttcagggcaaagagatcaatggtgctggtatcaatgctagctttgctgttcaccaggatgttgatggaagggcaacagatgtagctctagggtggtcagtagctttaggttctcctttcacatttgctactactctagagcaggagtaccggagtgacatttttggcgagcgaggtattttgcttggtgctgtccatggcatggtggaggctcttttcaggagatacacagaacaaggaatggatgaggactcagcatataagaatactgtagagagcatcactggaattatatcgaaaactatttcaaagaagggtatgcttgaagtgtataactctctgactgaagaaggaaagaagcagtttattgaggcctatagtgcagcatattacccatgcatggacatattgtatgagtgctatgaagacgtctcttctggaagtgagattagaagtgtggtgttggctgggaggagattttatgagaaggaagggctccctgctttccctatgggaaaaattgatcaaacacgtatgtggaaggtgggtgaaagggtccgttcaaccaggccacaaggtgatcttggcccactgcatcccttcactgctggagtgtatgttgcactaatgatggctcagattgaggtccttaggaagaagggccactcttactcagagataattaatgagagcctgatcgagtccgtggactcgttgaacccgttcatgcatgctcgcggtgtggccttcatggtcgataactgctccacaactgctcgtttgggatctaggaagtgggcaccacgcttcgattacatcttgacccaacaggcgtttgtgactgttgacaagaaagcaccgatcaaccaagacctcatcagcaacttcatgtctgaccctgtccacggtgccatcgaagtctgcgctcagctgaggcccactgttgacatctcagtgaccgctgatgctgatttcgtgcgtccagagcttcgacagtcttcataagcttgtatggatccgcagtgtgactgcaatggctagtttgtaagaacttaatatgcctgggcttttgaactcttagattgtgcctgtattgctcgtgcttgaggaccagaaaagtaaactcttggcggtgtggtactgttgtgatttgcaagaataaaaataaatttctgttgatcattccctggtgtccaattgtacacctgaa

SEQ ID NO: 2149 - DNA, 1957 bp, Triticum aestivum
gcacgagcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtgaggggtgggagggatctgttcccgctgttaccggaggccttcaagggaatcaaacagatcggtgtaatcggctggggctcgcagggtcctgcgcaagctcagaacttgagagactcacttgttgaggcaaagtcagatattgttgttaagattggtctccggaaaggttctaaatcttttgaagaagcccgagcagcaggattcaccgaagagagtgggacgctgggtgatatatgggagactgtatcaaacagtgatcttgttttgctactgatatctgattctgctcaggctgataactacgagaaaattttctcgcacatgaaaccaaacagtattcttggtttgtcacatggatttctccttggacatttgcaatctctgggttttgatttccctaaaagcatcagtgtgattgctgtatgccccaagggaatgggcccatcagtcagaagactttatgttcagggcaaagagatcaatggtgctggtatcaatgctagctttgctgttcaccaggatgttgatggaagggcaacagatgtagctctagggtggtcagtagctttaggttctcctttcacatttgctactactctagagcaggagtaccggagtgacatttttggcgagcgaggtattttgcttggtgctgtccatggcatggtggaggctcttttcaggagatacacagaacaaggaatggacgaggactcagcatataagaatactgtagagagcatcactggaattatatcgaaaactatttcaaagaagggtatgcttgaagtgtataactccttgactgaagaaggaaagaagcagtttattgaggcctatagtgcagcatattacccatgcatggacatattgtatgagtgctatgaagacgtctcttctggaagtgagattagaagtgtggtgttggctgggaggagattttatgagaaggaagggctccctgctttccctatgggaaaaattgatcaaacacgtatgtggaaggtgggtgaaagggtccgttcaaccaggccacaaggtgatcttggcccactgcatcccttcactgctggagtgtatgttgcactaatgatggctcagattgaggtccttaggaagaagggccactcttactcagagataattaatgagagcctgatcgagtccgtggactcgttgaacccgttcatgcatgctcgcggtgtggccttcatggtcgataactgctccacaactgctcgtttgggatctaggaagtgggcaccacgcttcgattacatcttgacccaacaggcgtttgtgactgttgacaagaaagcaccgatcaaccaagacctcatcagcaacttcatgtctgaccctgtccacggtgccatcgaagtctgcgctcagctgaggcccactgttgacatctcagtgaccgctgatgctgatttcgtgcgtccagagcttcgacagtcttcataagcttgtatggatccgcagtgtgactgcaatggctagtttgtaagaacttaatatgcctgggcttttgaactcttagattgtgcctgtattgctcgtgcttgaggaccagaaaagtaaactcttggcggtgtggtactgttgtgatttgcaagaataaaaataaatttctgttgatcaaaaaaaaa

SEQ ID NO: 2150 - DNA, 1948 bp, Aquilegia formosa
tgtttctcttcatcaatggcggctacaacatcattctcttcaccactctcttcttcatgtaataaaacccttcaaaccccacattctaaaatcccatcattcaatctaacttttctctcttcttcttcttcttctttctccaccaaaacctctttaatctctcatataaacaacaatgcaatctccccatcatctaaaatgactgtttcaacaaacccatcaattaataaaccattaaaaactctagattttgatacttctgtttttaataaagagaaaatctcacttgctggtaatgatgagtttattgtaagaggtggaagagatttgtttcatttgttgcctgatgcttttaaggggattaagcaaattggtgtcattggatgggggtctcagggacctgcacaagctcaaaatttgagagactcccttgcagaagcaagatctgatattgttgtaaagattgggctgcggaggggttcccgttcttttgctgaagcacgttctgctggatttactgaagagagtggaacattgggtgatatatgggaaacaatctcagaaagtgatctggttttgttactgatttctgatgcagcgcaggcagataattacgaaaagatcttttcctacatgaagcctaatagcatacttgggctctcacatggatttctgctaggccacttgcagtcttcggggcttgatttccctaagaacattagtgtagttgctgtatgtcccaagggcatgggtccttccgtacggagactctatgttcaaggaaaagagataaatggtgctggaatcaatgctagttttgctgtccatcaggatgttgatggtagagcaacagatgttgccttagggtggtctgttgcccttggttctcctttcacctttgcgactacactagagcaggagtacaagagtgacatttttggggaacgaggaattttacttggagctgtacatggaattgtggagtccttgtttagaagatacactgagaatggaatgaatgaggaactggcttacaaaaacactgttgagtgcattacaggaattatatcgaggaccatatccacagagggcatgcttgcagtatacaactctttaacagaggatggtaaaaaggagtttcatgctgcttacagtgcctcatattatccttgtatggatattctttatgagtgctatgaggatgtggccagtggaaatgaaatccgaagtgttgtcttggctgggcgtcgcttttatgaaaaagaaggtctacctgcttttccaatgggcaatatagatcagactcgaatgtggaaagttggtgagcgagtccgatcaacaaggcccaaaggtgacttgggtcctttgtatcctttcactgctggtgttttcgtggcattaatgatggctcagattgagatactgaggaaaaaagggcattcatactcagagatcatcaatgagagtgtgattgaatcggtggattccttgaatccttttatgcatgcacgtggagtttcattcatggttgataattgttccacaacagcacgtttgggatctcgaaaatgggccccacgctttgattatgttctcacacagcaggccttggtggcagttgatcaaaagactcccatcaaccaggacctcatcagcaatttcttatctgacccagttcatggagccattgaagtatgtgcccagttacggccaactgttgacatatcggtgccagcagatgctgattttgtacgcccagagctgcgtcagtaatgcagttagatttcttttagtgctagcatgctgttttgaaatttaggtacttcccatgtactagagcactgtaagttgccaattttttttgttatctttgttggtgtgtttcttgacgagttgtccgctaaatagtgaatgtagaactataagatgtgcggcaaatgctatgtga

SEQ ID NO: 2151 - DNA, 1794 bp, Cirsium arvense
atcgtctctcaaaactccacctaaaaccctagggttcagcctagggtttacatcttcaaaaacttccttcaaatcgctccaaactcgtgtgttttcttcctctggttctggttcagctatccgagctcgtgtggtgtcggcgccggagattactacgtcgccggatttgctcgatttcgaaacctctgttttcaaaaaggagaagattaatctcgctggttatgatgagtacattgtgagaggaggaagagatttgtttcatttgttgcctgatgcctttaaaggtattaagcagatcggtgttatcggttggggttctcagggtcctgctcaagctcagaatctaagggattctctagcagaagcgaaatctgatattgtagtgaagattggcttaaggaagggttcaagttcatttgctgaggcacgtgctgctggttttaccgaagaaactgggactcttggagatatttatgccactatttcgggtagtgacttggtcctgctcttgatatctgattcagctcaggctgataactatgagaaaatcttctcccacatgaagcctaacagcatacttggactttcccatggtttccttcttggtcacttgcaatcaactggtcttgatttccccaagaatgtcagtgtggttgctgtatgtcccaaaggaatgggtccatcggttaggaggttgtacgtccaaggaaaggagatcaatggagctggaatcaacgcaagctttgctgtccatcaggatgttgatggcagagccactgatgttgcacttggatggtcagttgctcttggttcaccatttacatttgcaactacactagagcaggagtacaaaagtgatatctttggggaaagaggtattttacttggtgctgtacatggtattgtggagtcgttatttagaagatacactgaaaatgggatgagtgaagatttggcttacaagaatacagtagaatgcatcactgggataatatcacgcacgatatcaactaaggggatgaaggctgtctatgagtcgctatcagaagaaggcaagaaagatttcttgaaggcatacagtgcttcctattatccttgcatggacatcttgtacgagtgctacgaggatgtagccagtggcagtgagattcggagtgttgttttggctggccgtcgcttttatgaaaaagaagggctgccagcctttccaatgggcaaaattgatcaaactcggatgtggaaagttggtgaacgtgttcgtgctagtcgtccagctggcgatttagggccattgtatcctttcaccgctggtgtctatgtggcattaatgatggcccagatcgaagtattgaggaagaaaggacactcttattctgaaatcatcaacgaaagtttgatcgaatctgtggattccttgaatccattcatgcacgctcgaggtgtttctttcatggtggacaactgttcgacgaccgcaagattgggatcaaggaaatgggctccacggttcgactacgtgctaacccaacaggctttggttgctgtggataatgacacaccgatcaaccaggatcttgttgcaaacttctttgaagatccggttcacgaagcggtcaaagtgtgtgcggaattgagaccgactgttgatatctcggtgcctgcagatgccgactttgtgagacccgagctacgtcaatctagcaactaaaaagcaacgaatgaggttagatttagatcgaccatagtgttgctattttattttacttatgatgtatttgttatcgatgtgatatc

SEQ ID NO: 2152 - DNA, 1943 bp, Festuca arundinacea
  misc_feature (1349)..(1349): n is a, c, g, or t
  misc_feature (1616)..(1616): n is a, c, g, or t
ggcacgaggcacagcccttcgcaccccagagagacgcaatggcggcgcccacctcctccgcgccctccacccgacccttctcccaccccaaaaccctagccgccgccgccaccctctccgcctccgtcgccttccccgccacacacccgtcatgcgccctcgccacccgccgccgcgcggtcgccgccatggtcgccgccccggccaaggtgggggccgccatgccctcgctcgacttcgacaccgccgtcttcaacaaggagaaggtctccctcgccggccacgaggagtacatcgtgaggggtgggcggaacctcttcccgctgctcccggaggcgttcaagggcgtcaagcagatcggggtcatcggatggggctctcagggtccggcacaggcccagaacctcagggactccttgactgaagccaagtctgacattgttgtcaagattggtctccggaaaggttccaaatctttcgaggaagcacgtgcggccgggttcactgaggagaacggaaccttgggagatatatgggagacggtttcaggcagtgatcttgtgttgctgctcatatctgattctgcacaggcagacaactatgagaagatcttctctcacatgaaaccaaacagtattcttggtttatcgcatggatttctccttggacatttgcaatcagctggccttgatttccccaagaacatcagtgtggttgctgtttgccccaagggaatgggcccatcagtgcggagactttatgttcagggcaaagaagtaaatggtgccggtatcaatgctagcttcgctgttcaccaggatgttgatggaagggcaactgatgttgctctaggatggtcagtggcactaggatccccgttcacatttgctactactttggaacaggagtacaagagtgatatctttggggagcgaggaattttgctcggtgctgtccatggcatcgtggaggctctgtttaggagatacacagagcaaggaatggatgaggaattggcatacaaaaccactgtagagggcatcactggaattatctcaaaaaccatctcgaagaagggtatgcttgaagtgtacaactctttgagcgaggaaggcaaaaaggagttcaacaaggcgtacagtgcatcattttatccttgcatggatatcctctatgagtgctatgaagatgttgcctctggaagtgaaatcaggagtgttgtgttggccgggaggaggttttatgataaggaaggtctccctgctttccctatgggcaaaatcgaccaaacccgtatgtggaaggttggtgaaaaggtgcgctcaacccggccacagggtgaccttggnccacttcaccccttcaccgctggagtttatgttgcactaatgatggcccagatcgaggtcctcaggaagaagggccactcctactctgagatcatcaacgagagcgtgatcgagtctgtagactccctgaaccccttcatgcacgcgagtggggtggccttcatggttgacaactgctccaccaccgcccggttgggatcaaggaagtgggcgccacgctttgactacatcctgacccagcaggctttcgtgactgtcgacaaggangcgcccatcaaccaggatctcatcagcaacttcttttcggaccctgtccacggcgccatcaaggtctgcgccgagctgaggccgaccgtcgacatctcggtgacggccgacgctgacttcgtgcgccccgagctcaggcagtctgcctagataggtctgtcgggtcgggggttgaagcaagagttggtttttgatgggatgtccatggactgtaacttatgtgtgcggatcaagtctgaacttgtgagctgctgtcagattagagagcccatggttgggttggactgaactgtcgtcatttcgagaataaagttagttcgtccggtt

SEQ ID NO: 2153 - DNA, 2065 bp, Arachis hypogaea
tctcttcgtttttctctctattcactctacttgcttcttccaacgatagtaatggcggctgcgacgtcgttttctgccacaatcaccgcaaacccggaaaccctagctgggcctgtttcaggaagaaccctcgccgttgcaaacgccaacgctaatggaaacgtctcattccgacaatccttgtcgtcatcatcctcgaagctgagcttcggatcactgaagtgtagccgacggaactccaccggagctcttggagcttgcatggtgtcggcgccggctgtgaaggctcccgtctcgctcgatttcgacacctccgtcttcaagaaggagaagatcagcctcgcgggacacgacgagtatatcgtgaaaggaggtagggatttgttccatttgttgccagatgctttcaaagggattaagcagattggtgttatcggttggggatcgcagggacctgctcaggctcagaatctcagggactcgcttgctgaagctaagtctgatattgtggtcaagattgggctcaggaaaggttctcggtcatttgctgaagctcgagcggctggtttttctgaggagaatgggactctaggtgacatatgggaaactgtctccggcagcgatcttgtgttgctgttaatttctgatgctgcacaggcagataactatgaaaaaattttctcctatatgaaatcaaacagcatacttgggctgtcccatgggtttcttcttgggcatttgcagtcgttgggacttgattttccaaagaacattagtgtaattgctgtgtgcccaaagggaatgggtccatcagtaaggagactctatgtacaaggaaaagatataaatggtgctggaattaattcaagtttcgcagttcaccaggatgtggatggtagagctactgatgttgctctgggatggtcagttgcccttggttccccattcacttttgccactacactggagcaggaatacaagagtgatatctttggggagagaggaattttacttggtgctgttcatggagttgtggaagccttgtttagaaaatacactgaaaatggagtccccgaagacctagcctataagaacactgttgagagcataacaggaattatatctaaaaccatatcatctaagggcatgcgggaggtatactatgctttagatgatactgggaaaagcatatttgaaaaggcatatagtgctgcttattacccgtgcatggagattttgtatgaatgctatgaggatgtagccagtggtagtgagattcgcagtgttgttctggctggccgacgtttttatgagaaagagggtctacctgctttccccatgggtaaaattgaccagacccgcatgtggaaggttggcgagcgtgtccgatctacaagaccagcgggtgatctaggcccattagatccaattaccgctggtgtctttgtggcattgatgatggctcagattgaaatcctgaggaagaaaggacattcctactccgaaatcatcaatgagagtctcattgaggctgttgattcattgaatcctttcatgcatgctcgaggtgtttccttcatggttgataactgttcaaccacagcacggttgggttcgaggaaatgggctccccgatttgattacatcctaacccagcaggccttagtggcactggaagaatgtgcgcctatcaaccgggacctaatcagcaacttcctgtcagacccagtgcatggagccattgaagtctgtgcacagctgagacccaccgtcgacatctccgtgccaccggatgcagactttgttcgtcctgagttgcgccagtccaactagaaagaattatacgcttttatttgatgaaatcactttttagaatgcgtagaaaactagaacgtctggttggttggttggtttgggtttcctgttttgtttacctggttaaccagtatcattgtacgttgtactattactttgtactttgcagttcttagttcgtatgatgttttgagaatgaggaatgatgcctgttatcggattagaaatataaataaattatgttcacagt

SEQ ID NO: 2154 - DNA, 2031 bp, Vinca minor
gctcccctcctaactctacttcccactcaatcgcactaataatggcggcgtcagcagctacttctctttccgtctccaccactccggcaaccaaaaccctaatatcccaaacaacatcagtagtacacaatctgagtttcctttcttcctcgacgccttctctgaagcctttggtagctcgcgcagcctctacatctgtatctgtatcatctcacggaggtggagccggagccgccgcttctcgtatggtatctacacctgccgccgctgtgaagcccctaacttctcttgattttgagacctcagtcttcaagaaggagaaagtcagtcttgctggccacgaggagtatattgtgagaggaggaagagatttattcaagctgttgcctgacgcattcaagggtatcaagcagattggtgtcatcggttggggttctcagggacccgctcaagctcagaatctaagagattcacttgccgaggcaaaatctgatattgttgtcaagattggattgaggaaaggttctcgttcatttgctgaggcccgtgcagctgggtttagtgaggagaatggtacccttggagagatatacgagactatatctggcagcgatctagtgcttctcttaatttctgatgctgcacaggctgataattatgaggaagtgttttcgcacatgaagccaaacagtatccttgggctttctcatgggtttcttcttggccatttacagtcaattggaaccgactttccgaagaatattagtgtaatagctgtatgtcccaagggaatgggtccatcagtgagaaggttatatgtgcaaggcaaagaaatcaatggtgctggtatcaatgctagttttgctgttcatcaggatgttaatgggagggctacagatgttgctctcggttggtcagttgcccttggttctccttttacctttgccactactctggaacaggagtacaagagcgacatctttggggagagaggaattttactgggtgctgtacatggcattgtggagtcactgttcagaagatacactgagaagggaatggctgaagatcttgcatacaagaacactgtggagtgtataacaggaatcatttcgaaaagcatatcaacaaagggcatgttgtctgtttacaatgcattaactgaagaagaaaagaaggaatttgaggctgcctacagtgcttcttactatccctgtatggatatcttgtatgaatgctatgaagatgtggctaccggaagtgagattcggagtgttgtcttagctggacggcgcttttatgaaaaggagggtctccctgccttcccaatgggcaagatcgaccaaacaagaatgtggaaagtaggtgagagagtccgagcagttcgacctgctggtgatttgggccctttacatccgttcacagctggtgtttatgttgctttgatgatggcacagattgagatcttgaggaagaaagggcactcctattctgaaatcataaatgaaagtgtgatcgagtctgtggattctctaaatcctttcatgcatgctcgtggggttgcgttcatggttgacaattgttcaacaactgcacgactaggatctaggaaatgggctccccggtttgattacatcctcacgcagcaggctcttgtggctgtggacaacaaaactccggttaacggggatctcatcagtaatttcctatccgatccagtgcacggagctattgaagtgtgtgcccagctgagacctactgttgacatttcagtgcctgaagatgccgatttcgtgcgcccagagctccgtcagtctaactaaagctatatatctcaaatcttgatgtcaaattaccgggagctaagccaattgaagagccaaatagatttagctaatatctagcttttaatgtatgcaattgaggtgtaagttttttttttttgttttgtttgagactttgcagtgcatattttcttctccagtgtacttgtcttattagtatgcgagaattgttgtgtatggtgttctt

SEQ ID NO: 2155 - DNA, 1957 bp, Arnica chamissonis
ctactgacacaaagctcagttacctttgctccgccgtttcccctcgtccacatcacatttcacgacaatggcgacggcgaccacctctttctcaaccttggcccctaccacctcatcgtcggcagcggcggcgtctctcaagattgctcccgaaaacgctacggtttaatgtggattttgtgtcttccaaaacttcctccaaatccctcaaagctcgctccaatggcggttctggatctgctctcggagctcgtatggtttcagcgccagcaataagcataactccaacgcttcttgattttgagacctctgtcttcaaaaaggagaagattaaccttgctggtcatgatgagtatattgtgagaggaggaagagatttgttccacctgttacctgatgcctttaaaggtatcaaacagattggtgttattggatggggttctcagggtcctgctcaagctcaaaatcttagggattctcttgtagaagcaaaatctgatattgtagtgaagatcggcttacgaaagggttcaagttcattcaacgaggctcgtgcagctggcttctccgaagaaactggaacccttggagatatttatgagactatctccggcagtgacttggttctgctcttaatttctgattcagctcaggctgataattatgagaaaatcttttcatacatgaagccaaacagcattcttggactttcacatgggttccttcttggtcatctgcaatcagttggtctcgatttccctaagaacataagcgtggttgctgtgtgtcccaaaggaatgggtccatctgtcaggagactatatgttcaaggaaaagagattaatggagctggaatcaatgcaagttttgctgtccatcaggatgttgatggtagagccactgatgttgcacttgcatggtcagttgctcttggttcaccctttacatttgccactacacttgagcaggagtataagagtgatatattcggggagcgaggtattttacttggtgcggtgcatggtattgtggagtctttgtttagaaggtatacagaaggtggtatgagtgaagatttggcttacaaaaacaccgtagagtgcataactggcataatatcaaggacaatctcgactcagggcatgaaagctgtatacgagtcattaaccgaagaaggtaaaaaagagttcttgacagcatacagtgcatctttctatccttgtatggagattctgtatgagtgctatgaggatgtggcaagtggcagtgagataagaagtgttgtgttggctggtcgtcgatttcatgaaaaggagggtttgccagcattccctatgggcaagattgatcagactcgaatgtggaaggtaggcgaacaggttcgtgccgttcgacccacgggtgatttaggcccgttacatcctttcacagctggtgtttatgttgcactaatgatggctcagattgaggtgttgaggaagaaaggacattcttactcagagatcatcaatgaaagcttgatcgagtcggtggattcgttgaacccattcatgcacgctcgaggtgtgtcgttcatggtggataactgttcaacaactgcacggttgggatcgaggaaatgggctccacgctttgattatattcttacccaacaggctttagttgctgtagacaatggggccccacttaaccaggacctgatcagcaacttctttgaagatccagtgcatgaagctgtgaaagtttgtgcagagttgagaccaaccgttgacatctcagtgcctgctgatgctgattttgtcagacccgagttgcgtcaaggtagcaactaagaatgctctcgggtgttgtctagtttgtcttggactcttggtgctatgcaggttgttatgtatgatgtgtttcctgttgatgttgtgttctaactttgttgaatttggtaataaaagttgtccgg

SEQ ID NO: 2156 - DNA, 1945 bp, Elaeis guineensis
attctcgtcgtcgtcctccagatccctgaggcttctcctctcccggatgcacatggatgcggccgcggcagggcggggtggcgccgccgccctcggagctcgaatggtctccgtgccatccatcagcaagcccgctccctctcttgacttcgagacctccgtctttaagaaggagaagatcaccctcgccggtcaaaatgagtatattgttagaggtgggagggatttattccatttgttgccagatgccttcaaggggatcaagcaaattggcgtgattggttggggatcccagggtcctgcccaagcacagaacttgagggattcacttgcagaggcacaatcagacattgtggtcaagattggtctgagaaaaggttctcgttcctttgaggaagcacgtgctgctgggtttactgaagaaaatggaaccttgggtgatatctgggagacaatttcaggcagtgaccttgtcttgttgctgatttcggattctgcacaggcagacaactacgagaaagtattctctcacatgaaaccaaacagcattctggggctgtctcatggttttcttcttgggcatttgcaatcccttggccttgatttcccaaaacatcagcgtgattgctgtatgtcctaaggggatgggtccatcagtgagaaggttgtatgttcagggaaaagagataaatggtgcaggaatcaattccagttttgctgtccatcaggatgttgatggcagggccacagatgttgctctggggtggtcagttgctctaggatctccttttacatttgccactactttagagcaggagtacaagagtgacatttttggggagcgtggtattttgcttggtgctgtgcatggaattgtggaggccttgtttagaaggtacactgagaatggaatgagtgaagaaatggcttataaaaacacagttgagtgcatcacaggaattatgtcaaagaccatttcaacaaagggtatgctctctgtatacaactctctgactgaagaagagaaaaaaggaatttaatgctgcatatagtgcatcatactatccttgcatggatatcttgtatgagtgttatgaggatgttgcctgtggcagtgaaatttgcagtgttgttttagctggacgacgcttttatagaaaaggaagggcttcctggctttcccaaatgggtaaaatcgatcagacacgaatgtggaaagttggtgagcgagtccgtgcggctcgacctgagggtgacttgggccccttgcacccgtttactgctggggtttatgtggctctaatgatggctcagattgaggtcctaagaaagaagggacattcttactcagagatcattaatgagagtgtgatcgagtcagtggattccctaaatcctttcatgcatgctcgcggggtgtcattcatggtggacaactgttccacaaccgcgcgcctggggtcaagaaagtgggctccgcgttttgattatatccttactcagcaagcattagtagctgtcgacaagaacgctcctatcaatcaggacctactcagcaacttcttttccgatccagtgcatggtgctattgaagtctgtgcagagttgaggccaactgttgatatatctgtgccacctgatgcagattttgtgcgtccagaattgcgacaaactggcaattgagaaatggcaatagattttgatagatagcctacagccattgtgatattttgagagggtaatcttagcatcaaagctctataaacatctaggttgtatgtgcatgcgaacattgtgcggtctctgagtgcgtagtgtctgaataaattggtgcgtggctgggcatcagttgtgtgtacgttgctacttgtttgacagttaattgagtaatccctgggagtcgtttgtagctttctgagatctttccctattttttttttttttt

SEQ ID NO: 2157 - DNA, 2163 bp, Brassica rapa
aggtaaaaaccgagtgttcgtgtcagtatccgtggtccctttaataatcggctgctcctctcgcagacgttttgctacacttgagataacagatggcggctgctacttcatccatcgctcctcccctctcgtgcccgtctctttcttcttccctcaggtcatcgaaaggcacaagctttgctttgcccagcatcagtttcgtctcgtctacttcaaagtctctgaggtcgctcactgccaccgtccctggaaatggaaccggatcttccctctccgcgaggatggttgcgtcgtctgcggtcagagcacctgtttctctcgatttcgagacgtctgtgttcaaaaaggagaaggtctctcttgctggttacgatgagtacattgtgagaggaggaagggacttgttcaagcatcttcctgatgctttcaaaggggttaagcagattggtgtcattggctggggttctcagggacctgctcaagctcagaatctaagggattcacttgtggaggctaagtctgacattgttgttaagattgggcttagaaagggatctaaatcgtttgaggaggcacgtgcagttggcttcactgaagagagtggtactttgggtgatatatgggaaaccatctctggcagcgatcttgtcttgcttttgatctctgatgctgctcaggctgataactatgagaaaatattctcacacatgaagccaaacagcattctcggtctgtcacacgggtttctactagggcatttacagtcaatgggacttgatttcccaaagaacatcagcgtggtagctgtttgccctaagggaatgggtccatccgtgaggaggctttatgtccaaggcaaagaaatcaacggtgctggaatcaacgctagttttgcagtccaccaggatgttgacggtagagccgctgatgttgcgccgggatggtcagtagcacttggttctccttttacttttgctactactcttgagcaagagtacaagagtgacatctttggagaaagaggtattttgcttggtgcggttcacggaatcgtggagtctctctttagaaggtacaccggaaatggaatgagcgaagacttggcttacaagaacacagtagagtgcatcacaggaacaatctcaaggactatctctactcagggaatgttggctgtctacaactccttgtctgaagaaggcaaaaaggacttcgagactgcatacagtgcatccttctacccttgtatggagattctctacgaatgttacgaggatgtagcagctggcagcgagatccggagtgttgtcttagccggtcgtcgcttctatgataaggagggcttgcctgcattcccaatgggtaagattgatcagacaagaatgtggaaggtcggtgaacgtgtcaggaagtccagaccagctggtgacttgggtccgttgtatcccttcaccgctggagtttacgttgcccttatgatggctcagattgagatcttgaggaagaagggtcactcatactcggagatcatcaacgagagtgtgattgagtctgttgattctctcaatccgtttatgcacgctagaggagtgtccttcatggtggacaactgctcgaccacagcgagattgggatcgaggaaatgggcaccgagattcgactacaacctgacgcaacaagctttagtggctgtggacagtggtgcaccaatcaacaaagacttgataagcaacttctttgctgatccagtccatggtgctatcgaggtctgtgcacagctcaggcctaccgttgatatctctgtgcctgaagatgcagattttgttcgacctgagctgcgtcagtctagctgagtgaatggttgaatgattatcagtttcttttgatgtaacggtttgaaaaaaaaaaagacaaatgggttttggaaggtttaggcgtgagtgtttcgttttggacggtttgaataatgatgtctctttgtctctttggacgttccattaatggaatgttctcttatgttctgtctgctttggttaaatcttcttacactccttaaaggggtttatggcggaaataaattactatattaagaggtattattctggcgacatgactatcgatttggattctgttattcagaaaatattttcttttagtctgaag

SEQ ID NO: 2158 - DNA, 2193 bp, Sorghum bicolor
taggatgtgactgtcctactgtcaccaacttttctgccctacaatcccacgcataaaaaagctcacggacgcatctccggaaatcccctctttccagccagccaccctcacgcttcagtagccccttcgctcctccgaaatggcggcggccacctcctcctccacctacctcgccatcgcccgcaaaaccctaaaccccgccccctccgtaggcacagccgccgcctccgtctccttccccgccacgcagcccccatgcctcctcgccgcctccgcggaccgccgccgcgccgtggctgcgaaggtctcgtcgccgtcggttatcggcaccgccatgccatcgctcgacttcgagacctccgtcttcaagaaggagaaggtgtccctggccggccatgaggagtatattgtgaggggtgggagggatctgttcccgctgttgccggaggccttcaagggaatcaaacagatcggcgtaatcggctggggctcgcagggtcctgcacaagctcagaacttgagagactcacttgttgaggcaaaggcagacgttgttgttaagattggtctccggaaaggttctaaatcgtttgaagaagcccgagcagcggggttcactgaagagagtgggacactgggtgatatatgggagactgtatcaagcagtgatcttgttttgctgctgatatctgattctgctcaggctgataactacgagaaaattttctcacacatgaaaccaaacagtattcttggtttgtcacatggatttctccttggacatttgcaatctctgggtcttgatttccctaaaaacatcagcgtgattgctgtatgccccaagggaatgggtccatcagttagaagactttatgttcagggcaaagagattaatggtgctggtatcaatgctagctttgctgttcaccaggatgttgatggaagggcaacagatgtagctctagggtggtcagtagctctaggttctcctttcacatttgctactactctagagcaggagtaccggagtgatatttttggcgagcgaggtattttgcttggtgctgtccatggcatggtggaggctctttttaggagatacacagaacaaggaatggatgaggactcagcatataaaaatacagttgagagcatcactggaattatatcgaaaactatttcaaagaaggggatgcttgaagtgtataactctttgaccgaagaaggaaagaagcagtttattgaggcctacagcgcagcatattacccatgcatggacatattgtatgagtgctatgaagacgtttcttctggaagtgagattagaagtgtggtgttggctgggaggagattttatgagaaggaagggcttcctgctttccctatggggaatattgatcaaacacgtatgtggaaggtgggtgaaagggtccgttctaccaggccacaaggtgatcttggtccattgcatcccttcactgctggagtgtatgttgcactaatgatggctcagattgaggtcctaagaaagaagggccactcttactcggagatcattaatgagagcctgatcgagtctgtggactcgttgaacccgtttatgcatgctcgtggtgtggccttcatggttgataactgctccacaactgctcgcttgggatcaaggaagtgggcaccacgcttcgattacatcttgacccaacaagcgtttgtgaccgttgacaagaaagcaccaatcaaccaagacctcatcagcaacttcatgtctgaccctgttcacggtgccattgaagtctgcgctcagctgaggcccactgttgacatctcagtgactgctgatgcagatttcgtgcgtccggagcttcgacagtcttcataagctcgtatggatcttcagtgtgtcctgcaatggttagtttgtaagaactaatatgtgtgggcttttgaactcttagattacctgtattgctcctgtttgaggaccagacaagtaaactcttggggtgtagtactgttgtggtttgcaagaataagaataaatggttgataccaaatgtctgattcggtattccctttttgatgtgaatgctgtagggctcatagctgaggctcgggatctaagtcttattctgaatatcatgaacccaaggttcgggctcaagctaattgtggtcaccatttcgacttcgattt

SEQ ID NO: 2159 - DNA, 2047 bp, Capsicum annuum
gcacgaggccctttatcattggtctccttccaacctatggcggcggctgcaacaacctcattctccatctccaccgcttcctcctcttccgcgtcctcttccaaatcccttaaaccttctcttgcttccaatctagggtttctctcctcagcgccgtcgcttaagcctcttagagctaaaaccgctgtttcagccggaggttctagctccggcggcgctatggcggcgaagatggtgtcggctcctgctgctgttgtgaaggcgcctgcttcgtttgattttgaaacgtccgtgtttaagaaggagaaagttacccttgctggaaatgatgagtacattgtgagggggggaagagatttgttcaagtatttgcctgatgctttcaaaggaatcaagcagattggagttattggctggggttctcagggacctgctcaagcccagaatttgagggattctctcgcagaaataaaatccgatatagtcgttaagattggtttaagaaagggttcaagctcatttgcagaggcccgcgcagccgggtttactgaagagaatgggagccttggtgacatatatgagactatctctggcagtgatctcgtgctgcttttgatttctgatgctgctcaggctgataattatgagaaagtgttttctcacatgaagccaaacagcatacttgggctttcacatggattccttcttggccatttgcagtcaacaggcctagacttcccgaagaacattagtgtgattgctgtatgtcccaagggaatgggtccctcagtcaggcgattatatgttcaaggaaaagaaatcaatggtgctggaattaatgcaagttttgcagtccaccaggatattgatggaagggccacagatgttgctctagggtggtctgttgcccttggttctccctttacttttgctactactctagagcaggaatatagaagtgacattttcggagaacgaggcattttactcggtgctgtccatggagttgttgagtcacttttcagaaggtacactgagaatggaatgagtgaggagcttgcctacaagaacactgtagagtgcataacaggaatcatttcaaggaccatatcaacaaagggcatgttggccgtgtacaactcatttactgaggaaggcaagagggattttgaggctgcatacagtgcttcattttacccctgcatggagattttgtatgagtgctatgaagatgtagctgcaggtagcgagatcaggagtgttgtcttggctggccgtcgcttttatgaaaaggagggcttaccagccttcccaatggggaaaattgacggaacaaggatgtggaaggttggtgagcgtgttcgagcaacacgaccagcgggtgatcttggtcctctgtatcctttcactgctggtgtctatgtggcattgatgatggcccagattgaggttttgaggaagaaaggccactcttactcggagattataaatgaaagcgtcatcgagtctgtagattccttgaatccattcatgcatgctcggggagtatcattcatggttgacaattgctctacaacagcacgtttaggttccaggaagtgggcccctcgatttgattacaatctcacccaacaagcactggtagctgtggataataatgcccctatcaatcgggatctcatcagcaacttccttgcagatcctgtgcatggagctattgaagtttgtgctcaactgagacccacagttgatatttctgtaccagcagatgctgatttcgtccgccctgaactcaggcaatctggcaattgagggctttttgggtcacctagtgagcgaaggagaattttatggaattgaggttgagattttatattattgtgttgttgatgtaggcaagaatacctatttaaatctgttgagctcataagaatcttagcctttgttgttgcttatctatgccggtgctactagcacgcactttatgtagcctttgttgaataacaggataaatgtatttgaaatttgggtacccttttagcaacta

SEQ ID NO: 2160 - DNA, 2452 bp, Oryza sativa
acttagcaaactttttttaaattatttttttcgagaaacacgcttagcaaaccgaaggtaggaaaaatgcactcttttcatttcacctagacacaacctagtttttttttatgttagtagccatagcaatatcatattgtaccgtacattgcagcacaaatataaaccctcagacgtatccctagtgaatccctctttccactcccgcagtcacaccctaagcccctcctcgcatcccaaaatggcggcggccacctccacttcctccaccgcgctcgcccaccccaaaaccctaaaccccgcctccaaatccgcggccgccggctcggtctccttccccgccgcccagcccccatgccccctcgccgcctccgccggcggccgccgccgccgcggcgccgtggccgccaaggtctcgtcgccgcaggtgatcggggccaccatgccgtcgctggacttcgagacatccgtcttcaagaaggagaaggtgtctctagctggccatgacgagtatattgtgaggggcgggaggaatctgttcccgctgctgccggaggcgttcaaggggatcaagcagatcggcgtaatcggatggggttctcagggtcctgcacaagctcagaacctgagggactcacttgctgaggcaaaatcagacatcgttgttaagattggtctccggaaaggttctaaatcttttgaagaagcacgcgcagctggatttactgaagagagtgggacacttggagatatatgggagactatctcaagtagcgatcttttgttgttgttgatatcagatgctgctcaggcggataactatgaggaaattttctcacacatgaaacccaacagtattcttggattgtcacatggatttctccttggacatttgcaatctgttggccttgatttccctaaaaacatcagtgttgttgctgtgtgtcccaagggaatgggcccatcagttagaaggctttatgttcagggaaaagaagtaaacggtgctggtatcaactccagctttgctgtacaccaggatgttgatggaagagcaacagatgtcgctcttggatggtcagttgctctaggttctcctttcacatttgctactactctagagcaggagtaccgaagcgatatttttggcgagcgaggtattttgcttggggctgtacatggtattgtggaggctcttttcaggagatacacagagcatgggttggatgaggactcagcatacaagaacactgttgagtgcatcactggaatcatctctaaaactatttcgaaaaaggggatgcttgaagtgtacaattcattgacagaagaaggaaagaagcaatttatcgaggcttacagtgcagcatattatccatgcatggatatactatatgaatgctatgaagatgtttcttctggaagtgaaattagaagtgttgttttggctggaaggagattttatgaaaaggaaggacttcctgctttcccgatgggcaacattgatcaaacacgtatgtggaaggtgggtgaaagggtgcggtcaacacggccagcaggtgatcttggcccattacatcctttcactgctggagtgtatgttgcacttatgatggcacagattgaagtccttagaaagaagggccactcttactcggagatcatcaacgagagtttgatcgagtctgtggattccctgaacccattcatgcacgctcgtggggtggccttcatggttgataactgctccacaacagcccggttgggatcaaggaaatgggcgccacgcttcgactacatcttgacccaacaagcttttgtgactgttgacaagaatgctccagttaatcaagacctcatcagcaatttcttctccgatcccgtccatagtgccattgaagtctgtgctcagttgaggcccaccgttgacatttcagtgcctgctgatgcagactttgtgcgtccagagctgcgacaatcttcgtgaagtttttgccaactccaggggcacctcataaactatgtcagtatctgacggtttcaactctcaaagctatgtatcactatttgagaacctaaatgtaaacttttggagtgtaggattgtcgtttggttgtcactggactagtgctggtgtttggcatgaataaaaatagtggtttaataaatgccgttcccttagagcagcagaggtggctgctccctctaattcaatccatattatcgtaccacgaattaagaggtaaaacgcacagacccccaatatctttagcactagtacatttttcttagctttggaccccatgttacatcgaatgtttggatacatgcgtgtaaattgcaagacaaatcttttaagcttaattgctacatgatttgacaatatggtgttacagtaaacatttgctaatgatggattaattatgcttaataaattcgttttgcagtttaa

SEQ ID NO: 2161 - DNA, 1975 bp, Oryza sativa
cctctttccactcccgcagtcacaccctaagcccctcctcgcatcccaaaatggcggcggccacctccacttcctccaccgcgctcgcccaccccaaaaccctaaaccccgcctccaaatccgcggccgccggctcggtctccttccccgccgcccagcccccatgccccctcgccgcctccgccggcggccgccgccgccgcggcgccgtggccgccaaggtctcgtcgccgcaggtgatcggggccaccatgccgtcgctggacttcgagacatccgtcttcaagaaggagaaggtgtctctagctggccatgacgagtatattgtgaggggcgggaggaatctgttcccgctgctgccggaggcgttcaaggggatcaagcagatcggcgtaatcggatggggttctcagggtcctgcacaagctcagaacctgagggactcacttgctgaggcaaaatcagacatcgttgttaagattggtctccggaaaggttctaaatcttttgaagaagcacgcgcagctggatttactgaagagagtgggacacttggagatatatgggagactatctcaagtagcgatcttttgttgttgttgatatcagatgctgctcaggcggataactatgaggaaattttctcacacatgaaacccaacagtattcttggattgtcacatggatttctccttggacatttgcaatctgttggccttgatttccctaaaaacatcagtgttgttgctgtgtgtcccaagggaatgggcccatcagttagaaggctttatgttcagggaaaagaagtaaacggtgctggtatcaactccagctttgctgtacaccaggatgttgatggaagagcaacagatgtcgctcttggatggtcagttgctctaggttctcctttcacatttgctactactctagagcaggagtaccgaagcgatatttttggcgagcgaggtattttgcttggggctgtacatggtattgtggaggctcttttcaggagatacacagagcatgggttggatgaggactcagcatacaagaacactgttgagtgcatcactggaatcatctctaaaactatttcgaaaaaggggatgcttgaagtgtacaattcattgacagaagaaggaaagaagcaatttatcgaggcttacagtgcagcatattatccatgcatggatatactatatgaatgctatgaagatgtttcttctggaagtgaaattagaagtgttgttttggctggaaggagattttatgaaaaggaaggacttcctgctttcccgatgggcaacattgatcaaacacgtatgtggaaggtgggtgaaagggtgcggtcaacacggccagcaggtgatcttggcccattacatcctttcactgctggagtgtatgttgcacttatgatggcacagattgaagtccttagaaagaagggccactcttactcggagatcatcaacgagagtttgatcgagtctgtggattccctgaacccattcatgcacgctcgtggggtggccttcatggttgataactgctccacaacagcccggttgggatcaaggaaatgggcgccacgcttcgactacatcttgacccaacaagcttttgtgactgttgacaagaatgctccagttaatcaagacctcatcagcaatttcttctccgatcccgtccatagtgccattgaagtctgtgctcagttgaggcccaccgttgacatttcagtgcctgctgatgcagactttgtgcgtccagagctgcgacaatcttcgtgaagtttttgccaactccaggggcacctcataaactatgtcagtatctgacggtttcaactctcaaagctatgtatcactatttgagaacctaaatgtaaacttttggagtgtaggattgtcgtttggttgtcactggactagtgctggtgtttggcatgaataaaaatagtggtttaata

SEQ ID NO: 2162 - DNA, 2157 bp, Sorghum bicolor
ccctacaatcccacgcataaaaaagctcacggacgcatctccggaaatcccctctttccagccagccaccctcacgcttcagtagccccttcgctcctccgaaatggcggcggccacctcctcctccacctacctcgccatcgcccgcaaaaccctaaaccccgccccctccgtaggcacagccgccgcctccgtctccttccccgccacgcagcccccatgcctcctcgccgcctccgcggaccgccgccgcgccgtggctgcgaaggtctcgtcgccgtcggttatcggcaccgccatgccatcgctcgacttcgagacctccgtcttcaagaaggagaaggtgtccctggccggccatgaggagtatattgtgaggggtgggagggatctgttcccgctgttgccggaggccttcaagggaatcaaacagatcggcgtaatcggctggggctcgcagggtcctgcacaagctcagaacttgagagactcacttgttgaggcaaaggcagacgttgttgttaagattggtctccggaaaggttctaaatcgtttgaagaagcccgagcagcggggttcactgaagagagtgggacactgggtgatatatgggagactgtatcaagcagtgatcttgttttgctgctgatatctgattctgctcaggctgataactacgagaaaattttctcacacatgaaaccaaacagtattcttggtttgtcacatggatttctccttggacatttgcaatctctgggtcttgatttccctaaaaacatcagcgtgattgctgtatgccccaagggaatgggtccatcagttagaagactttatgttcagggcaaagagattaatggtgctggtatcaatgctagctttgctgttcaccaggatgttgatggaagggcaacagatgtagctctagggtggtcagtagctctaggttctcctttcacatttgctactactctagagcaggagtaccggagtgatatttttggcgagcgaggtattttgcttggtgctgtccatggcatggtggaggctctttttaggagatacacagaacaaggaatggatgaggactcagcatataaaaatacagttgagagcatcactggaattatatcgaaaactatttcaaagaaggggatgcttgaagtgtataactctttgaccgaagaaggaaagaagcagtttattgaggcctacagcgcagcatattacccatgcatggacatattgtatgagtgctatgaagacgtttcttctggaagtgagattagaagtgtggtgttggctgggaggagattttatgagaaggaagggcttcctgctttccctatggggaatattgatcaaacacgtatgtggaaggtgggtgaaagggtccgttctaccaggccacaaggtgatcttggtccattgcatcccttcactgctggagtgtatgttgcactaatgatggctcagattgaggtcctaagaaagaagggccactcttactcggagatcattaatgagagcctgatcgagtctgtggactcgttgaacccgtttatgcatgctcgtggtgtggccttcatggttgataactgctccacaactgctcgcttgggatcaaggaagtgggcaccacgcttcgattacatcttgacccaacaagcgtttgtgaccgttgacaagaaagcaccaatcaaccaagacctcatcagcaacttcatgtctgaccctgttcacggtgccattgaagtctgcgctcagctgaggcccactgttgacatctcagtgactgctgatgcagatttcgtgcgtccggagcttcgacagtcttcataagctcgtatggatcttcagtgtgtcctgcaatggttagtttgtaagaactaatatgtgtgggcttttgaactcttagattacctgtattgctcctgtttgaggaccagacaagtaaactcttggggtgtagtactgttgtggtttgcaagaataagaataaatggttgataccaaatgtctgattcggtattccctttttgatgtgaatgctgtagggctcatagctgaggctcgggatctaagtcttattctgaatatcatgaacccaaggttcgggctcaagctaattgtggtcaccatttcgacttcgattt

SEQ ID NO: 2163 - DNA, 2101 bp, Eutrema parvulum
ataatttgtctcttcgtggtgttgagtaggtaaaattgtgtgagctttattaatttcctcactgactctgtgaacctcagtcaccctaattcgagagctttctttgcgcagacattcactgagaaatggcggccgcgacttcatccatcgctccttccctctcatgcccatcaccttcttcttcctccaaaacccttaggtcttccaaagccagaaccttagctcttcccaatatcggtttcctctcgtctacgtccaagtctctaaggtcgctaactgccaccgtcgctggaaatggtatcggttctgccaccggatcttccctctccgcacgaatggttgcgtcttctgcggtcagaacccctgtttctctcgatttcgagacatctgtctttaaaaaggagaaagtttctcttgctggttacgatgagtacattgtgagaggaggaagagatttattcaaacatcttccagatgctttcaagggtattaagcagattggtgtgattggctgggggtctcagggacctgctcaagctcagaatataagggattcacttgtggaggcaaagtctgacattgttgttaagattgggcttagaaagggctctagctcgtttgaggaggcacgtgctgttggcttcaccgaagaaagtggtactttgggtgatatatgggaaactatctctggcagtgatcttgtgttgcttttgatctctgatgctgctcaggctgataactatgagaaaatattctctcacatgaagccaaacagcattctcggtttgtcacacgggtttctactggggcatttacagtccatgggactcgatttcccaaagaacatcagcgtggtagctgtttgtcctaagggaatgggtccatctgtgagaaggctttatgtccaaggaaaagaaatcaacggtgctggaatcaacgccagttttgcagtccaccaggatgttgacggtagagccgctgatgttgctctgggatggtcagtagcacttggttctcctttcacttttgctactactcttgagcaagagtacaagagtgacatctttggagaaagaggcattttgcttggtgctgttcatggaatcgtggagtctctcttcagaaggtacactgagaatggtatgagtgaggacttggcttacaagaacacagtagagtgcatcacaggaacaatttcgaggaccatctctacccagggaatgttggctgtctacaactccttgtctgaagaaggtaaaaaagattttgagactgcatacagtgcatccttctatccttgtatggagattctctatgaatgctacgaggatgtagcggctggaagcgaaatccgaagtgttgtcctagccggtcgtcgcttctacgataaggagggattgcctgccttcccaatgggaaagattgatcagacaagaatgtggaaggttggtgaacgtgtcaggaagtcgagaccagctggtgacttgggtccgttgtatcccttcacagctggagtttacgttgcccttatgatggctcagatcgagatcttgaggaagaagggtcactcgtactctgagatcatcaacgagagtgtgattgaatctgttgattctctgaacccgtttatgcatgctagaggagtatccttcatggtggacaactgctcgaccacagcaagattggggtcgaggaaatgggcaccgcggtttgactacaacctgacccaacaagctctggtggctgtggacaatggtgcaccaatcaacaaagacttgatcagcaacttctttgctgatccagtccatggtgctatccaggtatgtgcagagctcaggcctaccgtcgatatctctgtgcctgaagatgcagattttgttcgaccggaactgcgtcagtctaactgagtgaagggttgaaattttatctgtttcttttaatgtaatcgtgttttgaaggaagacaggattttcggaagttgtaggcgtgaatgttctgtttgaacgatttgaataatgatgtctctttgcccattaatgtgacgttctcttgcatcaataagatattctctctgctttgaacaatgatgtctcttgtgaat

SEQ ID NO: 2164 - DNA, 1924 bp, Elaeis guineensis
ttctcgtcgtcgtcctccagatccctgaggcttctcctctcccggatgcacatggatgcggccgcggcagggcggggtggcgccgccgccctcggagctcgaatggtctccgtgccatccatcagcaagcccgctccctctcttgacttcgagacctccgtctttaagaaggagaagatcaccctcgccggtcaaaatgagtatattgttagaggtgggagggatttattccatttgttgccagatgccttcaaggggatcaagcaaattggcgtgattggttggggatcccagggtcctgcccaagcacagaacttgagggattcacttgcagaggcacaatcagacattgtggtcaagattggtctgagaaaaggttctcgttcctttgaggaagcacgtgctgctgggtttactgaagaaaatggaaccttgggtgatatctgggagacaatttcaggcagtgaccttgtcttgttgctgatttcggattctgcacaggcagacaactacgagaaagtattctctcacatgaaaccaaacagcattctggggctgtctcatggttttcttcttgggcatttgcaatcccttcgccttgatttccccaaaaacatcagcgtgattgctgtatgtcctaaggggatgggtccatcagtgagaaggttgtatgttcagggaaaagagataaatggtgcaggaatcaattccagttttgctgtccatcaggatgttgatggcagggccacagatgttgctctggggtggtcagttgctctaggatctccttttacatttgccactactttagagcaggagtacaagagtgacatttttggggagcgtggtattttgcttggtgctgtgcatggaattgtggaggccttgtttagaaggtacactgagaatggaatgagtgaagaaaaggcttataaaaacacagttgagtgcatcacaggaattatgtcaaagaccatttcaacaaagggtatgctctctgtatacaactctctgactgaagaagagaaaaaggaatttaatgctgcatatagtgcatcatactatccttgcatggatatcttgtatgagtgttatgaggatgttgcctgtggcagtgaaattcgcagtgttgttttagctggacgacgcttttatgaaaaggaagggcttcctgctttcccaatgggtaaaatcgatcagacacgaatgtggaaagttggtgagcgagtccgtgcggctcgacctgagggtgacttgggccccttgcacccgtttactgctggggtttatgtggctctaatgatggctcagattgaggtcctaagaaagaagggacattcttactcagagatcattaatgagagtgtgatcgagtcagtggattccctaaatcctttcatgcatgctcgcggggtgtcattcatggtggacaactgttccacaaccgcgcgcctggggtcaagaaagtgggctccgcgttttgattatatccttactcagcaagcattagtagctgtcgacaagaacgctcctatcaatcaggacctactcagcaacttcttttccgatccagtgcatggtgctattgaagtctgtgcagagttgaggccaactgttgatatatctgtgccacctgatgcagtattttgtgcgtccagaattgcgacaaactggcaattgagaaatggcaatagaatttgatagatagcctacagccattgtgatattttgagagggtaatcttagcatgaaagctctttaaacatctaggttgtatgtgcatgcgaacattgtgcggtctctgagtgcgtagtgtctgaataaattggtgcgtggctgggcatcagttgtgtgtacgttgcacttgtttgacggtaattgagtaatccctgggagtcgtttgtagctttctgagatctttccc

SEQ ID NO: 2165 - DNA, 1935 bp, Secale cereale
cgcccgcttgcagcagagagagccgcccttcgctcccccgagaggccagacacacccacgatggcggcgcccacctcctccgcggcatccaccctcgcccccttctcccaccccaaaaccctagccgccgccgccgccgcctccgccatctcctccgtcgccttctccccggccgcatcccaccccgcatgcgccctcgcctcgtccccgtccgcccgccgccgggcggtcgccgccatggtcgcggccccggccaaggtcggcgccgccatgccctcgctcgacttcgacaccgccgtcttcaacaaggagaaggtctccctcgccggccacgaggagtacatcgtcaggggcgggcggaacctcttcccgctgctcccggaggccttcaagggcgtcaagcagatcggagtcatcggatggggctcccagggtccggcgcaggcccagaacctgagggattccttggtggaagccaagtctgacatcgtcgtcaagattggcctcaggaaaggttccaagtctttcgaggaagcacgtggtgctggattcactgaggagaacggaaccttgggagacatatgggagacggtctctggcagtgatcttgtgctgctgttgatttcagattctgcccaggcagacaactatgagaagatcttctctcacatgaaaccaaacagcattcttggtttgtctcatgggtttctccttggtcatctgcaatcacatggccttgatttccccaaaaacatcagcgtcgttgctgtatgccccaagggaatgggtccatcagttcgcagactgtatgttcagggcaaggaagtaaatggtgctggcatcaacgctagctttgctgttcaccaggatgttgatggaagggcaactgatgttgctcttggatggtcggttgcactaggatccccattcacctttgctactaccctagaacaggagtacaagagtgatatctttggggagcgaggaattttgctgggtgctgtccatggcattgtggaggctctgttcaggagatacacagagcaaggaatggacgaggagctggcatacaaaagcaccgtggagggcatcactggaatcatctcaaagaccatctcaaagaaggggatgcttgaggtatacaactccttgagcgaggaaggcaaaaaggagttcaacaaggcatacagtgcatcattttacccttgcatggacatactctatgaatgctacgaagatgttgcctctggaagtgaaatccggagtgttgtgttggctggtcggaggttctatgacaaggaaggccttcctgctttccctatgggcaaaattgaccaaactcggatgtggaaggtcggcgaaaaggtgcgctcgacccggccagatggtgaccttggcccgcttcaccccttcacggctggagtttatgtcgcacttatgatggcccagattgaggtgctgaggaagaaggggcactcctactctgagatcatcaacgagagcgtgatcgagtcggtggactcgctgaacccgttcatgcacgctcgtggggtggccttcatggttgacaactgctcgacgacggcccggctggggtcgaggaagtgggcgccccgcttcgactacatcctgacccagcaggctttcgtgacggtggacaaggatgagcccatcaaccaggacctcatcagcaacttcatgtcggaccccgtccacggtgccattgaggtctgcgccgagctgaggcccaccgtcgacatctcggtgacggctgacgcagacttcgtgcgccccgagctacggcagtctgcctagatttggggttgaagagctgttttttgctgggtggacaatttatggactgtattgtatgtgtgcgactagctgtttgaacttgtgaactgctgtcaggtagagagcccctgtaggggttgg

SEQ ID NO: 2166 - DNA, 1826 bp, Brassica napus
tcccttaggtcctccaaagccacaacctttgctttccccaacatcggttccctctcgtctacttccaagtctctgaggtccctcactgccaccgtcgctggaaatggtaccggatcttccctctccgcgcgaatggttgcgtcctctgcggttagagcccctatgtctctagatttcgagacgtctgtgttcaaaaaggagaaagtctctcttgctggtcacgaagagtacattgtgagaggaggaagggacttgttcaagcatcttcctgatgctttcaaggggattaagcagattggtgtcattggctggggttctcagggacctgctcaagctcagaatttaagggattcccttgtggaggcaaagtctgacattgttgttaagattgggcttagaaagggctctcgctcatttgaggaagcacgtgctgttggcttcaccgaagaaagcggtactctcggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagtgtggtagctgtttgccctaagggaatgggtccatctgtgagaaggctttatgtccaaggcaaagaaatcaacggtgctggaatcaacgccagttttgctgtccaccaggatgttgacggtagagccgctgatgttgctctgggatggtcagtagcacttggttctccttttacttttgcaactactcttgagcaagagtacaagagtgacatctttggtgaaagaggtattttgcttggtgctgttcacggaatcgtggagtccctgttcagaaggtacaccgaaaatggaatgagtgaagacttggcttacaagaacacagtagagtgcatcacaggaacaatctcaaggactatctctacccagggaatgttggctgtgtacaactccttgtctgaagaaggcaaaaaggacttcgagactgcatacagtgcatccttctatccttgtatggagatcctctatgaatgctacgaggatgtagcagctggcagcgagatcaggagtgttgtcttagccggtcgtcgcttttacgataaggagggcttacctgcattcccaatgggaaagattgatcagacaagaatgtggaaggtcggtgaacgcgtcaggaagtccagaccagctggtgacttgggtcccttgtatcccttcaccgctggagtttacgttgccctcatgatggctcagattgagatcttgaggaagaagggtcactcctactcagagatcatcaacgagagtgtgatcgagtctgttgattctctgaacccctttatgcacgctagaggagtgtccttcatggtggacaactgctcgaccacagcaaggttgggatcgaggaaatgggcaccaaggttcgactacaacctgacccaacaagctctggtggctgtggacaatggtgcaccaatcaacaaagacttgatcagcaacttcttcgctgatccagtccatggtgctatccaggtctgcgcagagctcaggcctaccgtggatatctcagtgcctcaagatgcagattttgttcgaccagagctgcgtcagtccaactagagtgttatcagtgtttgaaatgttatcagtctctttcctatgtaatcgtgttttgaagaaagactatggttttggaagttgtaggcgtgagtgaatgtttttgtttggactactttaataat

SEQ ID NO: 2167 - DNA, 2255 bp, Brachypodium distachyon
gctagctgcaaacgctgccaaaaaagatactgcaccagaagaaaagaaacagtttgcgtgctgcgcggcagaggggcgcgcgccacggcagctccggtgcacgtgacccggcgggagcgaatcgaatcgcagccgtccaagtcgcggcgcatcggacggcggtggtagtcgtataaatccatccaggccgccccgcgagcggaaagcccattgctaccaaccaccgccgtgaacagcagcagcacagcagagcgcagacccagcagcgacaacacaatggcggcctcaaccatctccttctcccaccccaaaaccctagccgccgccgcggctgtgcccaaaacgctgccgatccccaccgcctcctccgtcgccttccccgcctcgcacccggcatgggtcctctccgccgcccgccgacgcgcggtcgcggccatggtcgcggcaccgacgacgacggcttccgtgggcgccgccatgccctcgctcgacttcgacacctccgtgttcaacaaggagaaggtctccctcgccggccatgaggagtatatcgtgaggggtgggaggaacctctttccgctgctccacgaggccttcaagggcgtcaagcagatcggagtcatcggatggggctcccagggtccagcacaagctcagaatctgagagattccctagctgaagcaaagtctgacattgttgttaagattggtctccggaaaggttctaaatcttttgaggaagcacgtggagctggattctctgaagagaatggaaccctgggagatatatgggagacgatttcaggcagtgatcttgtgttgctgctcatatctgattctgcacaggcagacaactatgagaaaatattctctcacatgaaaccgaacagtattcttggtttatcacatggatttctccttggacatttgcaatcacatggccttgatttccccaaaaacatcagtgttgttgctgtatgtccaaagggaatgggcccatcagtccgaagactttatgttcagggcaaggaagtaaatggggctggcatcaacgctagctttgctgttcaccaggatgttgatggaagggctactgatgttgctctaggatggtcagttgcactgggatctcctttcacatttgctactactttagaacaggagtacaagagtgacatcttcggggagcgaggaattttgctgggtgctgtccatggcatcgtggaggctttgtttaggagatacactgagcaagggatggatgaggccttgacatacaaaagtactgtagagggcatcaccggaattatatcaaaaactatctcaaagaaggggatgcttgaagtgtacaactccttgagtgaggaaggcaaaaaggagttcaacaaggcgtacagtgcatcattttatccttgcatggatatactttatgaatgctatgaagatgttgcctccggaagtgaaatccggagtgttgtgttggcagggcggaggttctatgataaggaaggtcttcctgctttccctatgggaaaaattgaccaaactcgtatgtggaaggttggtgagaaggtgcgcttgacccgcccagatggtgaccttggcccacttcaccccttcacggctggagtttatgttgcactcatgatggcccagatcgaggtcctaagaaagaagggtcactcttactcagagatcattaacgagagcgtcattgagtctgtggactccctgaacccgttcatgcacgcccgtggagtggccttcatggtcgacaactgctccaccactgcacgcctgggatcaaggaagtgggcaccacgctttgactacatcctgacccagcaagccttcgtgacggtggacaaggatgccccgatcaaccaggacctcatcagcaacttcatgtcagaccctgtccatggtgccatcgaagtctgtgccgagctgaggccgaccgtcgatatctcggtgaccgccgacgctgatttcgtgcgcccggagctccggcaatcttcatagatcagtcatttgtgtcggcctgggcagatgagtgtttttgatggattgactgtgtgtgtgcacctgtttgaacttgtgagctgctgtcggatttgggttggactaccgttccagaataaagttagttcccccgggccccggtgatgctgtgtttgtgcagcatttgccggaccatgtaatgtaggtcaaactgatcatccagctcagtcataacaaaatcttgtactccctct

SEQ ID NO: 2168 - DNA, 2068 bp, Papaver somniferum
tatctctctgtgtgtatcagtttcagactcggtcatggcggcggcaacttctttctctacatctgtagcagctccatcgaaaaccctaaaaccagttcactcttcttcttctttgggttttaaattagggtttctgtcttcatcttctaaaaccctaaaacctcttcttcttcgtgtttccaacaacaatgtctcatcatccgccgttggatcggctgttgcatcgaccatgagtgtttcagctcctaccaaacctttgactactcttgattttgaaacctctgtgtttaacaaggagaaggtcactcttgctggaaatgacgagtatattgtcaaaggaggaagagatttattccatttgttgcctgaagcattcaaaggaattaagcagattggtgttatcggttggggttctcagggtcctgctcaagctcagaacttgagagactcacttgtagaagccaagtctgacattgtggtcaagattggtttgaggaagggatctgcttcttttgctgaagcacgttctgttggtttcactgaggagactggaactttgggtgatatatatgaaactgttgctgggagtgatcttgtgttgttattgatttccgatgctgcacaggcagataattacgagaagatattctcccacatgaagcctaacagcattcttggactctcccatggatttcttcttggacatttgcagtcccagggggttgatttccccaaaaatatgagtgtgattgctgtctgccccaagggaatgggtccatcagttagaagactctatgtccaaggaaaggagataaacggtgctggaattaatgctagttttgctgtccaccaggatgttgatggtagagcaacagatgttgccttaggatggtctgttgctcttggctctccttttacgtttgccactactctcgagtcagaatacaagagtgacatttttggagaaaggggtattttacttggagctgttcatggaatcgtcgaatccttgttcagaaggtacaccgaaaatggaatgcccgaagaccttgcttacaagaacactgttgagtgcatcactggaattgtttcaaggaccatatccactgagggtatgttgtctgtgtacaactctctttcagagcaaggcaaaaaggatttccatgcagcatacagtgcctcctattatccctgtatggacatcttgtatgagtgctacgaggatgtagcgagtgggaatgagatcaaaagtgttgtcttggctgggcgccgattttatgaaaaagaaggcctaccagcttttccaatgggaaagattgatcaaacaagaatgtggttggttggtgagaaagtccgagcaactcgaccagaaggtgacttgggtccactctatcctttcaccgctggagtttttgtggctttaatgatggctcagattgaggtattgagaaagaaggggcattcttactcggaaatcatcaatgaaagtgtgatcgaggcagtggattctttgaatcccttcatgcatgcacgtggagtttcattcatggttgataactgttccacaacagctcgattgggatcaaggaagtgggctccacgatttgattacattctcacccaacaggctttggtagcagtcgacaataacgcccccattaaccaggatcttattagcaacttcttgtgtgaccctgtccatggggcaatcgaagtctgtgcccaattgagaccaactgttgacatatccgtgcccgtagatgcagattttgtcagggttgagcttcgtcagtcaagcaattagacttcgaaggagttaaatcgaacatcaccaccatcctgtacatgtgttaatctgcctttcaagaaggctgggaaggcttcaatgttttagttgtctattcagagtggtgaggtataagttagtgaggtttgttgagagttgcagacgttagttccgtcttgttttccggtgaacggttctttcctttttgctagtagcatctaaataatactgcagttctatttattaatggacaactacttggtcgtaaaaaaaaaaaaaaaa

SEQ ID NO: 2169 - DNA, 2081 bp, Brassica rapa
  misc_feature (990)..(990): n is a, c, g, or t
  misc_feature (1582)..(1582): n is a, c, g, or t
atccgtggtccctttaataatcggctgctcctctcgcagacgttttgctacacttgagataacagatggcggctgctacttcatccatcgctcctcccctctcgtgcccgtctctttcttcttccctcaggtcatcgaaaggcacaagctttgctttgcccagcatcagtttcgtctcgtctacttcaaagtctctgaggtcgctcactgccaccgtccctggaaatggaaccggatcttccctctccgcgaggatggttgcgtcgtctgcggtcagagcacctgtttctctcgatttcgagacgtctgtgttcaaaaaggagaaggtctctcttgctggttacgatgagtacattgtgagaggaggaagggacttgttcaagcatcttcctgatgctttcaaaggggttaagcagattggtgtcattggctggggttctcagggacctgctcaagctcagaatctaagggattcacttgtggaggctaagtctgacattgttgttaagattgggcttagaaagggatctaaatcgtttgaggaggcacgtgcagttggcttcactgaagagagtggtactttgggtgatatatgggaaaccatctctggcagcgatcttgtcttgcttttgatctctgatgctgctcaggctgataactatgagaaaatattctcacacatgaagccaaacagcattctcggtctgtcacacgggtttctactagggcatttacagtcaatgggacttgatttcccaaagaacatcagcgtggtagctgtttgccctaagggaatgggtccatccgtgaggaggctttatgtccaaggcaaagaaatcaacggtgctggaatcaacgctagttttgcagtccaccaggatgttgacggtagagccgctgatgttgcgctgggatggtcagtagcacttggttctccttttacttttgctactactcttgagcaagagtacaagagtgacatctttgganaaagaggtattttgcttggtgcggttcacggaatcgtggagtctctctttagaaggtacaccggaaatggaatgagcgaagacttggcttacaagaacacagtagagtgcatcacaggaacaatctcaaggactatctctactcagggaatgttggctgtctacaactccttgtctgaagaaggcaaaaaggacttcgagactgcatacagtgcatccttctacccttgtatggagattctctacgaatgttacgaggatgtagcagctggcagcgagatccggagtgttgtcttagccggtcgtcgcttctatgataaggagggcttgcctgcattcccaatgggtaagattgatcagacaagaatgtggaaggtcggtgaacgtgtcaggaagtccagaccagctggtgacttgggtccgttgtatcccttcaccgctggagtttacgttgcccttatgatggctcagattgagatcttgaggaagaagggtcactcatactcggagatcatcaacgagagtgtgattgagtctgttgattctctcaatccgtttatgcacgctagaggagtgtccttcatggtggacanctgctcgaccacagcgagattgggatcgaggaaatgggcaccgagattcgactacaacctgacgcaacaagctttagtggctgtggacagtggtgcaccaatcaacaaagacttgataagcaacttctttgctgatccagtccatggtgctatcgaggtctgtgcacagctcaggcctaccgttgatatctctgtgcctgaagatgcagattttgttcgacctgagctgcgtcagtctagctgagtgaatggttgaatgattatcagtttcttttgatgtaacggtttgaaaaaaaaaagacaaatgggttttggaaggtttaggcgtgagtgtttcgttttggacggtttgaataatgatgtctctttgtctctttggacgttccattaatggaatgttctcttatgttctgtctgctttggttaaatcttcttacactccttaaaggggtttatggcggaaataaattactatattaagaggtattattctggcgac

SEQ ID NO: 2170 - DNA, 2111 bp, Hordeum vulgare
accaacctccccggccgcagcagcacagcagagggcagcccttggctccgcagagagacgcggcacccacgatggcggcgcccacctcctccaccctcgcccccttcccccaccccaaaaccctagccgccgccggaggctcctcgtccatctcatcctccgtcgccttctccccggccgcctcgcaccccgcatgcgccctcacacgccgccgggcggtcgccgccatggtcgcggccccggccaaggtcggcgccgccatgccctcgctcgacttcgacaccgccgtcttcaacaaggagaaggtctccctcgccggccacgaggagtacatcgtcaggggcgggcggaacctcttcccgctgctcccggaggccttcaagggcgtcaagcagatcggggtcatcggatggggctcacagggtccggcgcaggcccagaacctgagggattccttggtggaagccaagtctgacatcgtcgtcaagattggtctcaggaaaggttccaagtcttttgaggaagcacgtggtgctggattcactgaggaggacggaacattgggggacatatgggagacagtttcaggcagcgaccttgtgctgctgttgatctcagattctgcacaggcagacaactatgagaagatcttctctcacatgaaaccaaacagcattcttggtttatctcatgggtttctccttggtcatttgcaatcacatggccttgatttcccaaagaacatcagcgtggttgctgtatgtcccaagggaatgggcccgtcggttcggagactgtatgttcagggcaaggaagtaaacggtgctggcatcaacgctagctttgctgttcaccaggatgttgatggaagggcaactgatgttgctcttggatggtcggttgcactaggatccccgttcacctttgctactactctagaacaggagtacaagagtgatatctttggggagcgaggaattttgctgggtgctgtccatggcatcgtggaggctctgtttaggagatacacagagcaaggaatggatgaggagtcggcatacaaaagcactgttgagggcatcactggaatcatctcaaagaccatctcaaagaaggggatgcttgaggtatacaactccttgagcgcggaaggcaaaaaggagttcaacaaggcatacagtgcatcattttacccttgcatggacatcctctacgaatgctatgaagatgttgcctctggaagtgaaatccggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccactccaccccttcacggctggagtttacgttgcacttatgatggcccagatcgaggtgctgaggaagaagggtcactcctactctgagatcatcaacgagagcgtgatcgagtcagtggactcgctgaacccgttcatgcacgcgcgtggggtggccttcatggtggacaactgctcgacgacggcccggctggggtcgaggaagtgggcgccccgcttcgactacatcctgacccagcaggcgtttgtgacggtggacaaggatgcgcccatcaaccaggacctcatcagcaacttcatgtcggaccccgtccacggcgccatcgaggtctgcgccgagctgaggcccaccgtcgacatctcggtgacggccgatgctgacttcgtgcgtccggagctccggcagtctgcctagattcgggtctgaagagttgttttttgatgggtggacaattcatggactgtaatgtatgcgtgcgactagctgtttgaacctgtgagctgctgtgtcaggtagagagagccccctgttggggttggatcgagtgagtcgtctccgtttcttctcgaataataaaagttagttcgtccggttagatgttgttggttgttttgtttgtgtagcttttgccgcatctctctcgaaattctggtagagcttgccggcagtggcagtaacagcagggacatgggctgttatgaccaagagggtcttcctctc

SEQ ID NO: 2171 - DNA, 2067 bp, Eschscholzia californica
tggaactctgtgtgtttctcacagcaagcagctcagtttcactaatggcggcggctacttctttctcagcatccttgtcttctcctcctacttgttcatctaaaacccttaaacctgttcatacatctctaggtttcaatctagggtttctctcttcatcttctaaaaccctaaaacctcttcttgctcgtgtctctaccaataacgacaatgtctccgttagtggatcgtctcttgcatctcgaatgatggtctcagttcctgctattaaacccttgactacccttgattttgaaacctctgtgtttaagaaggagaaggtcacacttgcaggaaatgacgagtatattgttaaaggaggaagggatttattccatttgttacctgaagcattcaaggggattaagcagatcggagttattggttggggttctcagggacctgcccaagctcagaacctgagggattcacttgtagaggctaagtctgacattgttgtcaagattgggttgaggaagggctctcgttcttttgccgaggcacgtgctgctggatttaccgaggagaatggaactttgggtgaaatttatgaaactgttgcaggaagtgatcttgtattgctattgatttctgatgcagcacaggctgataattacgagaaaatattctcccacatgaagcctaacagcgtacttggtctttcccatggattccttcttggacatttgcagtctatggcgactgatttccccaaaaacatcagtgtaattgctgtctgcccaaagggaatgggtccatctgttaggagactttatgttcaaggcaaagagattaatggtgctggaattaatgctagttttgctgttcaccaggatgttgatggtagagcaacagaggtggccctagggtggtcagttgctcttggttctccttttacattcgcgacaaccctagagcaggaatacaagagtgacatttttggggagcgaggcattttgcttggagctgtacatggaattgtggagtccttgtttagaaggtacactgagaatgggatggctgaagaccttgcttacaagaacactgttgagtccatcactggaatcatctcaaggaccatctcgactgagggcatgttagccgtatacaactccttgtcagagcagggcaagaaggatttccagactgcatacagtgcctcatactacccttgcatggagatcctctacgagtgctacgaggatgttgccagtggcaatgagatccgaagtgttgttttggccgggcgccgattctacgagaaagaaggccttccagcttttccaatgggtaacatcgaccagacaagaatgtggaaagttggtgaaagagttcgatcaacaagaccagaaggtgatttgggtccactataccctttcactgctggggttttcgttgctttgatgatggctcagattgaggtcttgaggaggaagggacactcttactcagagatcattaacgaaagtgtgattgaatctgtcgattctttgaaccccttcatgcatgcacgtggagtctccttcatggttgacaactgctccacaacagcacgattgggatcaaggaagtgggctccaagattcgattacattctcactcaacaagctttggtggcagtcgacaacaacactcccatcaaccaagacctcattagcaacttcctgtccgaccccatccacggagcaattgaagtctgtgcccagcttagaccaactgttgacatctccgtaccagcaaatgcagacttcgtaaggcccgagcttcgtcaatctagcaattaaaactttgaagaggtcagttatgtgcatatccgattagctaccaggatgtgtcttgactagtactcgaagctttagcaaactgaggtaatttttaacaatttgatggataaatatgaggtatgtaagttctatcgtgtttgtggcttgagaggtgcaaactatgagcacttagtttttcctcgaagattagtttcttttcttgcttgtatctgaactcgttactatggtactgctatctattacg

SEQ ID NO: 2172 - DNA, 2074 bp, Allium cepa
tagagccagcttctcgtctctccactcccagtcttgcaaaaatggcggctgcaatcaacacccattcctcttcttcaatcatctctctttccactaacagaagtctagctaagccactatctacctacaacttagctttcagttgcgtacccagaaccctagcccgacatatccgatccaatggaggaagatcttctgttggtgcctgcatggttcaatcggcaccgttagttggccagtatcctgaacttgatttcgataccagcgtttttaagaaagagaagatcactctttctggccatgacgagtatatcgtaagaggaggaagagatttgtttcatttgttgccggatgccttcaaagggataaaacaaattggagttataggttggggctctcagggtccagcccaagcacaaaatctcagagactcacttgtcgaggccaggtcagacatcgtagtcaagattggattgaggaagggttcacgctcatttgaagaagcacgtgctgtcggttttactgaagaaagtggaacattgggtgaaatatgggaaactgtctccaccagtgatcttgtattgttattaatctcagatgctgcacaggcagataactatgaaaaagtgttttcacacatgaaaccaaatagtattctaggcctctcgcatggttttcttctagggcacttgcagtctcttggtcttgattttccgaagaacatcagtgttgttgctgtttgccctaagggtatgggcccatcagtaaggaggctctatgttcaaggcaaggaagtcaatggtgctgggatcaatgctagctttgctgttcatcaggatgttgatggccgagctacagatgttgctctaggatggtctgttgctttaggatcgccattcacttttgctaccacgttagaacaagaatacaaaagtgacatctttggcgagcgaggtattttgcttggtgctgttcatggtatcgtggaatccttgttcagacgatatacagagaatggaatgagtgaagagctagcctacaagaacactgtggagtgcatcactggtacaatgtcaaagaccatttctactaagggcatgctttctgtctacaattcattgtctgaggaggggaagaaagagttcaatgctgcatacagttcttcatactatccttgcatggatatattatatgaatgttacgaggatgtcgctagtggaagcgagattagaagtgttgtcttggccggtagaagattccaagaaaaggaggggcttccagcttttccaatgggtaaaattgatcagacaagaatgtggaaagttggtgaaaaagttcgtgctgtgaggcctaagggtgatttgggaccgctgcatcccttcacggctggcgtatttgtagctttaatgatggctcagattgaagttctgcgaaagaagggtcattcatactcagagatcataaatgaaagcgtgatagaagcagtcgactccttgaatccattcatgcatgcgcgtggcgtctcgttcatggtcgacaactgctccaccaccgctaggttaggatccagaaagtgggctcctcgatttgattacatactcatgcagcaagcctatgttgctgtcgataatgcttctcctgttaaccaggatcttataagcagcttcctgtctgaccccgtacatggtgcgatagaggtctgcgcccggctgaggccttctgttgatatttctgtgccggtcgatgctgatttcgtgcgccctgagcttcgtcaagctttgaattgatgtttctgttgtatttgttatatagttaataatgactttatgtccgagttagagtattatgaagtgtatttgtagtactgttggttttgttgaacgaccgtatgaaatggtttgttgcttgatgatactgatgcaaaaggacgtatgcatcctgtggcttatgcattcgaactctttgtttggttcagctcttttgaatgacatgcaatgacagctattctgttttaggtgttgtgagtgattgtacactaaattgcgcgcttagttcaaattaatgattaatactt

SEQ ID NO: 2173 - DNA, 2002 bp, Secale cereale
agcagagagagccgcccttcgctcccccgagaggccagagacacccacgatggcggcgcccacctcctccgcggcatccaccctcgcccccttctcccaccccaaaaccctagccgccgccgccggctccgccatctcctcctcctccgtcgccttctccccggccgcatcccaccccgcatgcgccctcgcccgccgccgcgcggtcgccgccatggtcgcggccccggccaaggtcggcgccgccatgccctcgctcgacttcgacaccgccgtcttcaacaaggagaaggtctccctcgccggccacgaggagtacatcgtcaggggcgggcggaacctcttcccgctgctcccggaggccttcaagggcgtcaagcagatcggagtcatcggatggggctcccagggtccggcgcaggcccagaacctgagggattccttggtggaagccaagtctgacatcgtcgtcaagattggcctcaggaaaggttccaagtcttttgaggaagcacgtggtgctggattcactgaggagaacggaaccttgggagacatatgggagacggtctctggcagtgatcttgtgctgctgttgatttcagattctgcccaggcagacaactatgagaagatcttctctcacatgaaaccaaacagcattcttggcttatctcatgggtttctccttggtcatctgcaatcacatggccttgatttccccaaaaacatcagcgtcgttgctgtatgccccaagggaatgggtccatcagttcgcagactgtatgttcagggcaaggaagtaaatggtgctggcatcaacgctagctttgctgttcaccaggatgttgatggtagggcaactgatgttgctcttggatggtcggttgcactaggatccccattcacctttgctactaccttagaacaggagtacaagagtgatatctttggggagcgaggaattttgctgggtgctgtccatggcatcgtggaggctctgttcaggagatacacagagcaaggaatggacgaggagctggcatacaaaagcactgtggagggcatcactggaatcatctcaaagaccatctcaaagaaggggatgcttgaggtatacaactccttgagcgaggaaggcaaaaaggagttcaacaaggcatacagtgcatcattttacccttgcatggacatactctatgaatgctacgaagatgttgcctctggaagtgaaatccggagtgttgtgttggctggtcggaggttctatgacaaggaaggccttcctgctttccctatgggcaaaatcgaccaaactcgcatgtggaaggtcggcgaaaaggtgcgctcgacccggccagatggtgaccttggcccactccaccccttcacggctggagtttatgttgcacttatgatggcccagattgaggtgctgaggaagaaggggcactcctactctgagatcatcaacgagagcgtgatcgagtcggtggactcgctgaacccgttcatgcacgcgcgcggggtggccttcatggtggacaactgctcgacgacggcccggctggggtcgaggaagtgggcgccgcgcttcgactacatcctgacccagcaggcgtttgtgacggtggacaaggatgagcccatcaaccaggacctcatcagcaacttcatgtcggaccccgtccacggcgccattgaggtctgcgccgaactgaggcccaccgttgacatctcggtgacggctgacgccgacttcgtgcgcccagagctccggcaatctgcctagatttggggttgaagagctgttttttgctgggtggacaatttatggactgtattgtatgtgtgcgactagctgtttgaacttgtgaactgctgtcaggtagagagagcgccccctgttggggttggaccgagtgagtcgtcttcgttttccagaataataaaagttggttcgtaaacggttaaaaaaaaaaaaaaaaaaaaaaaaaaaaaa

SEQ ID NO: 2174 - DNA, 1936 bp, Saccharum officinarum
cgcttcactagccctttgctcctctgaaatggcggcggccacctcctccaccacctacctcgccatcgcccgcaaaaccctaaaccccgccccctccgtcggcacggccgccgcctccgtctccttccccgccacgcagcccccatgcctcctcgccgcctccgcggaccgccgcggccccgtggctgcgaaggtctcgtcgccgtcggtcatcggcaccgccatgccgtctctcgacttcgagacctccgtcttcaagaaggaggaggtgtccctggccggccatgaggagtatattgtgaggggtgggaggaatctgttcccgctgctgccagaggccttcaagggaatcaaacagatcggtgtaatcggctggggctcgcagggtcctgcgcaagctcagaacttgagagactcacttgttgaggcaaaggcagatgttgttgttaagattggtctccggaaaggttctaaatcttttgatgaagcccgagcagcgggattcaccgaagagagtgggacactgggtgatatatgggagactgtatcaagcagtgatcttgttttgctgctgatatctgattctgctcaggctgataactacgagaaaattttctcacacatgaaaccaaacagtattcttggtttgtcacatggatttctccttggacatttgcaatctctgggtcttgatttccctaaaaacatcagcgtgattgctgtatgccccaagggaatgggcccatcagttagaagactttatgttcagggcaaagagattaatggtgctggtatcaatgctagctttgctgttcaccaggatgttgatggaagggcaacagatgtagctctagggtggtcagtagctctaggttctcctttcacatttgctactactctagagcaggagtaccggagcgacatttttggcgagcgaggtattttgcttggtgctgtccatggcatggtggaggctcttttcaggagatacacagaacaaggaatggatgaggactcagcatataagaatactgtagagagcatcactggaattatatcgaaaactatttcaaagaaggggatgcttgaagtgtataactccttgaccgaagaaggaaagaagcagtttattgaggcctatagcgcagcatattacccatgcatggacatattgtatgagtgctatgaagacgtttcttctggaagtgagattagaagtgtggtgttggctgggaggagattttatgagaaggaagggcttcctgctttccctatgggaaacattgatcaaacacgtatgtggaaggtgggtgaaagggtccgttcaaccaggccacaaggtgatcttggtccattgcatcccttcactgctggagtgtacgttgcactaatgatggctcagattgaggtccttagaaagaagggccactcttactcagagatcattaatgagagcctgatcgagtctgtggactcgttgaacccttttatgcatgctcgtggtgtggccttcatggttgataactgctccacaactgctcgcttgggatctaggaagtgggcaccacgcttcgattacatcttgacccaacaagcgtttgtgactgttgacaagaaagcaccaatcaaccaagacctcatcagcaacttcatgtctgaccctgttcacggtgccattgaggtctgtgctcagctgaggcccactgttgacatctcagtgactgctgatgcagatttcgtgcgtccagagcttcgacagtcttcataagcttgtatggatccgcagtgtgtgctgcaatggttagtttgtaagaactaatatgtgtgggcttttgaactcttagattgcctgtattgctcctgtttgatgaccagaaaagtaaactcttggggtgtagtactgtcgtgatttgcaagaataaagaataaatggttg

SEQ ID NO: 2175 - DNA, 1846 bp, Flaveria ramosissima
cttgttactccaccggtgttactcatggcggccgccgcacctaccttctcctccgccgcacctaccacccactctccaccgtcgtcgtcttcaccgactctcaaaacggcttctcaaaccctaggtttcgccacaacgtttctatcatccaaaacctcattcaaatcgcttcaaactcgcttgttatcttccaatcgtggctccggctccgctctcggagctcgtatggttgcagcgccggtgatcagcaagtcgccggtgtctctcgatttcgatacgtcggtttttagaaaggagaaagtcaacctcgctggtcacgaagagttcattgtgagggaggtagagatttgtttcatttgttgcctgatgcatttaaagggattaagcagattggcgtgatcggctggggctctcagggtcctgcacaggcgcagaatttgagggattcacttgcagaagcaaagtctgatattgtagtgaagattggcttaaggaagggttcaagttcgtttgctgaggcgcgtgctgctggtttcagtgaagaaaatgggactcttggagatatttatgagactatttctggtagtgatttggtcctgctcttgatatctgattcagctcaggctgataattatgagaaaatcttctcccacatgaaaccaaacagcatccttggactttctcatggtttccttcttggtcatttacaatcaatcggtcttgatttccccaaaaatgttagtgtggttgctgtgtgtcccaaaggaatgggccatcagttagaaggctatatgttcaaggaaaagagatcaatggagccgggattaatgcaagttttgctgtccatcaggatgtcgatggcagagccactgatgttgcacttggatggtcagttgctcttggttcaccttttacatttgctactaccctagaacaggagtataaaagtgatatattcggagaaagaggtattttacttggtgctgtgcacggtattgtcgagtcattatttagaaggtacacagagcaaggtatgactgaagatttggcttacaagaacactgtagaatgcataaccggagtaatttcaaagaccatatcgaccaagggtatgaaagctgtctatgagtcactctcagaagaaggcaagaaagatttcttgattgcatacagtgcttcttattatccctgcatggaaatcttgtacgagtgttatgaggatgtggctagtggcagtgagatcaggagcgttgttttggctggccgccgcttttatgaaaaagagggtctaccagccttcccaatgggcaaaattgatcaaacccgcatgtggaaagttggcgaacgagttcgtgctacacgacccgtcggcgatttaggcccgctgtatcctttcacagcaggtgtctacgtggcgctaatgatggcccagattgaggtactgaggaagaaagggcactcttattctgaaatcatcaacgaaagtctaatcgaatctgtggattcattgaaccctttcatgcatgctcgaggcgtttcgttcatggtggacaactgttccaccactgcacggttagggtcaaggaaatgggctccacggttcgactacaatctgacccaacaggccctggtagcagtagacaatggcaccccagtgaaccaggaccttgttaaagccttctttgaagatccggttcatgaagcggtcaaagtgtgcgcagagttgagacccacggtcgacatctcggtgcctgcagatgctgattttgtgagacctgagctgcgtcagtctagcaactagaaagggatggtttaagttatttacattttacacatgcaatggcag

SEQ ID NO: 2176 - DNA, 2078 bp, Elaeis guineensis
gggttgggattctcgtcgtcgtcctccagatccctgaggcttctcctctcccggatgcacatggatgcggccgcggcagggcggggtggcgccgccgccctcggagctcgaatggtctccgtgccatccatcagcaagcccgctccctctcttgacttcgagacctccgtctttaagaaggagaagatcaccctcgctggtcaaaatgagtatattgttagaggtgggagggatttattccatttgttgccagatgccttcaaggggatcaagcaaattggcgtgattggttggggatcccagggtcctgcccaagcacagaacttgagggattcacttgcagaggcacaatcagacattgtggtcaagattggtctgagaaaaggttctcgttcctttgaggaagcacgtgctgctgggtttactgaagaaaatggaaccttgggtgatatctgggagacaatttcaggcagtgaccttgtcttgttgctgatttcggattctgcacaggcagacaactacgagaaagtattctctcacatgaaaccaaacagcattctggggctgtctcatggttttcttcttgggcatttgcaatcccttggccttgatttccccaaaaacatcagcgtgattgctgtatgtcctaaggggatgggtccatcagtgagaaggttgtatgttcagggaaaagagataaatggtgcaggaatcaattccagttttgctgtccatcaggatgttgatggcagggccacagatgttgctctggggtggtcagttgctctaggatctccttttacatttgccactactttagagcaggagtacaagagtgacatttttggggagcgtggtattttgcttggtgctgtgcatggaattgtggaggccttgtttagaaggtacactgagaatggaatgagtgaagaaatggcttataaaaacacagttgagtgcatcacaggaattatgtcaaagaccatttcaacaaagggtatgctctctgtatacaactctctgactgaagaagagaaaaaggaatttaatgctgcatatagtgcatcatactatccttgcatggatatcttgtatgagtgttatgaggatgttgcctgtggcagtgaaatttgcagtgttgttttagctggacgacgcttttatgaaaaggaagggcttcctgctttcccaatgggtaaaatcgatcagacacgaatgtggaaagttggtgagcgagtccgtgcggctcgacctgagggtgacttgggccccttgcacccgtttactgctggggtttatgtggctctaatgatggctcagattgaggtcctaagaaagaagggacattcttactcagagatcattaatgagagtgtgatcgagtcagtggattccctaaatcctttcatgcatgctcgcggggtgtcattcatggtggacaactgttccacaaccgcgcgcctggggtcaagaaagtgggctccgcgttttgattatatccttactcagcaagcattagtagctgtcgacaagaacgctcctatcaatcaggacctactcagcaacttcttttccgatccagtgcatggtgctattgaagtctgtgcagagttgaggccaactgttgatatatctgtgccacctgatgcagattttgtgcgtccagaattgcgacaaactggcaattgagaaatggcaatagattttgatagatagcctacagccattgtgatattttgagagggtaatcttagcatcaaagctctataaacatctaggttgtatgtgcatgcgaacattgtgcggtctctgagtgcgtagtgtctgaataaattggtgcgtggctgggcatcagttgtgtgtacgttgcacttgtttgacagtaattgagtaatccctgggagtcgtttgtagctttctgagatctttcccattttttttttttcttggtgtgtgtgtgttttttgccttgatgataactctcagttttagatgcaaatcacgcttgctgtattggtgcatagctgggcatccagctatggaatattgaaccaatccatgttctcaaagaaactgtt

SEQ ID NO: 2177 - DNA, 2120 bp, Eutrema halophilum
atatatgactcttcgtggtgttgaataggttaaacgcgtgctttattaatttctccttaccaactctctgtgagccaacactccttaagtctcagtgaccctaatttgcgcacacgttacattgagaaatggcggctgcaacttcatccatagctccttctctctcatgcccatctccttcttcttcctccaaaacccttaggtcttcgaaagccagagccttggctcttcccaatatcggtttcctctcgtctgcatccaagtctctgcggtcgctaactgcaaccttcgctggaaatggtatcggttccgccactggatcttccctctccgctcggatggttgcgtcgtctgcggtcagaacccctgtttctctcgatttcgagacatctgtcttccaaaaggagaaagtctctcttgctggttacgaagagtacattgtgagaggaggaagggatttgttcaagcatcttccagatgctttcaaggggattaagcagattggtgtgattggctggggatctcagggacctgctcaagctcagaatttaagggattcgcttgtggaggcgaagtctgacattgttgttaagattgggcttagaaagggctctcgctcatttgaggaggcacgtgctgttggcttcaccgaagaaagtggtactttgggtgatatatgggaaactatttctggcagcgatcttgtattgcttttgatctctgatgctgctcaggctgataactatgagaaaatattctctcacatgaagccaaacagcatcctcggtttgtcacacgggtttctgttagggcatttacagtccatgggactcgatttcccaaaaaacatcagtgtggtcgctgtttgtcctaagggaatgggtccctctgtgaggaggctttacgtccaaggaaaagaaatcaacggtgctggaatcaatgccagttttgcagtccaccaggatgttgacggtagagcagccgatgttgctttgggatggtcagtagcacttggttctccttttacttttgctactactcttgagcaagagtacaggagtgacatctttggagaaagaggcattttgcttggtgctgttcacggaatcgtggagtctctgtttagaaggtacaccgaaaatgggatgagtgaagagttggcttacaagaacacagtagagtgcatcacgggaacaatttcgagaactatctctacccagggaatgttggctgtgtacaactccttgtctgaagaaggtaaaaaggatttcgagactgcatacagtgcatcgttctatccttgtatggagattctctatgaatgttacgaggatgtagctgcgggtagcgaaatccgaagtgttgtcttagctggtcgtcgcttctatgataaggagggattgcctgcattcccaatgggaaagattgatcaaacaagaatgtggaaggtcggtgaacgtgtcaggaagtccagaccagctggtgacttgggtccgttgtatcccttcaccgctggagtttacgttgcgcttatgatggctcagatcgagatcttgagaaagaaaggtcactcttactcagagattatcaacgagagcgtgatagaatctgtggactctctaaacccatttatgcatgctagaggagtttccttcatggtggacaactgctcaaccacagcaagattgggatcgaggaaatgggccccgcggttcgactacaacttgacccaacaagctctggtggctgtggacaacggtgcagcgatcaacagagacttgatcagcaatttcttctctgatccagtccatggtgctatcgaggtctgtgcacagctcaggcctacggtcgatatctctgtgcctgaggacgcagactttgttcgacctgagctgcgccagtctagcaactgagtgaagtattgaaaagtttacgagtcttctcttattgtaatcggatttttcgtaaaagccagagtttggtatgttttttcttaggcgtgagtgaggatttgaataattatgtctctttgtctctttggaaatccaataatgggatgctctctgcttttggtcttaaaatcttgttaaagagtttctcgcgagactaattactgatat

SEQ ID NO: 2178 - DNA, 2238 bp, Solanum lycopersicum
agacgtttatgagtttatgtaatgagtcgattttgttagagaacacggattcgtaaagtaacaaacctttaccctagcaaagtacaccactaccacactgcaaatctgcaacatctataaaaaggaactctccatatcacattttctccctcttatccatctctctctgtaacactttaatttgtctgctttccacttcacaatcatggcggcggcggcggcaacttccttctccatcaccaactctactcatccgtcctcctccgcatcatcaaccaaatccctaaaaccttcgcttgttggtaacttagggtttctatcctcgtcaactccatcgcttaagcctctcagagctcaagccgccgtttcatctggcagctcaaaatccggcggaggcgcgcttgcggctcgcatggtcgctgcacctgctaccgtcaaagctcctgcttcgtttgattttgaaacatccgtttttaagaaggagaaagtaaccctagctggaaatgatgagtacattgtgaggggaggtagagatttgtttaagtatttgccggatgctttcaaaggaatcaagcagatcggagttatcggctggggttctcagggacctgctcaagcccagaacttgagggattctcttgcagaaataaaatctgacatagttgttaagattggtttaagaaagggttcaagttcatttgcggaggcccgcacagctgggtttactgaagagaacggtacccttggtgacatatatgagactatctctggcagtgatctagtgctgctattgatttctgatgctgctcaggctgataattatgagaaagtgttctctcacatgaagccaaacagcatacttgggctttcacatggattcctccttggccatttgcagtcaatgggccttgacttcccaaagaacattagtgtgattgctgtatgtcccaagggaatggggccttcagtcaggagattatatgttcaaggaaaagaagtcaatggtgctggaattaattcaagttttgcagttcaccaggatattgatggaagagccacagatgttgctcttgggtggtctgttgcccttggttctccctttacttttgctactactctagagcaggaatataaaagtgacatttttggagaacgaggcattttacttggtgctgtccatggagttgtggagtcgcttttcagaaggtacactgagaacggaatgaatgaggagcttgcatacaagaacactgtagaatgcataacaggagtcatttcaaaaaccatatcaacaaagggcatgttggctgtgtacgactcattgactgaggagggcaagaaggagtttgaagctgcatacagtgcttcattctacccctgcatggagattttgtatgagtgctatgaagatgtagctacaggtagcgagatcaggagcgttgtcttggctggccgccgcttttatgaaaaggagggcttacctgccttcccaatggggaaaattgatcaaacaaggatgtggaaggttggtgagcgcgtccgagcaacccgaccagctggtgatcttggtcctctgtatccattcactgctggtgtctttgtggcattgatgatggcccagattgaggttctgaggaagaaaggacattcttactccgagattatcaatgaaagtgtcatcgagtctgtagattctttgaatccgtttatgcacgctcgtggagtatcattcatggttgacaattgctcaacaacagcacgtctaggttccaggaagtgggcccctcgatttgattacaatctcacccaacaagcacttgtagccgtggataacaacacccctatcaaccgtgatctcatcagcaacttccttgcagatcccgtgcatggagctattaaagtgtgtgctgaactaagacccacagttgatatttctgtaacagcagatgctgattttgtccgccctgagctcaggcaatctgtcaattaagggctttacgggtcactttgtgagcgagcaagtgagaattgattgtgatgttgagatttcatattgttgatgtgtgttggtgaaggcaagaatacttaaatctgttagcttataagaatcttagcctcttttcgttgcttagttacgttggtactagcacttttttatgtaacgaataacagattcaaaatttgggaacccttatagcaactataaaatgtgggttatggcagtagcatgtttcagtc

SEQ ID NO: 2179 - DNA, 1967 bp, Triticum aestivum
gcccttcgctccccccagaggccagagacggacacgatggcggcgcccacctcctccgcggcatccaccctcgcccccttctcccaccccaaaaccctagccgccgccgccgccgccgcatcctcctccgtcgccttctccccggccgcatcccaccccgcatgcgccctaacccgccgccgcgcggtcgccgccatggtcgcggccccggccaaggtcggcgccgccatgccgtcgctcgacttcgacaccgccgtcttcaacaaggagaaggtctccctcgccggccacgaggagtacatcgtgaggggcgggcggaacctcttcccgctgctcccggaggcgttcaagggcgtcaagcagatcggcgtcatcggatggggctcccagggtccggcgcaggcccagaacctgagggattccctggtggaagccaagtctgacatcgtcgtcaagattggcctcaggaaaggttccaagtcttttgaggaagcacgtggtgctggattcaccgaggagaacggaaccttgggagacatatgggagacggtctctggcagtgatcttgtgctgctgttgatttcagattctgcccaggcagacaactatgagaagatcttctctcacatgaaaccaaacagcattcttggtttatctcatgggtttctccttggtcatctgcaatcacatggccttgatttccccaaaaacatcagcgtcgttgctgtgtgtcccaaggggatgggcccgtcggttcggagactgtatgttcagggcaaggaagtaaatggtgctggcatcaacgctagctttgctgtccaccaggatgttgatggaagggccactgatgttgctcttggatggtcggttgcactaggatccccattcacctttgctactactctagaacaggagtacaagagtgatatctttggggagcgaggaattttgctgggcgctgtccatggcattgtggaggctctctttaggagatacacagagcaaggaatggacgaggagctggcatacaaaagcaccgtggagggcatcactggaattatctctaagaccatctcaaagaaggggatgcttgaggtgtacaactctttgagtgaggaaggcaaaaaggagttcaacaaggcatacagtgcatcattctacccttgcatagacatactctacgaatgctacgaagatgttgcctctggaagtgaaatccggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccgctccaccccttcacggctggagtttatgttgcacttatgatggcccagatcgaggtgctgaggaagaaggggcactcctactctgagatcatcaacgagagcgtgatcgagtcggtggactcgttgaaccccttcatgcacgcgcgcggggtggccttcatggtggacaactgctcgacgacggcgcgtctggggtcgaggaagtgggcgccccgtttcgactacatcctgacccagcaggcgttcgtgacggtggacaaggacgagcccatcaaccaggacctcatcagcaacttcatgtcggaccccgtccacggcgccatcgaggtctgcgccgagctgaggcccaccgtcgacatctcggtgacggccgacgccgacttcgtgcgccctgagctccggcagtcctcctaggctcgccccttgcacctaagttaactaagctgcgccgggccggtcggggcccggcaggagagttggtttttgatggatggacattcatggactgtaatgtatgtgtgcgactagctggtttgaactcgtgagctgctgctgggtagagtgagtcgtcttcgtttccagaataataaagttggttcgtccggtta

SEQ ID NO: 2180 - DNA, 1995 bp, Triticum aestivum
ccacccccggccgcagcagcagcagagagccagccgcccttcgctccccccagaggccagagacggacacgatggcggcgcccacctcctccgcggcatccaccctcgcccccttctcccaccccaaaaccctagccgccgccgccgccgccgcatcctcctccgtcgccttctccccggccgcatcccaccccgcatgcgccctaacccgccgccgcgcggtcgccgccatggtcgcggccccggccaaggtcggcgccgccatgccgtcgctcgacttcgacaccgccgtcttcaacaaggagaaggtctccctcgccggccacgaggagtacatcgtgaggggcgggcggaacctcttcccgctgctcccggaggcgttcaagggcgtcaagcagatcggcgtcatcggatggggctcccagggtccggcgcaggcccagaacctgagggattccctggtggaagccaagtctgacatcgtcgtcaagattggcctcaggaaaggttccaagtcttttgaggaagcacgtggtgctggattcaccgaggagaacggaaccttgggagacatatgggagacggtctctggcagtgatcttgtgctgctgttgatttcagattctgcccaggcagacaactatgagaagatcttctctcacatgaaaccaaacagcattcttggtttatctcatgggtttctccttggtcatctgcaatcacatggccttgatttccccaaaaacatcagcgtcgttgctgtgtgtcccaaggggatgggcccgtcggttcggagactgtatgttcagggcaaggaagtaaatggtgctggcatcaacgctagctttgctgtccaccaggatgttgatggaagggccactgatgttgctcttggatggtcggttgcactaggatccccattcacctttgctactactctagaacaggagtacaagagtgatatctttggggagcgaggaattttgctgggcgctgtccatggcattgtggaggctctctttaggagatacacagagcaaggaatggacgaggagctggcatacaaaagcaccgtggagggcatcactggaattatctctaagaccatctcaaagaaggggatgcttgaggtgtacaactctttgagtgaggaaggcaaaaaggagttcaacaaggcatacagtgcatcattctacccttgcatagacatactctacgaatgctacgaagatgttgcctctggaagtgaaatccggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccgctccaccccttcacggctggagtttatgttgcacttatgatggcccagatcgaggtgctgaggaagaaggggcactcctactctgagatcatcaacgagagcgtgatcgagtcggtggactcgttgaaccccttcatgcacgcgcgcggggtggccttcatggtggacaactgctcgacgacggcgcgtctggggtcgaggaagtgggcgccccgtttcgactacatcctgacccagcaggcgttcgtgacggtggacaaggacgagcccatcaaccaggacctcatcagcaacttcatgtcggaccccgtccacggcgccatcgaggtctgcgccgagctgaggcccaccgtcgacatctcggtgacggccgacgccgacttcgtgcgccctgagctccggcagtcctcctaggctcgccccttgcacctaagttaactaagctgcgccgggccggtcggggcccggcaggagagttggtttttgatggatggacattcatggactgtaatgtatgtgtgcgactagctggtttgaactcgtgagctgctgctgggtagagtgagtcgtcttcgtttccagaataataaagttggttcgt

SEQ ID NO: 2181 - DNA, 2244 bp, Setaria italica
ccacacataaaaagcccacagacgcatctccaagaatcccctctttccagccaccctcacgcagtcacgcttcaccctagtccctccctcccaagtcccaaaatggcggcggccacctcctccaccacctacctcgccatcacccgcaaaaccctaaaccccgccgcctccggagccccaggcgccgccgctgcctccgtctccttccccaccgcgcaggccccatgccccctcgccgcctccgcgggccgccgccgcgccatgaccgcgaaggtttcgtcgccgtcggtcgtcggcaccgccatgccctcgctcgacttcgagacctccgtcttcaagaaggagaaggtgtcccttgcgggccatgaggagtatattgtgagaggtgggagggatctgttcccgctgctgccaacggcgttcaaggggatcaaacagatcggtgtgatcggctggggctcgcagggtccagcacaagctcagaacttgagagactcacttgttgaggcaaagtcagacattgttgttaagattggtctccggaaaggttccaaatctttcgaagaagcccgtgcagctggattcactgaagagagtgggacactgggtgatatatgggagactgtatcaggcagtgatcttgtgctgcttctgatatcagattctgctcaggctgataactatgggaaaattttctcacacatgaaacccaacagtattcttggtttgtctcacggatttctccttggacatttgcaatccctgggccttgatttccctaaaaacatcagtgtgattgctgtctgccccaagggaatgggcccatcagttagaaggctttatgttcagggcaaagagataaatggtgctggtatcaatgctagctttgctgttcaccaggatgttgatggaagggctacggatgtagctttggggtggtcagttgctctaggttctcctttcacatttgctactactctagagcaggagtaccggagcgatatttttggagagcgaggtattttgctcggtgctgttcatggcatggtggaggctcttttcaggcgatacacagaacaaggaatggatgaggattcagcatataagaacactgtggagagtatcactggaatcatctctaaaactatttcgaagaaggggatgcttgaagtgtacaactctttgaccgaagagggaaagaagcagttccttgaggcgtatagtgcggcatattacccatgcatggacattttgtacgagtgctatgaagatgtttcttctggaagtgagattagaagcgtagtgttggctgggaggagattttatgaaaaggaagggcttcctgctttccccatgggcaaaattgatcaaacacgtatgtggaaggtgggtgaaagggtgcgttcaaccaggccacaaggtgatcttggaccgttgcatcccttcactgctggagtgtatgttgcattaatgatggctcagattgaggtgcttagaaagaaaggccacagttactctgagatcatcaatgagagcctgattgagtctgtagactcattgaacccattcatgcatgctcgcggggtggccttcatggttgataactgctccactactgctcgcctgggatcaaggaagtgggcgccccgttttgactacatcctgactcaacaagcttttgttactattgataagaaggcaccaatcaaccaagacctcattagcaacttcatgtctgatcccgtccatggtgccattgaagtatgtgctcagctgaggcccaccgttgacatctcagtcactgctgatgcagactttgtgcgcccagagctgcgacagtcttcctaaagctcatatcgatctgcagtgcattaacagcggttaggttttaagaagtactaagtgtgggcgtttgaactcttaggccatgtatcgctgctgtttgagaagaacagtgaactcttgagtgtaggactggtgtgtgatggcactgaacttatatttggcaagaataaaaataagtggtttgatctaaatgtgtgttttgctatgcccgtttcaatgtcgatgctgtagtagagctgatggctgaaagctcgtgatctgtcagcttctgaatatcatcacgaacccagtccaggcaattcctgacaaccatttctgactttggtttctaagttgagctgtgctatttgaattctgatgaagcaagggtacatgtggtctaaggtacttttctataac

SEQ ID NO: 2182 - DNA, 2014 bp, Leymus cinereus x Leymus triticoides
  misc_feature (7)..(8): n is a, c, g, or t
  misc_feature (11)..(12): n is a, c, g, or t
  misc_feature (193)..(193): n is a, c, g, or t
  misc_feature (197)..(197): n is a, c, g, or t
  misc_feature (586)..(586): n is a, c, g, or t
  misc_feature (775)..(775): n is a, c, g, or t
  misc_feature (883)..(883): n is a, c, g, or t
  misc_feature (952)..(952): n is a, c, g, or t
  misc_feature (1315)..(1315): n is a, c, g, or t
  misc_feature (1327)..(1327): n is a, c, g, or t
  misc_feature (1435)..(1435): n is a, c, g, or t
  misc_feature (1480)..(1480): n is a, c, g, or t
  misc_feature (1570)..(1570): n is a, c, g, or t
  misc_feature (1944)..(1944): n is a, c, g, or t
  misc_feature (1953)..(1953): n is a, c, g, or t
agcacannatnncgcagcccttcgctccgcagagagacgcgacacgatggcggcgcccacctcctccaccctcgccttctcccacaccaaaaccctagccgccgccgccgtcgcggggcccaaggccctgcccgccggctccgtcgccttcccggccgcctcccaccccgcatgcgccctcgccgcgtccccntccncccgccgccgcgcggtcgccgccatggtcgcggccccggccaaggtcggcgccgccatgccgtcgctcgacttcgacaccgccgtcttcaacaaggagaaggtctccctcgccggccacgaggagtacatcgtcaggggcggacggaacctcttcccgctgctcccggaggcgttcaagggcgtcaagcagatcggagtcatcggatggggctcccagggtccggcgcaggcccagaacctgagggattccttggtggaagccaagtctgacatcgtcgtgaagattggtctcaggaaaggttccaagtcttttgaggaagcacgtgcagctggattcactgaggagaacggaacattgggagacatatgggagacggtttcaggcagngatcttgtgctgctgttgatctcagattctgcacaggcagacaactatgagaagatcttctctcacatgaaaccaaacagtattcttggtttatcgcatggttttctccttggacatttgcaatcacatggccttgatttcccaaagaacatcagcgtggttgctgtatgccccaagggaatgggcccntcggttcggagactctatgttcagggcaaagaagtaaatggtgctggcatcaacgctagctttgctgttcaccaggatgttgatggaagggcaactgatgttgctctnggatggtcggttgcactaggatccccgttcacctttgctactaccttagaacaggagtacaagagtganatctttggggagcgaggaattttgctgggtgctgtccatggcatcgtggaggctctgtttaggagatacacagagcaaggaatggatgaggagctggcatacaaaagcactgtggagggcatcactggaattatctcaaagaccatctcaaagaaggggatgcttgaagtgtacaactccttgagtgaggaaggcaaaaaggagttcaacaaggcatacagtgcatcattctacccttgcatggacatactctatgaatgctacgaagatgttgcctctggaagtgaaatccggagtgttgtgttggctggtcggaggttttatgataaggaaggccttcctgctttccctatgggcaaaatngaccaaactcgnatgtggaaggtcggcgaaaaggtgcgctcgacccggccagatggtgaccttggcccactccaccccttcacggctggagtttatgttgcacttatgatggcccagatngaggtgctgaggaagaaggggcactcctactctgagatcatcaangagagcgtgatcgagtcggtggactcgctgaaccccttcatgcacgcgcgtggggtggccttcatggtggacaactgctcgacgacggcncggctggggtcgaggaagtgggccccccgcttcgactacatcctgacccagcaggcgttcgtgacggtggacaaggacgcgcccatcaaccaggacctcatcagcaacttcatgtcggaccccgtccacggcgccatcgaggtctgcgccgagctgaggcccaccgtcgacatctcggtgacggccgacgccgactttgtgcgcccagagctccggcagtctgcctagattcggggctgaagagttgttttttgatggattggacattcatggactgtaatgtatgtgtgcgactagctgtttgaagttgtgaactgctgtcaggtagagagagccccctgttggggttggactgagtgagtcgtcttcgtttncagaataanatgttgcttgtttgtgtagcttttgcctcatctctctcgaaattcatatacaagtggggta

SEQ ID NO: 2183 - DNA, 2031 bp, Triticum aestivum
gcccttcgctccccccagaggccagagacatccacgatggcggcgcccacctcctccgcggcatccaccctcgcccccttcgcccaccccaaaaccctagccgccgccgccgccgccgcctcctccatctcctccgtcgccttctccccggccgcatcccaccccgcatgcgcgctctcagcctccacccgccgccgcgcggtcgccgccatggtcgcggccccggccaaggtcggcgcggccatgccgtcgctcgacttcgacaccgccgtcttcaacaaggagaaggtctccctcgccggccacgaggagtacatcgtgaggggcgggcggaacctcttcccgctgctcccggaggcgttcaagggcgtcaagcagatcggcgtcatcggatggggctcccagggtccggcgcaggcccagaacctgagggattccttggtggaagccaagtctgacatcgtcgtcaagattggcctcaggaaaggttccaagtcttttgaggaagcacgaggtgctggattcactgaggagaacggaaccttgggagacatatgggagacggtctcaggcagtgatcttgtgctgctgttgatctcagattctgcccaggcagacaactatgagaagatcttctctcacatgaaaccaaacagcattcttggtttatctcatgggtttctccttggacatctgcaatcacatggccttgatttccctaagaacatcagcgtggttgctgtatgccccaagggaatgggcccgtcggttcggagactgtatgttcagggcaaggaagtaaatggtgctggcatcaacgctagctttgctgtccaccaggatgttgatggaagggccactgatgttgctcttgggtggtcggttgcactaggatccccgttcacctttgctactactctagaacaggagtacaagagtgatatctttggggagcgaggaattttgctgggcgctgtccatggcatcgtggaggctctgtttaggagatacacggagcaaggaatggacgaggagctggcatacaaaagcaccgtggagggcatcactggaattatctctaagaccatctcaaagaaggggatgcttgaggtgtacaactctttgagtgaggaaggcaaaaaggagttcaacaaggcatacagcgcatcattctacccttgcatggacatactctatgaatgctacgaagatgttgcctctggaagtgaaattcggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccactccaccccttcacggctggagtttatgtcgcacttatgatggcccagatcgaggtgctgaggaagaaggggcactcctactctgagatcatcaacgagagcgtgatcgagtcggtggactcgctgaaccccttcatgcacgcgcgcggggtggccttcatggtggacaactgctcgacgacggcgcggctggggtcgaggaagtgggcgccccgcttcgactacatcctgacccagcaggcgttcgtgacggtggacaaggacgagcccatcaaccaggacctcatcagcaacttcatgtcggaccccgtccacggcgccatcgaggtgtgcgccgagctgaggcccaccgtcgacatctcggtgacggccgacgccgacttcgtgcgccctgagctccggcagtcctcctaggctcctcgcccccttgcacctaagttaagtaagctgcgccgggccggtcggggcctggcacgagagttggtttttgatggatggacattcatggactgtaatgtatgtgtgcgactggctgtttgaactcgtgagctgctgctgggtagagtgagtcgtcttcgtttccggaataataaagttagttcgtccggttagatgttgcttgtttgtgtaactcatctctctcgaaataaaccttca

SEQ ID NO: 2184 - DNA, 2087 bp, Triticum aestivum
ccccagaggccagagacatccacgatggcggcgcccacctcctccgcggcatccaccctcgcccccttcgcccaccccaaaaccctagccgccgccgccgccgccgcctcctccatctcctccgtcgccttctccccggccgcatcccaccccgcatgcgcgctctcagcctccacccgccgccgcgcggtcgccgccatggtcgcggccccggccaaggtcggcgcggccatgccgtcgctcgacttcgacaccgccgtcttcaacaaggagaaggtctccctcgccggccacgaggagtacatcgtgaggggcgggcggaacctcttcccgctgctcccggaggcgttcaagggcgtcaagcagatcggcgtcatcggatggggctcccagggtccggcgcaggcccagaacctgagggattccttggtggaagccaagtctgacatcgtcgtcaagattggcctcaggaaaggttccaagtcttttgaggaagcacgaggtgctggattcactgaggagaacggaaccttgggagacatatgggagacggtctcaggcagtgatcttgtgctgctgttgatctcagattctgcccaggcagacaactatgagaagatcttctctcacatgaaaccaaacagcattcttggtttatctcatgggtttctccttggacatctgcaatcacatggccttgatttccctaagaacatcagcgtggttgctgtatgccccaagggaatgggcccgtcggttcggagactgtatgttcagggcaaggaagtaaatggtgctggcatcaacgctagctttgctgtccaccaggatgttgatggaagggccactgatgttgctcttgggtggtcggttgcactaggatccccgttcacctttgctactactctagaacaggagtacaagagtgatatctttggggagcgaggaattttgctgggcgctgtccatggcatcgtggaggctctgtttaggagatacacggagcaaggaatggacgaggagctggcatacaaaagcaccgtggagggcatcactggaattatctctaagaccatctcaaagaaggggatgcttgaggtgtacaactctttgagtgaggaaggcaaaaaggagttcaacaaggcatacagcgcatcattctacccttgcatggacatactctatgaatgctacgaagatgttgcctctggaagtgaaattcggagtgttgtgttggctggtcggaggttttatgacaaggaaggccttcctgctttccctatgggcaaaatcgaccaaactcgcatgtggaaggtcggcgaaaaggtgcgctcgacccggccagatggtgaccttggcccactccaccccttcacggctggagtttatgtcgcacttatgatggcccagatcgaggtgctgaggaagaaggggcactcctactctgagatcatcaacgagagcgtgatcgagtcggtggactcgctgaaccccttcatgcacgcgcgcggggtggccttcatggtggacaactgctcgacgacggcgcggctggggtcgaggaagtgggcgccccgcttcgactacatcctgacccagcaggcgttcgtgacggtggacaaggacgagcccatcaaccaggacctcatcagcaacttcatgtcggaccccgtccacggcgccatcgaggtgtgcgccgagctgaggcccaccgtcgacatctcggtgacggccgatgccgacttcgtgcgccctgagctccggcagtcctcctaggctcctcgcccccttgcacctaagttaagtaagctgcgccgggccggtcggggcctggcacgagagttggtttttgatggatggacattcatggactgtaatgtatgtgtgcgactggctgtttgaactcgtgagctgctgctgggtagagtgagtcgtcttcgtttccggaataataaagttagttcgtccggttagatgttgcttgtttgtgtaactcatctctctcgaaataaaccttcaagactagactcgttgctaatcagcgagatgtgttcctgctcgccgtggcggcggtgagagcatcgagg

SEQ ID NO: 2185 - DNA, 2124 bp, Papaver somniferum
ctatctctctgtgtgtatcagtttcagactcggtcatggcggcggcaacttctttctctacatctgtagcagctccatcgaaaaccctaaaaccagttcactcttcttcttctttgggttttaaattagggtttctgtcttcatcttctaaaaccctaaaacctcttcttcttcgtgtttccaacaacaatgtctcatcatccgccgttggatcggctgttgcatcgaccatgagtgtttcagctcctaccaaacctttgactactcttgattttgaaacctctgtgtttaacaaggagaaggtcactcttgctggaaatgacgagtatattgtcaaaggaggaagagatttattccatttgttgcctgaagcattcaaaggaattaagcagattggtgttatcggttggggttctcagggtcctgctcaagctcagaacttgagagactcacttgtagaagccaagtctgacattgtggtcaagattggtttgaggaagggatctgcttcttttgctgaagcacgttctgttggtttcactgaggagactggaactttgggtgatatatatgaaactgttgctgggagtgatcttgtgttgttattgatttccgatgctgcacaggcagataattacgagaagatattctcccacatgaagcctaacagcattcttggactctcccatggatttcttcttggacatttgcagtcccaggggttgatttccccaaaaatatgagtgtgattgctgtctgccccaagggaatgggtccatcagtgagaagactctatgtccaaggaaaggagataaatggtgctggaattaatgctagttttgcagtccaccaggatgttgatggtagagcaacagatgttgccttaggatggtctgttgctcttggctctccttttacgtttgccactactcttgagtcagaatacaagagtgacatttttggagaaaggggtattttacttggagctgttcatggaatcgtcgaatccttgttcaggaggtacaccgaaaatggaatggccgaagaccttgcttacaagaacactgttgagtgcattactggaattgtttcaaggaccatatccactgagggtatgttgtctgtgtacaactctctttcagagcaaggcaagaaggatttccatgcagcatacagtgcctcctattatccctgtatggacatcttgtatgagtgctatgaggatgtagcgagtgggaatgagatcaaaagtgttgtcttggctgggcgccgattttatgaaaaagaaggcctacccgcttttccaatgggaaagattgatcaaacaagaatgtggttggttggcgagaaagtccgagcaactcgaccagaaggtgacttgggtccactctatcctttcaccgctggagtttttgtggctttaatgatggctcagattgaggtattgagaaagaaggggcattcttactcggaaatcatcaatgaaagtgtgatcgaggcagtggattctttgaatcccttcatgcatgcacgtggagtttcattcatggttgataactgttccacaacagctcgattgggatcaaggaagtgggctccacgattcgattacattctcacccaacaggctttggtagcagtcgacaataacgcccccattaaccaggatcttattagcaacttcttgtctgaccctgtccatggggcaatcgaagtctgtgcccaattgagaccaactgttgacatatccgtgcccgtggatgcagattttgtcagggttgagcttcgtcagtcaagcaattagatttcgaaggagttaaatcgaacatcaccaccatcctgtacatgtgttaatctgcctttcaaaaaggctggaaagcttcaatgttttagttgtctattcagagtggtgaggtataagttagtgaggtttgttgttgagagttgcagacgttagttccgtcttgttttccgttgaacggttctttcccttttgctagtagcatctaaataatactgtagttctatttattaatggacaactacttggtcgtatctgtgctctagtatctgtgctcccttagagcaactgcagtcatacgactataaccaaagatcaaagag

SEQ ID NO: 2186 - DNA, 2790 bp, Musa acuminata
gtggcgttgcttatctcgtgctggccttctcacgccctacgcatttctcctcactgatgtcggcggctgccttcaccccttctgcagcttccgtccccctctccaagtcgctgaaaccggcggcgcccaaaaccctaggttttggatcttccttatcggccttcaagtgcctgaggcgtctcctccctcggctcgacatggacgccgcggccggaaacggcactgccctcgcggcccggatggtctcttccgttccttccatcggcaggtcagccccctccctcgactttgagacctcggtgttcaagaaggagaaggtcacccttgccggccacgatgagtatattgttagaggtggaagagatctgttccccttgttgccggatgcgttcaaggggatcaatcagattggtgtgatcggctgggggtctcagggtccagcccaagcacagaatttgagggattcacttgctgccacaaagtcagacattgtagtaaagattggtttgagaaaaggttctagttcttttgatgaagcacgtgctgctggattcactgaagaaaatgggactttgggtgatatctgggaaacaatttcaggcagtgatcttctgctgttgttgatttctgatgccgcacaggctgacaactatgagaaagtactctctcacatgaagccaaacagcatcctgggcctctcccatggctttcttcttggatacttgcagtccgttggtcttgattttccaaaagacatcagtgtaattgctgtatgccccaagggaatgggcccatctgttagaaggttgtatgtccaggggaaagagatcaacggtgcagggatcaattctagttttgctgtacaccaggatgttgatggcagagctacagatgttgctctggggtggtcagtcgctttaggctcccctttcacctttgctactacattggagcaggaatacaagagtgacatttttggggagcgcggtattttacttggtgctgtgcatggaattgtggaggcattatttagaagatacaccgagaatggaatgagcgaagaactggcttacaaaaacactgtagaatgtatcacaggaataatatcaaaaaccatttcgacaaagggtatgcttgctgtgtacaatgctctgtcagaagaggggaagaaagaatttaatgctgcatacagtgcatcctactatccttgcatggacatattgtatgagtgctatgaggatgttgcctgtggcagtgaaattcgcagcgtcgtactagctggacggcgcttttatgaaaaggatggtctccccgctttccccatgggtaaaatcgatcaaacacgtatgtggaaggttggtgagcaagttcgtgctgttcggcctgaaggcgacttgggtcctttgcatccgtttactgcaggagtttatgtggctctgatgatggcacagattgaggtcctaaggaagaagggacactcttattccgagatcatcaatgagagtgtcatagagtctgttgattcactgaacccttttatgcatgctcgcggggtatcatttatggtggataactgttccacgactgcacgtctgggatccagaaaatgggctccacggtttgattacatcctcacgcagcaggcttttgttactgtcgacaaagagagcccccttaatcaggacctcatcagcaacttcttatccgatccggtccatggtgcgatcgaggtttgtgcacaactgaggccaactgttgacatctcagttccacctgatgctgattttgtccgcccggaattgcgacagacaagcaattgagatgtaagaagtttcgatgcgtaacatctctcggatgtttgaggctaaatctttggaaaatcttcccaaatatgcagttccaacgcttatggagaaattatgattcgagatcgcctagtatgtggttgtagtgaagtagtttgacatttgtgtttccaactttgaataacagtggttgtgtactgcaagagcttgatctaactcttgaagtgtttggctagcttttgtcgttgcagagtactacacatctgtgaatgcttattatggaggttgaagtacaaattaaagcacttgagctgacttagcataggaataaaatgtggaagattcagtcagggaacagaacttgcgaagcttgaatctactcagtgaacatgttctagatgacggatcactataagctactttagatgctgatttgaatgaccatgatggttgatgatagacatcattaaagacttgaagcgatcgacgactcctctcttctcatgatgatctgaatgacttggatctttctactcggggagttgcagagaggagtggcagtgaagtgagagccaaatccatgtccaccaacactagcagccaccgtcatcgatcattgttgtcgtccttactgaacatgagattctctgcttcttgcactgtgctcgtcttcatgcccacgaggaggacgttcttgggagatgggtagatgaatttgatggaattgggtctccgatgccaccggacaatggataatagttggcatagaattgacccacggaatcaacattgtttgcatctctcctttctttaaccatgtcggtgtttgtggaacaggtgtggagtcacggcagcacggccatgacctctgatctcgaaaccttttcccggagagaaagattcgtagatagctactggcacggacgttgacgcaagcaatgacagcgaacggatcaaagagaagaagacgaaaaccaaacatgcc

SEQ ID NO: 2187 - DNA, 2103 bp, Manihot esculenta
ctactccgcaattctcaacaatggctgccgccgccgccacctcctccgccatcaagtcagcactttctactccgtcactctctccaccatcatcatcgcttaatcccaatgcttcgagatcctctctaggatttacatcctcgtcttcctcgacgcttaaacctctggtttctcgtgtctacaccaggcaaaatgccccatcaaatggaagatcatcgctttcagttaatatggtttccgttccttccatcactcctacgacgtcgcttgatttcgacacctctgttttcaagaaagagaaggtcactcttgctggtcatgatgagtatattgtgaggggagggagagacttgtttcccttgttgcctgatgctttcaaggggattaagcagattggagttattggctggggatcacaggggccagcccaagctcagaatttgagggattctcttgctgaagcaaagtctgacatcgtcgtaaagattgggctgaggaagggctcccagtcttttgctgaagctcgtgctgcagggttcactgaggagagtggaactctgggagacatatgggaaactattggtggcagtgatcttgtcttgttattgatttctgatgcagcacaggcagataactatgaaaagatattctcccacatgaaaccaaacagcattcttgggctctcccatggttttcttcttggacatttgcagtccttagggcttgattttcctaaaaacataagcgtcattgctgtttgccctaagggtatggggccttctgttcggagactttatgttcagggcaaagagataaatggtgctggaattaattccagttttgctgtccatcaggatgttgatggtagggctactgatgttgccttaggctggtcagttgcattgggatcacctttcacatttgccaccacattggagcaggagtataggagtgatatttttggggaacggggcatacttctcggtgctgttcatggagttgttgaatgcttgttcagaaggtacactgagaatggaatgcatgacgatttggcttacaagaatactgttgaatgcataacaggaattatatcaaaaaccatctcaacaaagggaatgttggctgtttacaactcattgtcagaagagggcaaaaaggactttgagactgcatacagtgcttcattctatccttgtatggacatcctatatgagtgttatgaagatgtagctagtggtagtgagattcgaagtgtcgttttagctggtcgtcgattctatgagaaggagggccttccagctttcccaatgggtaagattgatcaaacacggatgtggaaagtgggtgagcgtgttagagaaacacgaccaaagggtgacttgggtcccttgtatcctttcactgctggagtgtttgtggctttgatgatggctcagattgaagtattgaggaagaagggacattcatactccgaaatcatcaatgagagtttgattgaagctgtggattcactgaatcctttcatgcatgctcgaggtgtctcattcatggttgataattgttcaacaactgcacgattaggatcaaggaaatgggcaccacgctttgattatatccttgcgcagcaggcctttgtagccgtggatgcaggcgctcctctcaatcaggaccttattagcaatttcctatcagatcctgttcatggggccattgaagtctgtgcccagttgaggccaactgttgacatttcagtgcctcctgatgcagattttgttcgcccagagctgcgccagtctggcaattagataggaaggaatttggctttaccatgatgcatttcatggaggtttacaaggatggaagattttgtaagattgaagtgagtgggatgtgatctaaatgaaagctttatcttcctgtctgagttcacctgagaaatgtttttccttttccatttttccccttttccttttgttgcaagcacgttatacatcccttagtgcggatgctgctttatttctttttgtttgtaagggttatgggatatatttccatctatgtcgttcagttgctaaatagttacgagttcaatttctccctcaa

SEQ ID NO: 2188 - DNA, 1994 bp, Artemisia annua
acgagtgcgtaagctggtatcaacgcagtactccgacgggatacacactccgacgaaatggcggcggcgacaactgctttctcagccttgacacctgccacgtcatcggcggcttccactgcgtctttgaaagctgctcctaaaagcttggggtttaatgtaggagggtttacgttgggtaaaagatgtacgaagtcgttgaaagctggcggtggatctgcgcttggtgccaagatggtgtcggcgccggcggcgataagtaggccgccgactttgcttgattttgagactggcgtttttaataaggagaagattaaccttgctggttatgatgagtatattgtgagaggaggaagagatttattccatttgttgcctgatgcattcaaaggtatcaagcagattggtgttattggatggggttctcagggtcctgctcaagctcaaaatctaagagattctcttgtagaggcaaaatctgatatcaaagtgaagattggtttaagaaagggttctagctcatttaatgaggctcgtgttgctggcttcactgaagagtctggcacacttggagatatttacgagacgattgctgagagtgacttggttttactcttgatatctgattcagctcaggctgataattatgagaaaatattctcgtacatgaagccaaacagcatccttggactttcccatgggtttcttcttggccatttgcaatcagttggctctgattttcccaagaacatcagcgtagttgctgtgtgtcccaaaggaatgggtccatcagtgagaaggctttatgttcaaggaaaggagataaatggagctggaatcaatgcaagttttgccgtccatcaggatgttgatgggagagccactgatgttgcacttggatggtctgttgctcttggttcaccctttacgtttgccactacactcgagcaggagtacaggagtgatatatttggggaaagaggtattttacttggggctgttcatggtattgtggaatctttgtttagaagatatacagaagatggcatgagtgaagatttggcttacaagaataccgtagagtgcattactggaaatatttcaaggactatatcaactcagggcatgaaggcagtgtatgagtcattgacggaagaaggcaagaaagaatttttaacagcatacagtgcatccttctatccttgtatggagatcctgtatgagtgctacgaggatgtagccagtggcagtgagatcagaagcgttgtgttggctggtcgtcgattttatgaaaaagagggtctaccagccttccctatgggcaagattgaccagactcgcatgtggaaggtaggtgaacgtgttcgtgctgtccgacctgcaggtgatttaggcccgttatatcctttcactgctggtgtatatgtggcacttatgatggcccagattgaggtgttgagaaagaagggacattcttattccgagatcatcaatgaaagtttgatagagtctgtggattcattaaacccattcatgcatgctcgaggtgtatcgtttatggtggacaactgttcaacaacagcaaggttgggatcaaggaaatgggctccacgcttcgattatattcttacccaacaggctttagttgctgtagacaacggggccccgcttaaccaggacctcatcagcaacttctttgaagatccagtgcacgaagctgtcaaagtttgtgcagagttgagaccaactgttgacatttcggtgcctgttgatgctgattttgtcagacctgagttgcgtcaaagcaactagagatgatggttcatatgaggtatggctttaacttctttttcagagcaacccaggctcgggtctagttgccatgatgttttgggaaatgtttttatgtagggatatgtttgttatcgatgttgtgatgagactttgttgaattttgtgattttgtaacaataaaagttattgtgtcttgctcc

SEQ ID NO: 2189 - DNA, 2816 bp, Musa acuminata
cgacacgtctctactccatggagctgccaacgaacagagcgcccagtcctggccgccggagacgccgataccacatccaaaccaggtctttatcgtaccacctctcgaccagcgcacataactttcaaccgcgccactacggctttcccaggactagttacaggtgcatcttaaggaacgtgagctcctggcggtcgccggcccgagcggcgctggaaagaccacacggctgtctcgtgccaatgaaaacatacccagctactggatcttcatgcaccacccgacctcgttcgagtatcctttcgaggctttggttctgaacgagttcggcgggcaaggggatgtgctcttgacggagggatgctcctgaggcggcagggtgtagaggagttccaaaggtggagtcatgtagggatgatgcttccgtccgtgtgtggggggtacaggatcctctgcttccttgttctctggtgtagatgttacaggttgagaagatagcctcttcctcctctcggcctctgcttcttttggcaatgggtcgaactatggaacggagctctgatcgcaaaataacatatttacggggcgtgtttctgtgaaagttaatataataactccaggggtgtaattataaaaacgagtgtcaggtatttgaagagggcgttggaagaaaccccaactcgctgggtgttgcgctttcctctgtttctttccatctatggcggcggctcaacccttcacccattccgcctcactctccacggccttgaagccggcggcaccaagaactttaggttttgggtcttccttctcgttcgccaagtcccctagccatctcctccgccggatacacacccaagccgcgcccggtggtcgagtaggcggcgctgcccttgcagctcggatggtctcttccctgccttccatcggtgggtctgtcacctctctcgacttcgagagctcggtgttcaagaaagagaaggtcaaccttgccggccacgatgagtatattgttagaggtggaagagatctgttccatttgttgccggacgcgttcaaggggatcaggcaaattggtgtgatcggatgggggtctcagggtccagcccaggcacagaatttgagggattcacttgccgcggcgaattcagatatcgtggtcaagattggcctaagaaaaggttctcgatcttttgatgaagcacgcgctgctggattcactgaagaaaatggaactttgggtgatatctgggaaacagtttctggcagtgatcttttattgttgttgatttccgatgctgcacaggcggacaactatgagaaggtattctctcacatgaagccaaacagcatcctgggcctctcccatggctttcttcttggacatttgcaaacacttggtcttgattttcccaaaaacattagtgtgattgctgtatgccccaagggaatgggtccttctgttagaaggttgtatgtccaagggaaagaaataaatggtgcaggaatcaattctagttttggtgtacaccaggacattgatggcagggctgcagatgttgctctgggatggtcggtcgctctaggatcacctttcacctttgctaccacattggagcaggaatataagagtgacatttttggagagcgcggtattttactcggcgctgtgcatggaattgtggagtcattgttcagaagatacactgagaacggaatgagcgaagaactggcttacaaaaacaccgtagagtgtatcacggggatcatatcaaagaccatttcaacaaagggtatgcttgctgtgtacgatgctctgtctgaagaggggaagaaagaatttaatgctgcatatagtgcatcatactacccttgcatggatatattatacgagtgctatgaggatgttgcatgtggcagtgaaattcgcagtgtcgttctagctggacgacgcttctacgaaaaggagggtcttcctgctttcccaatgggtaaaatcgatcaaacacgtatgtggaaagttggtgagaaagttcgtgccgttcgtcctgaaggtgatttggggcctctgcatccgtttactgcaggcgtttatgtagctttgatgatggcacagatcgaggtcctaaggaagaagggacactcctattcggagatcatcaacgagagtgtcatagagtctgttgattcactgaaccctttcatgcatgctcgtggggtgtcatttatggtggataactgttccacgactgcacgtctgggatcaaggaaatgggctccacggtttgattacatcctcacgcagcaggcttttgttggtgtcgataaaaagagccccattaatcaagacctcctcagcaacttcttgtctgatccagttcatggtgcaatcgaggtttgtgcacggttgaggccaactgttgacatctcagttccacccgacgccgatttcgtccgcccggaactgcggcaaagtagcaattgagatgtgattagttttgatactcggaccaacaagtgtgtgtttgtttgagaggttaaactcaaggaaagcttcctaaagatgcagttccatcaagcctccggagaaattaggctgccgattatgtagctggtagtgaagcgttgtggcgtttgtttgtagttttgcacgttgaataatatggtgctccactgagcatcgttcgtgttgttttcgtcttcgtcgtccggcagtaaattggtgattatgtaccctactaagacaatattgttctcttttttagatctttttgacggaatggaatttttattggttgacagcagccgattgctta

SEQ ID NO: 2190 - DNA, 1879 bp, Plantago ovata
caatccctcactccttgggctttctctcatcgtcgtctccttccatgaaatccctcagagccgccgtttactcttcccgtgcttccggctcttccatgtcagcagcggctagtatggtctctgcaccttctaccgtcaaggcaccagccaccttcgatttcgacacttccgtcttctccaaggagaaaatcaatttagccggccacgatgagtacatcgtgagaggaggaagaaacttgtttaagctgttgcctgacgcctttaagggcatcaagcagattggtgtcattggctggggttcacagggacctgctcaagctcagaatctgagggattcactatcagaaatcaattctgatattgtcgtgaagattggtctgaggaagggttctcgatcatttgctgaagctcgtggcgctgggtttacagaagagaatgggaccttgggagatatctatgagaccatctctaccagtgatttagtgcttcttttgatatcagattcagctcaggctgataattatgagaaaattttctctcacatgaagccgaacagtattcttggtctgtcccatggatttctgttgggtcatttacaatccatgggacatgatttccctaaggatatcagtgtcattgcagtatgccccaagggaatgggcccttcggtgcgaaggttgtatgtgcaaggaaaagaagttaatggtgctggtattaatgccagttttgctgttcaccaggatgttgatggcagagctacagatgttgctctaggatggtcagttgcccttggttctccgtttacattcgcaactaccctcgagcaggagtacaagagtgacatcttcggggagagaggtattttgcttggtgctgtgcatggtatagtggaatctttatttcgaagatacacagaaaatggaatggctgaggaacttgcttacaagaacactgtcgaaagtatcactggagttatatctaagaccatatcaacacagggtatgctggcagtctataacgcactgagtgaagaaggtaaaagagactttgaagctgcatacagtgcttcatattatccttgcatggatattctatatgagtgctatgaagacgtagccagtggaagtgaaataaggagtgttgtcttggctggacgccgcttctatgaaaaggatggacttcctgcattcccaatgggcaagattgaccagacacgaatgtggaaggtcggtgaacgtgtaagagcaacacgcccggcaggtgacatgggacctctttatcctttcacagcaggtgtcttcgtggcactgatgatggcccagattgaagttcttaggaagaaaggacattcttactctgaaattattaacgagagtgtgattgagtctgtggattcattgaacccattcatgcatgctcgtggtgttgcattcatggttgataactgttcaacaactgctcgcctgggatccaggaaatgggctccaagattcgattacgtccttacccagcaggcacttgttgctgttgacagcaaagccccaattaaccaagatctgattagcaattttatgtcggatccggttcacggtgctattgatgtgtgcgcccagttgaggccaactgtggacatttcagtgcccgcagatgctgattttgtccgtccggagttgagataggccactttggacaatgttactattgtctttagcattttgaaccaagcctagtttgttgagtgattttatctttcgactgtttaatttaagtctgaaccgttttgttgtcttgcatgcgagagactaatgcagtgtgatggtgtttgttataaaataagtatattactgcataatgtactcagcatagcaactttcgttgt

SEQ ID NO: 2191 - DNA, 2008 bp, Papaver somniferum
tttcagactcggccatggcggcggcaacttctttctctccatctgtagcagctccatcaaaaaccctaaaaccagttcactcttcttcttctttgggttttaaattagggtttctgtgttcatcttctaaaaccctaaaacctcttcttattcgtgtttccaacaacaatgtctcatcatccgccgttggatcggctgttgcatctaccatgagtgtttcagctcctaccaaacctttgactactcttgattttgaaacctctgtgtttaacaaggagaaggtcactcttgctggaaatgacgagtatattgttagaggaggaagagatttattccatttgttgcctgaagcattcaaaggaattaagcagattggtgttattggttggggttctcagggtcctgctcaagctcagaacttgagagactcacttgtagaagccaagtctgacattgtggtcaagattggtttgaggaagggatctgcttctattgctgaagcacgttctgttggtttcactgaggagactggaactttgggtgatatttatgaaactgttgccgggagtgatcttgtattgttattgatttccgatgctgcacaggcagataattacgagaagatattctcccacatgaagcctaccagcattcttggactctcccatggatttcttctcggacatttgcagtcccagggggttgattttcccaaaaatatgagtgtgattgctgtctgccccaagggaatgggtccatcagttagaagactctatgtccaaggaaaggagataaatggtgctggaattaatgctagttttgctgtccaccaggatgttgatggtagagcaacagatgttgccttaggatggtctgttgctcttggctctccttttacgtttgccactactcttgagtcagaatacaagagtgacatttttggagaaaggggtattttacttggagctgttcacggaatcgtcgaagccttgttcagaaggtacaccgaaaatggaatggccgaagaccttgcttacaagaacactgttgagtgcatcactggaattgtttcaaggaccatatccactgagggtatgttgtctgtgtacaactctctttcagagcaaggcaagaaggatttccatgcagcatacagtgcctcctattatccctgtatggacatcttgtatgagtgctatgaggatgtagctagtgggaatgagatcaaaagtgttgtcttggctgggcgccgattttatgaaaaagaaggcctaccagcttttccaatgggaaagattgatcaaacaagaatgtggttggttggtgaaaaagtccgagcaactcgaccagaaggtgacttgggtccactctatcctttcaccgctggagtttttgtggctttaatgatggctcagattgaggtattgaggaagaagggacattcttactcggaaatcatcaatgaaagtgtgatcgaggcagtggattctttgaatcctttcatgcatgcacgtggagtttcattcatggttgataactgttccacaacagctcgattgggatcaaggaagtgggcgccacgatttgattacattctcacccaacaggctttggtagcagtcgacaataacgcccccattaaccaggatcttattagcaacttcttgtccgaccctgtccatggggcaatcgaagtctgtgcccaattgagaccaactgttgacatatccgtgcccgtagatgcagattttgtcagggttgagcttcgtcagtcgagcaattagacttgaaggagttaaatcgtacatcaccaccatcgtgtacatgatcttcctttcaagaaggctggaaaggcttcaatgtttttagttgtctattcagagtggtgaggtataagttagtgaggtttgttcttgagagttgcagacgttccttttggctagtagcatctaaataatactgtcgttctatttattaatggacaactacttggtcgtttctgtgctcc

SEQ ID NO: 2192 - DNA, 2628 bp, Sorghum bicolor
ggggaccttgcaaaattcacgcggaaaagcagcggacggcatgggtatcggcattcggcaacgccgcgacggcacggcagctcaagagctcttcgcagtttcctcgctgccgcgcaccgtgcacggcgcccgcggtctcgagatccacacgaccagcgcgcggggggagacgctaaaaaatgacgccgcccgcgtgcggcgtgctgcctgcgccgcgccgcgcatctccaggcgagggcgtgcaacccgccaaaaccacgtaggctcgccgcgcacgtgaacggccaacggcccctagccccggcgtcgtcgcatcgcggccgacgacggcgcatcacacggcgggcttagccgtataaatccacagggattagccctgacacgtccgccctcatcagtcacacacggacagttcccacccccaccacaccaaccgctcgccacccgcctcgccgtcctcgttcgcagctgtcctgcactgcaatcggctacatggcggcctccaccctcgcgttcggccaccccaaaaccctaggcgccgccgccgcatccgccggtgcgaaggccctcccgacctcctcgtccgtctccttcccggccacccagcagcccgcgtgccacctctcctcgtccgcgtccgcgtccgcgcacggggcccgccgccgggacgtcgccgccatggtctacgcgccgccggccgtcggcaccgccatgccgtcgctcgacttcgacacctccgtcttcaacaaggagaaggtctccctcgccggccacgaggagtacatcgtgcgcggcgggaggaacctgttcccgctgctcccggaggcgttcaagggggtcaagcagatcggagtcattggatggggctcgcagggacctgcccaagctcagaacctgagagattcactggctgaagcaaagtcagacattgttgtgaagattggtctacggaaaggatccaaatcttttgaggaagcacgtgctgctggattcaccgaagagagtggaaccttgggcgatatttgggaaactgtctccgacagcgatcttgtgttgctgctgatttctgatgctgcacaggctgacaactatgagaagatcttctctcacatgaaaccaaacagtatccttggtttatctcatggatttcttctgggacatttgcaatcacttggacttgatttcccaaagaacatcagtgtgattgctgtatgccccaagggaatgggtccatctgtccgcaggctttatgttcagggcaaggaagtcaatggtgctggcatcaactctagctttgctgtgcaccaggatgttgatggaagggcaactgatgttgctctagcatggtcagttgcacttggctccccctttacatttgctactactttagaacaggagtacaagagtgatatctttggagagcgaggcattttgctgggtgcggtccatggtatcgtggaggctctgtttaggagatacacagagcaaggaatggatgaagagtcagcctacaaaaacactgttgagggcataactgggatcatctcgaaaaccatctcaaagaaggggatgcttgaagtgtacaactcattgagtgaggaaggcaaaaaggagttcaacaaggcttacagtgcatcgttttacccgtgcatggatatactctacgaatgctatgaagatgtggcctctggaagtgaaatccggagtgtggtgttggctgggcggaggttttacgaaaaagagggcctcccagcttttccaatgggcaacattgaccaaactcgcatgtggaaggttggtgaaaaggtgcgcgcaacccgtccagaaggtgatcttggcccgctccatgccttcactgctggagtgtacattgccttgatgatggcgcagattgagatcttgaggaagaaggggcactcctactctgagatcatcaacgagagcgtgatcgagtcagtggactcgctgaacccgttcatgcacgcccgtggggtcgccttcatggtggacaactgctccacgacggctcgcctgggatccaggaagtgggcaccacgcttcgactacatcctgacgcagcaggccttcgtgacggtggacaaggacgcccccatcaaccaggacctcatcagcaacttcttgtcagaccctgtccatggcgccatcgaggtctgcgcggagctgaggcccaccgtcgacatctccgtgactgccaacgccgactttgtgcgcccagagctccgacaatcttcctagattgaggcagtgagcagagagagtgagagggagggagaggaagagaggatttcgtgtccagagttagaacagagttgtatgttgtgcgactgctttgtaagtctgaactgaacctatgtgagcttctatcagaggacctgagaaagcttgggcatctgtttttggaataaaatgggcccttatatggaatagcttgggagggtatgtgcatgtgcgaaagtatgataaacaggtggtctctcttcccattggtttgctctttgctcgtcatgcccgtgcctttttttttttttgtggtatataaggcccggcccggccaccttgaatcactcgaaatgttgtctacgaatggactaagagagtattatagta

SEQ ID NO: 2193 - DNA, 1937 bp, Flaveria ramosissima
cttgttactccaccggtgttactcatggcggccgccgcacctaccttctcctccgccgcacctaccaccaactctccaccgtcgtcgtcttcaccgactctcaaaacggctcctcaaaccctaggtttcgccacaacgtttttatcatccaaaacctcattcaaatcgcttcaaactcgcttgttatcttccaatcgtggctccggctccgctctcggagctcgtatggttgcagcgccggtgatcagcaagtcgccggtgtctctcgatttcgatacgtcggttttcaaaaaggagaaagtcaacctcgctggtcacgaagagtacattgtgagaggaggtagaaatttgtttcatttgttgcctgatgcatttaaggggattaagcagattggcgtgatcggttggggctctcagggtcctgcacaggcgcagaatttgagggattcacttgcagaagcaaagtctgatattgtagtgaagattggcttaaggaagggttcgagttcgtttgctgaggcgcgtgctgctggtttcagtgaagaaagtgggactcttggagatatttatgagactatttctggtagtgatttggtcctgctcttgatatctgattcagctcaggctgataattatgagaaaatcttctcccacatgaaaccaaacagcatccttggactttctcatggtttccttcttggtcatttacaatcaatcggtcttgatttccccaaaaatgttagtgtggttgctgtgtgtcccaaaggaatggggccatcagttagaaggctatatgttcaaggaaaagagatcaatggagccgggattaatgcaagttttgctgtccatcaggatgttgatggcagagccactgatgttgcacttggatggtcagttgctcttggttcaccttttacatttgctactaccctagaacaggagtataaaagtgatatattcggtgaaagaggtattttacttggtgctgtgcacggtattgtggagtcattatttagaaggtacacagagcaaggtatgactgaagatttggcttacaagaacactgtagaatgcataaccggagtaatttcaaagaccatatcgaccaagggcatgaaagctgtttatgagtcactctcagaagaaggcaagaaagatttcttgattgcatacagtgcttcttattatccctgcatggaaatcttgtacgagtgttatgaggatgtggctagtggcagtgagatcaggagcgttgttttggctggccgccgcttttatgaaaaagagggtctaccagccttcccaatgggcaaaattgatcaaacccgcatgtggaaagttggcgaacgagttcgcgccacacgacccgccggcgatttaggcccgctgtatcctttcacagcaggtgtctacgtggcgctaatgatggcccagattgaggtactgaggaagaaagggcactcttattctgaaatcatcaacgaaagtttaatcgaatctgtggattctttaaaccctttcatgcatgctcgaggcgtttcgttcatggtggacaattgttccaccactgcacggttagggtcaaggaaatgggctccacggttcgactacaacctgacccaacaggccttggtagcagtagacaatgacaccccagtgaaccaggaccttgttaaagccttctttgaagatccggttcatgaagcggtcaaagtgtgtgcagagttgagacccacggtcgacatctcggtgcctgcagatgctgattttgtgagacctgagctgcgtcagtctagcaactagaaagagatggattaaggtatttgcatttacacatgccatggtgttatcttatataagtaagttgcttgttatggacatgattttggtggttgaattttggtaattctagaataatggtggtttggtgtaaaaaa

SEQ ID NO: 2194 - DNA, 1839 bp, Solanum phureja
gcttgcggctcgcatggtcgccgcacctgctaccgtcaaagctcctgcttcgtttgattttgaaacatccatttttaagaaggagaaagtaaccctcgctggaaatgatgagtacattgtgaggggagggagagatttgttcaagtatttgcctgatgcttttaaaggaatcaagcagattggagttatcggctggggttctcagggacctgctcaagcccagaacttgagggattctctcgcagaaataaaatctgacatagttgttaagattggtttaaggaagggttcaagctcatttgcagaggcccgcacagctgggtttactgaagagagtgggacccttggtgacatatatgagactatctctggcagtgatctagtgctgcttttgatttctgatgctgctcaggctgataattatgagaaagtattttctcacatgaagccaaacagcatacttgggctttcacatggattcctccttggccatttgcagtcaatggaccttgacttcccaaagaacattagtgtgattgctgtatgtcccaagggaatgggtccctcagtcaggagattatatgttcaaggaaaagaagttaatggtgctggaattaattcaagttttgcagttcaccaggatattgatggaagagccacagatgttgctctagggtggtctgttgcccttggttctccctttacttttgctactactctagagcaggaatataaaagtgacatttttggagaacgaggcattttacttggtgctgtccatggagttgtggagtcacttttcagaaggtacactgagaacggaatgaatgaggagcttgcatacaagaacactgtagagtgcataacaggagtcatttcaaagaccatatcaacaaagggcatgttggctgtgtacaactcattgactgaagagggcaagagggagtttgaagctgcatacagtgcttcattttacccatgcatggagattttgtatgagtgctatgaagatgtagctacaggtagcgagatcaggagtgttgtcttggcaggccgccgcttttatgaaaaggagggcttacctgccttcccaatggggaaaattgaccaaacaaggatgtggaaggttggtgagcgcgttcgagcaacccggccagccggtgatcttggtcctctgtatcctttcactgctggtgtctttgtggcattgatgatggcccagattgaggttctgaggaagaaaggtcactcttactccgagattatcaatgaaagcgtcatcgagtctgtagattctttgaatccgtttatgcacgctcgtggagtatcattcatggttgacaattgctctacaacagcacgtttaggttccaggaagtgggcccctcgatttgattacaatctcacccagcaagcacttgtagctgtggataataacgcccctatcaatcaagatctcatcagcaacttccttgcagatcctgtgcatggagctattaaagtctgtgctgaactgagacccacagttgatatttctgtaacagcagatgctgattttgtccgccccgagctcaggcaatctggcaattaagggctttacgggtgggaattttgtggaattgtgaggtttagattttattttgttgatgtgtgttggtgaaggcaagaatacttaaatctgttagcttacaagaatcttagcctttttcgttgcttagttacgccggtactagcacttcctttatgtaaccttttgctgaataacagattcgaaatttgggaacccttttagcaactaaaaaatgtgggttatgtggcagtagcatgtttcagtatcta

SEQ ID NO: 2195 - DNA, 2058 bp, Saccharum officinarum
cacacgacagccccacccaccaaccgctcgccgctcgccagtcgccagtcgccacccgcctcgccgtccttgctcgctcgcgcagctgtcctgcactgcacccggctacatggcggcctccaccctcgcgttcggccaccccaaaaccctagccgccgccgccgccggtgccaagagcctcccgacctcctcgtccgtctccttccccgccacccagcagcccgcgtgcctcctctcctcgtccgcgtccggggcccgccgccgggacgtcgccgccatggtctccgcgccgccggccgtcggcaccgccatgccgtcgctcgacttcgagacctccgtattcaacaaggagaaggtctccctcgcgggccacgaggagtacatcgtgcgcggcgggaggaacctgttcccgctgctcccggaggcgttcaagggggtcaagcagatcggagtcattggatggggctcgcagggtcctgcccaagctcagaacctgagagattcactggctgaagcaaagtcaaacattgttgtgaagattggtctccggaaaggatccaaatcttttgaggaagcacgtgctgctggattcaccgaagagagtggaaccttgggtgatatttgggagactatctcaggcagcgatcttgtgttgctgctgatatctgatgctgcacaggctgacaactatgagaagatcttctctcacatgaaaccaaacagtatccttggtttatctcatggatttcttctgggacatttgcaatcacttggacttgatttcccaaagaacatcagcgtgattgctgtatgccccaaggggatgggtccatctgtccgcaggctttatgttcagggcaaggaagtcaatggtgctggcatcaactctagctttgctgtgcaccaggatgttgatggaagggcaactgatgttgctctagcatggtcagttgcgcttggctcccccttcacgtttgctactactttagaacaggagtacaagagcgatatctttggagagcgcggcattttgctgggtgctgtccatggtattgtggaggctctgtttaggagatacacagaacaaggaatggatgaagagtcagcctacaaaaacactgttgagggcatcactgggatcatctcgaaaaccatctcaaagaaggggatgcttgaagtgtacaactctttgagtgaggaaggcaaaaaggagttcaacaaggcttacagtgcatcgttttacccgtgcatggatatactctacgaatgctatgaagatgtggcctctggaagcgaaatccggagcgtggtgttggctgggcggaggttttacgagaaagagggcctcccagcttttccaatgggcaacatcgaccaaactcgcatgtggaaggtcggtgaaaaggtgcgctcaacccgtccagaaggtgatcttggcccgctccatgccttcactgctggagtgtacattgccctgatgatggctcagattgagatcctgaggaagaaggggcactcctactctgagatcatcaacgagagcgtgatcgagtcggtggactcgctgaacccgttcatgcatgcccgtggggtcgccttcatggtggacaactgctccacgacggctcgcctgggatccaggaagtgggcgccgcgcttcgactacatcctgacacagcaggccttcgtggcggtggacaaggacgccccgatcaaccaggacctcatcagcaacttcctgtcggaccctgtccacggcgccatcgaggtgtgtgccgagctgaggcccaccgtcgacatctccgtgcctgccaacgccgactttgtgcgcccggagctccggcagtcttcctagattgaggcggtgagcagagagagagaggaagaggaagagaggatttcgtgtccagagttagaacagagtgttgtatgttgtgcgactgcttgtaagtctgaactgaacctatgtgagcttctatcagaacctgagaaagcttgggcatctgttttcggaataaaatgggcccttatatggaattacaaaaacaaacaagatac

SEQ ID NO: 2196 - DNA, 2108 bp, Triticum aestivum
ggggcccttcgctccccccagaggccagagacggacacgatggcggcgcccacctcctccgcggcatccaccctcgcccccttctcccaccccaaaaccctagccgccgccaccgccgccggaggctcatcctctgtcgccttctctccggccgcctcccaccccgcatgcgccctatcagtctcgggcgcccgccgccgcgcggtcgccgccatggtcgcggccccggccaaggtcggcgccgccatgccgtcgctcgacttcgacaccgccgtcttcaacaaggagaaggtctccctcgccggccacgaggagtacatcgtgaggggcgggcgcaacctcttcccgctgctcccggaggccttcaagggcgtcaagcagatcggggtcatcggatggggctcccagggtccggcgcaggcccagaacctgagggattccttggtggaagccaagtctgacatcgtcgtcaagattggcctcaggaaaggttccaagtcttttgaggaagcacgtggtgctggattcaccgaggagaacggaaccttgggagacatatgggagacggtctctggcagtgatcttgtgctgctgttgatctcagattctgcccaggcagacaactatgagaagatcttctctcacatgaaaccaaacagcattcttggtttatctcacgggtttctccttggacatctgcaatcacatggccttgatttccctaagaacatcagcgtggttgctgtatgccccaagggaatgggtccatcagttcggagactgtatgttcagggcaaggaagtaaatggtgctggcatcaacgctagctttgctgttcaccaggatgttgatggaagggccactgatgttgctcttgggtggtcggttgcactaggatccccgttcacctttgctaccactctagaacaggagtacaagagtgatatctttggggagcgaggaattttgctgggtgctgttcatggcatcgtggaggctctgtttaggagatacacagagcaaggaatggacgaggagctggcatacaaaagcactgtggagggcatcactggaattatctccaagaccatctcaaagaaggggatgcttgaagtatacaactccttgagcgaggaaggcaaaaaggagttcaacaaggcatacagtgcatcattttacccttgcatggacatactctacgaatgctacgaagatgttgcctctggaagtgaaatccggagtgttgtgttggctggtcggaggttctatgacaaggaaggccttcctgctttccctatgggcaaaatcgaccaaactcggatgtggaaggttggcgaaaaggtgcgctcgacccggccagatggtgaccttggccctctccaccccttcacggctggagtttatgttgcacttatgatggcccagattgaggtgctgaggaagaaggggcactcctactctgagatcatcaacgagagcgtgatcgagtcggtggactcgctgaacccgttcatgcacgcgcgaggggtggccttcatggtggacaactgctcgacgacggcacggctggggtcgaggaagtgggcgccccgtttcgactacatcctgacccagcaggcgtttgtgacggtggacaaggacgagcccgtcaaccaggacctcatcagcaacttcatgtcagaccctgtccatggcgccattgaggtctgcgccgagctgaggcccaccgtcgacatctcggtgacggccgacgcggactttgtgcgcccagagctccggcagtctgcctaggtttggggccgaagagttgttttttgatgggtggacaattcatggactgtaatgtatgcgtgcgactagctgtttgaagttgtgaactgctgtcaggtagagagagacccctgttggtggtggactgagtgagtcgtcttcgtttccagaataataaaagttggttcgtcgggatagatgttgctgttggtgtagcttttgccgcatctctctcgaaattcacgtaccagtggtaacagcagacgctgccccggcctagcttatggtttatggactgttatggcgtattttgtaattgaaagatggccctctcctat

SEQ ID NO: 2197 - DNA, 2165 bp, Triticum aestivum
ggggcccttcgctccccccagaggccagagacggacacgatggcggcgcccacctcctccgcggcatccaccctcgcccccttctcccaccccaaaaccctagccgccgccaccgccgccggaggctcatcctctgtcgccttctctccggccgcctcccaccccgcatgcgccctatcagtctcgggcgcccgccgccgcgcggtcgccgccatggtcgcggccccggccaaggtcggcgccgccatgccgtcgctcgacttcgacaccgccgtcttcaacaaggagaaggtctccctcgccggccacgaggagtacatcgtgaggggcgggcgcaacctcttcccgctgctcccggaggccttcaagggcgtcaagcagatcggggtcatcggatggggctcccagggtccggcgcaggcccagaacctgagggattccttggtggaagccaagtctgacatcgtcgtcaagattggcctcaggaaaggttccaagtcttttgaggaagcacgtggtgctggattcaccgaggagaacggaaccttgggagacatatgggagacggtctctggcagtgatcttgtgctgctgttgatctcagattctgcccaggcagacaactatgagaagatcttctctcacatgaaaccaaacagcattcttggtttatctcacgggtttctccttggacatctgcaatcacatggccttgatttccctaagaacatcagcgtggttgctgtatgccccaagggaatgggtccatcagttcggagactgtatgttcagggcaaggaagtaaatggtgctggcatcaacgctagctttgctgttcaccaggatgttgatggaagggccactgatgttgctcttgggtggtcggttgcactaggatccccgttcacctttgctaccactctagaacaggagtacaagagtgatatctttggggagcgaggaattttgctgggtgctgttcatggcatcgtggaggctctgtttaggagatacacagagcaaggaatggacgaggagctggcatacaaaagcactgtggagggcatcactggaattatctccaagaccatctcaaagaaggggatgcttgaagtatacaactccttgagcgaggaaggcaaaaaggagttcaacaaggcatacagtgcatcattttacccttgcatggacatactctacgaatgctacgaagatgttgcctctggaagtgaaatccggagtgttgtgttggctggtcggaggttctatgacaaggaaggccttcctgctttccctatgggcaaaatcgaccaaactcggatgtggaaggttggcgaaaaggtgcgctcgacccggccagatggtgaccttggccctctccaccccttcacggctggagtttatgttgcacttatgatggcccagattgaggtgctgaggaagaaggggcactcctactctgagatcatcaacgagagcgtgatcgagtcggtggactcgctgaacccgttcatgcacgcgcgaggggtggccttcatggtggacaactgctcgacgacggcacggctggggtcgaggaagtgggcgccccgtttcgactacatcctgacccagcaggcgtttgtgacggtggacaaggacgagcccgtcaaccaggacctcatcagcaacttcatgtcagaccctgtccatggcgccattgaggtctgcgccgagctgaggcccaccgtcgacatctcggtgacggccgacgcggactttgtgcgcccagagctccggcagtctgcctaggtttggggccgaagagttgttttttgatgggtggacaattcatggactgtaatgtatgcgtgcgactagctgtttgaagttgtgaactgctgtcaggtagagagagacccctgttggtggtggactgagtgagtcgtcttcgtttccagaataataaaagttggttcgtcgggatagatgttgctgttggtgtagcttttgccgcatctctctcgaaattcacgtaccagtggtaacagcagacgctgccccggcctagcttatggtttatggactgttatggcgttttttgtaattgaaagatggccctctcctatcaacagtaacatgatgatgtctgtgtgacgtggtaactgaaaaccggtcaaaacaac

SEQ ID NO: 2198 - DNA, 2171 bp, Sorghum bicolor
ataaatccacagggattagccctgacacgtccgccctcatcagtcacacacggacagttcccacccccaccacaccaaccgctcgccacccgcctcgccgtcctcgttcgcagctgtcctgcactgcaatcggctacatggcggcctccaccctcgcgttcggccaccccaaaaccctaggcgccgccgccgcatccgccggtgcgaaggccctcccgacctcctcgtccgtctccttcccggccacccagcagcccgcgtgccacctctcctcgtccgcgtccgcgtccgcgcacggggcccgccgccgggacgtcgccgccatggtctacgcgccgccggccgtcggcaccgccatgccgtcgctcgacttcgacacctccgtcttcaacaaggagaaggtctccctcgccggccacgaggagtacatcgtgcgcggcgggaggaacctgttcccgctgctcccggaggcgttcaagggggtcaagcagatcggagtcattggatggggctcgcagggacctgcccaagctcagaacctgagagattcactggctgaagcaaagtcagacattgttgtgaagattggtctacggaaaggatccaaatcttttgaggaagcacgtgctgctggattcaccgaagagagtggaaccttgggcgatatttgggaaactgtctccgacagcgatcttgtgttgctgctgatttctgatgctgcacaggctgacaactatgagaagatcttctctcacatgaaaccaaacagtatccttggtttatctcatggatttcttctgggacatttgcaatcacttggacttgatttcccaaagaacatcagtgtgattgctgtatgccccaagggaatgggtccatctgtccgcaggctttatgttcagggcaaggaagtcaatggtgctggcatcaactctagctttgctgtgcaccaggatgttgatggaagggcaactgatgttgctctagcatggtcagttgcacttggctccccctttacatttgctactactttagaacaggagtacaagagtgatatctttggagagcgaggcattttgctgggtgcggtccatggtatcgtggaggctctgtttaggagatacacagagcaaggaatggatgaagagtcagcctacaaaaacactgttgagggcataactgggatcatctcgaaaaccatctcaaagaaggggatgcttgaagtgtacaactcattgagtgaggaaggcaaaaaggagttcaacaaggcttacagtgcatcgttttacccgtgcatggatatactctacgaatgctatgaagatgtggcctctggaagtgaaatccggagtgtggtgttggctgggcggaggttttacgaaaaagagggcctcccagcttttccaatgggcaacattgaccaaactcgcatgtggaaggttggtgaaaaggtgcgcgcaacccgtccagaaggtgatcttggcccgctccatgccttcactgctggagtgtacattgccttgatgatggcgcagattgagatcttgaggaagaaggggcactcctactctgagatcatcaacgagagcgtgatcgagtcagtggactcgctgaacccgttcatgcacgcccgtggggtcgccttcatggtggacaactgctccacgacggctcgcctgggatccaggaagtgggcaccacgcttcgactacatcctgacgcagcaggccttcgtgacggtggacaaggacgcccccatcaaccaggacctcatcagcaacttcttgtcagaccctgtccatggcgccatcgaggtctgcgcggagctgaggcccaccgtcgacatctccgtgactgccaacgccgactttgtgcgcccagagctccgacaatcttcctagattgaggcagtgagcagagagagtgagagggagggagaggaagagaggatttcgtgtccagagttagaacagagttgtatgttgtgcgactgctttgtaagtctgaactgaacctatgtgagcttctatcagaggacctgagaaagcttgggcatctgtttttggaataaaatgggcccttatatggaatagcttgggagggtatgtgcatgtgcgaaagtatgataaacaggtggtctctcttcccattggtttgctctttgctcgtca

SEQ ID NO: 2199 - DNA, 1809 bp, Ambrosia trifida
ccctttttcttctcttccaaccctacccttaaacccctcaaagctcgctccaatggctctgctcttggtgcccgtatggtttcagccccagccattactcctaaacccccttccttcttgactttgattacctctgtttttaaaaagaaaagattaaccttgctggtcatgattgagtatattgtgagaggtggacgggatttgttccatttgttgcctgatgcttttaaaggtattaagcagattggtgttattggatggggttctcagggtcctgcacaagctcagaatcttagggattcacttgcagaagcaaagtctgatattgtagtgaagatcggtttacgtaagggttcgagttcgtttaatgaggctcgggcagctggattttcggaggaaagtggaacacttggagatatttatgagactatctctggtagtgatttggttctgcttttgatttctgattccgctcaggctgataactatgagaaaatcttttcacacatgaagccaaacagcatacttggactttcacacgggttccttcttggtcatctgcaatcagctgggcttgatttccccaagaacataagtgtggttgctgtgtgtcccaaaggaatgggtccatctgttaggaggttgtatgtacaaggcaagagattaacggagccggaatcaacgctagttttgctgttcatcaggatgttgatggaagagccactgatgtcgcacttgcatggtcagtcgcacttggttcaccttttacgtttgccactactcttgagcaggagtataagagtgatatattcggggagcgaggtattttgcttggtgcggtgcatggtattgtggagtctttgtttagaaggtataccgaagatggtatgagtgaagaattggcttacaaaaatacagtggagtgcataactggtactatatcaaggataatctcgactcagggcatgaaagccgtatatgagtcattggacgaagaaggcaagaaagagttcttgacagcgtacagtgcatcttactatccttgtatggacattctgtatgagtgctatgaggatgtggcgactggcagtgagataagaagcgttgtgttggctggccgtcgattttatgaaaaggagggtttgccagcattccctatgggcaagattgatcagactcgaatgtggaaagtaggtgaacgggttcgggctgtccgacccgcgggtgatttaggccccttatatcctttcaccgctggtgtctatgtcgcactaatgatggctcagattgaggtgttgaggaagaaaggacattcttattctgagattatcaatgaaagcttgatcgagtcagtggattcattgaatccgttcatgcatgctcgaggtgtgtcgtttatggtggacaactgctcaacaactgcaaggctgggatcaaggaaatgggctccacggtttgattatattcttacccaacaggctttagttgctgtagacaacaaagccccacttaaccaggacctgatcagcaacttctttgaagatccagtgcacgacgctgttaaagtttgtgcggagttgagaccgactgttgacatctcagtgcccgctgatgctgattttgtccgacctgagctgcgtcaaggtagcaactgagtatgactcccaggctcttgtctagttaaatctatcatgcgctatgcagatttttttctgtatgtgtgcctagttcttacgaatgttgcattcctacttatgttgaattttgtaataaaagttgttcgtcctagcgtttgtttgcaaaaaagaa

SEQ ID NO: 2200 - DNA, 1633 bp, Flaveria ramosissima
caaatcgctcaaagctcgttccaatggtggctgtggttctgctattggagctcgtatggtttcagctccggcgataagcaaacccccaatgcttcttgattttgagacctctgttttcaaaaaggagaagattaaccttgctggtcatgatgagtatattgtgagaggaggaagagatttgtttcatttgttacctgaggcttttaaaggtatcaagcagattggtgttattggatggggttctcagggtcctgctcaagctcaaaaccttagggattctcttgcagaagcgaaatctgatattgttgtgaagattggcttacgaaaggggtcgagttcatttaacgaggctcgtgctgctggctttactgaggaaactggaacccttggagatatatacgagactatctctggcagtgacttggttctgctcttgatttctgattcagctcaggctgataattatgagaaaatcttttcccacatgaagccaaacagcattcttggactttcacatgggttccttcttggtcatctgcaatcagttgggcttgatttccccaagaacataagtgtggttgctgtgtgtcccaaaggaatgggtccatctgtcaggaggttgtatgttcaaggaaaagaggtcaatggagccggaatcaatgcaagttttgctgtccatcaggatgttgatggaagagccactgatgttgcacttgcatggtcagttgctcttggctcaccctttacattcgccactacacttgagcaggagtacaggagtgatatattcggggagcgaggcattttacttggagcggtgcatgggattgtggagtctttgtttagaaggtatacagaaggtggtatgagtgaagatttggcttacaaaaacaccgtagagtgcattactggcataatatcaaagataatatcgactcagggcatgaaagctgtatacgagtcattgacagaagaaggcaaaaaggagttcttgacagcatacagtgcatcttactatccttgtatggacattctgtatgagtgctatgaggatgtggcgactggaagtgagataagaagcgttgtgttggctggccgtcgattttatgaaaaggagggtttgccagcattccctatgggtaagatcgatcagactcgaatgtggaaagtaggtgaacgtgttcgggctgcccgacctgcaggtgatttaggcccattgtatcctttcacggctggtgtctatgttgcactaatgatggcccagattgaggtgttgaggaagaaaggacattcttattctgagatcatcaatgagagcttgatcgagtcggtggattcattgaacccattcatgcatgctcgaggtgtgtcgtttatggtggataactgttcaacaactgcaagactgggatcaaggaaatgggctccccgctttgattatattcttacccaacaggctttagttgctgtagacaatgggaccccacttaaccaggacctgatcagcaacttctttgaagatccggtgcatgaagctgtcaaagtttgtgcagagttgagacccactgttgacatctctgtgcccgctgatgctgtattttgtcagacccgagttgcgtcaagctagcaacta

SEQ ID NO: 2201 - DNA, 2058 bp, Pennisetum glaucum
acccacccttcacgcagtcacgcttcaccctagaccctcccccttccctcccaaaatggcggcggccacctcctccaccacctacctcgccatcgcccgcaaaaccctaaaccccgccgcctcgggagccccaggcaccgccgccgcctccgtctccttccccaccgcgcaggccccatgccccctcgccgcctccgcggggcgccgccgcgccgtggccgcgaaggtctcgtcgccgtccgtcctcagcaccgctatgccgtcgctcgatttcgagacctccgtcttcaaaaaggagaaggtgtcccttgcgggccatgaggagtatattgtgagaggtgggagggatctgttcccactgctgccggaggcgttcaaggggatcaaacagattggtgtgatcggctggggctcgcagggtccagcacaagctcagaacttgagagactcacttgttgaggcaaagtcagacattgttgttaagattggtctccggaaaggttccaaatctttcgaagaagctcgtgcagctggattcactgaagagagtgggacactgggtgatatatgggagactgtatcaggcagtgatcttgtgttgcttctgatatcagattctgcccaggctgataactatgaggaaattttctcacacatgaagcccaacagtattcttggtttgtcacacggatttctccttggacatttgcaatccctaggccttgatttccctaaaaacatcagtgtgattgctgtctgccccaagggaatgggcccgtcagttagaaggctttatgttcagggcaaagagataaatggtgctggtatcaatgctagctttgctgttcaccaggatgttgatggaagggctacaaatgtagctttggggtggtcggttgctctaggttctcctttcacatttgttactactctagagcaggagtaccggagcgatatctttggagagcgaggtattttgcttggtgctgttcatggcatggtggaggctcttttcaggcgatacacagaacatggaatggatgaggattcagcatataagaacactgtggagagtatcactggaatcatctctaaaactatttcgaagaaggggatgcttgaagtgtacaactccttgaccgaagaaggaaagaagcagttccttgaggcttatagtgcagcatattacccatgcatggacattttgtacgagtgctatgaagatgtttcttctggaagtgagattagaagcgtagtgttggctgggaggagattttatgaaaaggaaggccttcctgcttttcccatgggtaaaattgatcaaacgcgtatgtggaaggtgggtgaaagggtgcgttcaaccaggccacaaggtgatcttggaccgttgcatcccttcactgctggagtgtatgttgcattaatgatggctcagattgaggtgcttagaaagaaaggccacagttactccgagatcatcaatgagagcctgattgaatctgtggactcattgaacccgttcatgcatgctcgtggggtagccttcatggttgataactgctccacaactgctcgcctgggatcaaggaagtgggctccgcgatttgattacatcctgactcaacaagcttttgttactattgataagaaggcaccaatcaaccaagacctcgttagcaacttcatgtctgatcctgttcatggtgccattgaagtatgtgctcagctgaggcccactgttgacatctcagtgaccgctgatgcggactttgtgcgcccagagctccgacagtcttcctaaagctcatatcgatctgcagtgcatgaacagtggttaggttttaagaagtaatatgggtgctggcgtttgaactcttaggccatgtatcgctgctgtttgagaaccagaacaataaactcttgtgtaggactgttgtgtgatggcactgaatttatattggacaagaataaaaataagtggtttgatctgaatgtatgttttgctatgcctatttcaatgtcgatgctgtggtagagctgatgtctgaaagctcgttg

SEQ ID NO: 2202 - DNA, 1903 bp, Carpinus betulus
ggtgtcggtgccggcgatcaagcccctgacttcgctcgacttcgataccaaactcttcaagaaggagaaggttaacttcgctggacacgacgagtatattgtgagaggagggagggatttgttccctttgctgccggatgcgttcaaggggattaagcagattggtgttattggctggggttcccagggacctgctcaagctcagaatttaagggattctcttgctgaagtgaaatctgatattgtggtcaagattgggctcaggaagggctcccgttcttttgctgaagctcgtgcagctggttttactgaagagaacggcactctaggtgatatatgggaaactgtgtcaggaagtgatcttgttttgctactgatttctgattctgcacaggccgataattatgagaaaatattctcccacatgaagccaaagagcatacttgggctttcccatgggtttcttcttggccatttgcagtcaacgggacttgatttccccaaggacatcagtgtgattgctgtgtgtccaaaaggaatgggtccctccgtgaggagactttatgtccaaggcaaagagataaatggagcaggaattaattccagttttgcagtccaccaggatgttgatggtagagccacagatgttgccctaggatggtcagttggtcttggttctcctttcacatttgccactacattagagcaggaatataagagtgacatctttggggagcgtggcattttacttggtgctgttcatggaattgttgaggccttgtttagaaggtacacggaaaatggaatgagtgaagatctggcttacaagaacactgttgagtgcatcacagggataatatcaaagactatctcaaccaagggcatgttggctgtatacaactccttttctgaagaggacaaaagggtatttcagactgcatatagtgcctcgtattatccctgcatggacatcctgtatgaatgctatgaagatgtggccagtggtagtgagatccgcagtgttgtcttggctgggcgtcgcttttatgaaaaggatggtctaccagctttcccaatgggtaaaattgatcagacccggatgtggaaagttggtgaacgtgtccgatcaacacggccggcaggagacctaggcccattgtatcctttcactgctggtgtttatgtggctttaatgatggcgcagattgagatattgaggaagaaagggcactcatactctgagatcattaatgaaagtgtgattgaatcggttgattccttgaatccctttatgcacgctcgtggggtttctttcatggttgataattgttcgacaacagcacgattgggatcgaggaaatgggcaccacgctttgattacatcctcactcagcaggccctagttgcagtggacaagggtgcacccatcaaccaggatctcatcagtaacttccagtcggatccggtgcacggagccattgaagcatgtgcccaactgagaccaaccgttgacatatcagtgcccccagatgcagacttcgtgaggcctgagttgcgccagtctagcaattaaggcccggctacctccagatggcatgtaaaatccttttttaaggataaggatgttcaagggtgaggacttcttaaatttaggagtagctgtagtcctttttatcaatgtagtccgcttggctgagttatgtctgtcagtgaataagacgggggcaatgcatgttctagtaattttggtgtgacgaaattattgtgggtgatgttgttggacttgattgtttgcatttcgtaaggctgtatgaaaatggatcatctatgatctaattataatgacctaaaacaacgtttggattagtttgtgttccttaatgagagtggcatgcatgttact

SEQ ID NO: 2203 - DNA, 1838 bp, Allium cepa
  misc_feature (1213)..(1213): n is a, c, g, or t
  misc_feature (1222)..(1222): n is a, c, g, or t
  misc_feature (1413)..(1413): n is a, c, g, or t
  misc_feature (1520)..(1521): n is a, c, g, or t
cccagtcttgcaaaaaatggcggctgcaatcaacacccattcctcttcttcaatcatctctctttccactaacagaagtctagctaagccactatctacctacaacttagctttcagttgcgtacccagaaccctagcccgacatatccgatccaatggaggaagatcttctgttggtgcctgcatggttcaatcggcaccgttagttggccagtatcctgaacttgatttcgataccagcgtttttaagaaagagaagatcactctttctggccatgacgagtatatcgtaagaggaggaagagatttgtttcatttgttgccggatgccttcaaagggataaaacaaattggagttataggttggggctctcagggtccagcccaagcacaaaatctcagagactcacttgtcgaggccaggtcagacatcgtagtcaagattggattgaggaagggttcacgctcatttgaagaagcacgtgctgtcggttttactgaagaaagtggaacattgggtgaaatatgggaaactgtctccaccagtgatcttgtattgttattaatctcagatgctgcacaggcagataactatgaaaaagtgttttcacacatgaaaccaaatagtattctaggcctctcgcatggttttcttctagggcacttgcagtctcttggtcttgattttccgaagaacatcagtgttgttgctgtttgccctaagggtatgggcccatcagtaaggaggctctatgttcaaggcaaggaagtcaatggtgctgggatcaatgctagctttgctgttcatcaggatgttgatggccgagctacagatgttgctctaggatggtctgttgctttaggatcgccattcacttttgctaccacgttagaacaagaatacaaaagtgacatctttggcgagcgaggtattttgcttggtgctgttcatggtatcgtggaatccttgttcagacgatatacagagaatggaatgagtgaagagctagcctacaagaacactgtggagtgcatcactggtacaatgtcaaagaccatttctactaagggcatgctttctgtctacaattcattgtctgaggaggggaagaaagagttcaatgctgcatacagttcttcatactatccttgcatggatatattatatgaatgttacgaggatgtcgctagtggaagcgagattagaagtgtngtcttggcnggtagaagattccaagaaaaggaggggcttccagcttttccaatgggtaaaattgatcagacaagaatgtggaaagttggtgaaaaagttcgtgctgtgaggcctaagggtgatttgggaccgctgcatcccttcacggctggcgtatttgtagctttaatgatggctcagattgagttctgcgaaagaanggtcattcatactcagagatcataaatgaaagcgtgatagaagcagtcgactccttgaatcattcatgcatgcgcgtggcgtctcgttcatggtcgaaactgctccnncaccgctaggtaggatccagaaagtgggctcctcgatttgattacatactcatgcagcaagcctatgttgctgtcgataatgcttctcctgttaaccaggatcttataagcagcttcctgtctgaccccgtacatggtgcgatagaggtctgcgcccggctgaggccttctgttgatatttctgtgccggtcgatgctgatttcgtgcgccctgagcttcgtcaagctttgaaattgatgttttctgttgtattttgttatatagttaataatgactttatgtccgagttaaagtattatgaagtgttatttgtagt

SEQ ID NO: 2204 - DNA, 1931 bp, Manihot esculenta
aaataccaatctctgtcatttgctgacagtaacgcttcctcttcacctctagcgagctccctcttctcggccttggattttcgtcggcacaactaatggctgccgcgacggcgttctccggtactctttccagccatacgccgtctttaatttctcttgattttgattcctctgtctttaagaaggagaagatctccctcgctggtcatgacgagtacattgtgagaggaggtagggatttattctacttgctgccagatgcattcaagggaatcaagcagattggcgttattggttgggggtctcagggtcctgcccaagctcagaatttaagggattccctaacggatgccaagtctgatattgtagtgaagatcggacttaggaaggggtctcattcattcgctgaagctcgtgctgctggttttactgaagagaatgggacgctaggtgatatatgggaaactatttcaggcagtgaccttgtcatgttactgatatctgattctgcacaggctgataactatgagaaaattttctcccatatgaagccaaacagcatacttgggctttcccatggatttcttcttggacatttgcagtcaatgggacttgacttcccaaaaaacattagtgtggttgctgtttgtcccaagggaatgggtccatctgtaaggagactttatgttcaaggcaaagaggtcaatggtgcaggaataaattctagttttgcagtccaccaggatgttgatggtagggccacagatattgccttgggatggtcagtagcccttggttctcctttcacttttgccactacactggagcaagagtacaaaagtgacatctttggggagcgtggcattttactgggtgctgtacatggaattgttgagtccttgtttagacgatacactgaaaatggaatgagtgaagaggaagcttacaagaacactgttgagtgcataacaggaattatatcaaagaccatttcaaccaagggtatgttggctgtatataattccttgtctgaagaaggtaaaaaggaatttgagattgcatatggtgcttcatattatccctgcatggatatcttgtatgagtgctatgaagatgttgcttgtggaaatgagatacgcagcgttgtccttgccggccgtcgcatttatgaaaaagatgggctaccagccttcccaatgggtaaaattgatcaaacacgcatgtggaaggttggcgagcgagtccgatcagttagacaagcaggggacttaggtccattataccctttcactgcaggagtctacgtggcattgatgatggcacagattgaaatcttaaggaagaaagggcactcatattctgagatcatcaatgaaagtgtgattgaatccgtggattctttaaatccatttatgcacgctcgtggagtttctttcatggtagacaactgctcaacaacagcaagattgggatccaggaaatgggcccctcgttttgattatatccttacccaacaagctttggtagctgtggacaatgacagtcctgtgaatcgcgatctcattagcaacttcctatcagatccggtgcatggagccattgaagtttgtgctcaactgagacctacagtagacatttcagtgccaccagatgctgactttgtgagacctgagttgcgccaatctaccaattgagatctaaaggtgaatttctagtttgaatcggctacgagaaatcgctacacatataagctgaggacgaagcttttcctggattgtaagcatgctctagtttttatcaacttaaatattttgtgttgtatgtagtattatgatcgttctcttttttccttttgtttttttcctccttttgtgtgtatggacagggcttttattcttgtattggtaacgttggcagtagaattttagcct

SEQ ID NO: 2205 - DNA, 2160 bp, Elaeis guineensis
ccgactccttccaacgcccttccttcccactcgccgcccgcttaccccacgcaaacccgtaacccggccccaaacctagcttgggttgggattctcgtcgtcgtcctccagatccctgaggcttctcctctcccggatgcacatggatgcggccgcggcagggcggggtggcgccgccgccctcggagctcgaatggtctccgtgccatccatcagcaagcccgctccctctcttgacttcgagacctccgtctttaagaaggagaagatcaccctcgccggtcaaaatgagtatattgttagaggtgggagggatttattccatttgttgccagatgccttcaaggggatcaagcaaattggcgtgattggttggggatcccagggtcctgcccaagcacagaacttgagggattcacttgcagaggcacaatcagacattgtggtcaagattggtctgagaaaaggttctcgttcctttgaggaagcacgtgctgctgggtttactgaagaaaatggaaccttgggtgatatctgggagacaatttcaggcagtgaccttgtcttgttgctgatttcggattctgcacaggcagacaactacgagaaagtattctctcacatgaaaccaaacagcattctggggctgtctcatggttttcttcttgggcatttgcaatcccttggccttgatttccccaaaaacatcagcgtgattgctgtatgtcctaaggggatgggtccatcagtgagaaggttgtatgttcagggaaaagagataaatggtgcaggaatcaattccagttttgctgtccatcaggatgttgatggcagggccacagatgttgctctggggtggtcagttgctctaggatctccttttacatttgccactactttagagcaggagtacaagagtgacatttttggggagcgtggtattttgcttggtgctgtgcatggaattgtggaggccttgtttagaaggtacactgagaatggaatgagtgaagaaatggcttataaaaacacagttgagtgcatcacaggaattatgtcaaagaccatttcaacaaagggtatgctctctgtatacaactctctgactgaagaagagaaaaaggaatttaatgctgcatatagtgcatcatactatccttgcatggatatcttgtatgagtgttatgaggatgttgcctgtggcagtgaaatttgcagtgttgttttagctggacgacgcttttatgaaaaggaagggcttcctgctttcccaatgggtaaaatcgatcagacacgaatgtggaaagttggtgagcgagtccgtgcggctcgacctgagggtgacttgggccccttgcacccgtttactgctggggtttatgtggctctaatgatggctcagattgaggtcctaagaaagaagggacattcttactcagagatcattaatgagagtgtgatcgagtcagtggattccctaaatcctttcatgcatgctcgcggggtgtcattcatggtggacaactgttccacaaccgcgcgcctggggtcaagaaagtgggctccgcgttttgattatatccttactcagcaagcattagtagctgtcgacaagaacgctcctatcaatcaggacctactcagcaacttcttttccgatccagtgcatggtgctattgaagtctgtgcagagttgaggccaactgttgatatatctgtgccacctgatgcagattttgtgcgtccagaattgcgacaaactggcaattgagaaatggcaatagattttgatagatagcctacagccattgtgatattttgagagggtaatcttagcatgaaagctctttaaacatctaggttgtatgtgcatgcgaacattgtgcggtctctgagtgcgtagtgtctgaataaattggtgcgtggctgggcatcagttgtgtgtacgttgcacttgtttgacggtaattgagtaatccctgggagtcgtttgtagctttctgagatcttccccttttttttttgttgtgtgtgtgtgtgtgtgttttgccttgatgataactctcagttttagatgcaaatcacgcttgctgtattggtgcatagctgggcatccagctatggaatattgaaccaatccatgttctcaaagaaactgtt

SEQ ID NO: 2206 - DNA, 2311 bp, Ricinus communis
aacaaactcatactccctcttttaaacaacgcaagtcttactcacctgcttatttcccatttcgagcgccacacagcacacttcctccaaactctcaacaatggccgccgcctcctccgtcgctaccactgccaagtcagcactctccacgccatcactctcaccgtcatcatcacttaaacataacccctcaagatccactttagggtttatatccacatcatcgccaaccttaaagtcgctggtttctcgtgttcatactaaacaaaatgtcccgctaaatcaaagatcatcatcgctttcagttaaaatggtttcaagtccttctattgctcctacgacgtcgcttgattttgacacctctgttttcaagaaagaaaagatcactttagctggtcatgatgaatatattgtgagaggagggagagacttgtttcctttgttgcctgatgcttttaaagggattaagcagattggtgtcattggctggggatctcaggggccagctcaagctcagaatttgagggattctcttgctgatgcaaaatctgatattgttgtaaagattgggctgaggaagggctcccgctcttttgccgaagctcgtgctgcagggttcactgaggagaacggaactttgggggacatatgggaaaccattgctggcagtgatcttgtcttgttattgatttctgatgctgcacaggcagataacaatgaaaagatattctcccacatgaaaccaaacagcatccttgggctttcccatggttttcttctgggacatttacaatctttggggcttgactttcctaagaacataagtgttattgctgtttgccccaaggggatggggccttctgtaaggaggctttatgttcagggaaaagaaataaatggagccggaattaattccagttttgctgtccaccaggatgttgatggtagagctacagatgttgccttgggatggtcagttgctctggggtctccatttacatttgccaccacactggagcaggagtataggagtgacatttttggggagcgtggcatactacttggtgctgttcatggagttgttgagtgcttattcagaaggtacactgagagtggaatgagtgaagatttagcttacaagaatactgttgaatgcattacaggaattgtatcaaaaaccatttcaactaagggcatgttggctgtttacaatgcattgtcagaagagggcaaaagggactttgagactgcatatagtgcttcctactatccttgcatggacatcctttatgagtgttatgaggacgttgctagtggtagtgagattagaagtgttgttttggctgggcgtcgattctatgaaaaagagggtttaccagctttcccgatgggtaagattgatcaaacacgaatgtggaaagtgggtgagcgtgttcgagcagtaagacccaatggtgacttgggtcctttgtatcccttcactgctggagtgtttgtagcactaatgatggctcagattgaggtcttgaggaagaaggggcactcgtattctgagatcatcaatgagagtttgattgaagctgtggattcactgaatccgttcatgcatgctagaggtgtctcgttcatggttgataactgttcaaccactgcccgattaggatcaagaaaatgggcgccacgctttgattacattcttacccaacaagcctttgtagctgtggatgcaggcacttccatcaatcaggaccttattagcaacttcatgtcagatcctgttcatggggctattgaagtatgtgctcagttgaggccaactgttgatatttcagtgcctccagatgcagattttgttcgcccagagttgcgccaatctggaaactagatatgaagaagttgagcattactaggatgcatttgattaagatgtttcgaggatggaagatttcgtaggagttgagttactagaatgtttctagtcgaagctttaggtcctacgtggagtgtagtttactgagtaatggtgttctttttttgttttatttaaaagccttaggtttgatctctttttgttgagtgttgcagagacatcatatgccccgtatccaaatttaggtcgagtctgtttaagaacaattcttcatcttctcgcctttagctgccatgttacagatcaactgcatatgtttatgaatttactcttttacgaacttctctcttgtcttctcacctgtagccaccgttttgcagaccaactgcatatgtttatgaatgtactctctttgtcaaataaagcagctgtttagtcatt

SEQ ID NO: 2207 - DNA, 2440 bp, Cirsium arvense
gtagggtttctgtcttcgcagccttcctcgaaatccctcagagctcgcgcctttccctcctccaatggcgcttctggatctgctcttggtgctcgtatggtttccgtctccccaataaccaagtctccaacgtttcttgattttgaaacctctgttttcaaaaaggagaagattaaccttgctggttatgatgagtatattgtgagaggaggaagagatttgttccatttgttgcctgatgccttcaaaggtatcaagcagattggtgtcattggatggggttctcagggtccagctcaagctcaaaaccttagggattctcttgtagaagcaaaatctgatattgttgtgaagattgggttacgaaagggttcgagttcatttaacgaggctcgtgctgctggcttctctgaagaaaatggaactcttggtgatatctatgagactatctctggcagtgacttggtcctgctcttaatatctgattcagctcaggctgataattatgagaaaatcttctcccacatgaagccaaacagcatacttggactttcccatggattccttcttggacatctgcaatcagttggccttgatttccccaagaacataagcgtggttgccgtgtgtcccaaaggaatgggtccatcagtgaggaggttgtatgtccaaggaaaggagatcaacggagctgggatcaatgcaagttttggtgtccatcaggatgttgatggaagagccaccgatgttgcacttggatggtcagttgctcttggttcaccctttacatttgccaccacactggagcaggagtacaagagcgatatatttggggagcgaggtattttacttggtgcggtgcatggtatcgtggagtctttgtttagaaggtacactgaaggtggtatgagcgaagatttggcttacaaaaataccgtagagtgcataactgggacaatctcaaggacaatatcaactcaggggatgaaggctgtatacgagtctttgacagaagaaggcaagaaagagtttttgacagcatacagcgcctcctactatccttgcatggacattctgtacgagtgctatgaggatgttgccagtggcagcgagataagaagtgttgtcttggctggtcgtcgattttatgaaaaggagggtctacccgccttccctatgggcaagattgatcagacccggatgtggaaagtcggtgagcgggttcgtgctagccgaccagcgggtgatctaggcccattgtatcctttcacagctggtgtctatgtggcattaatgatggcccagatcgaggtgttgaggaagaaaggacattcttattctgagatcatcaatgaaagtttgatcgagtctgtggattcgttgaacccgttcatgcatgctcgaggtgtgtcgtttatggtggacaactgttcaacaactgcaaggttgggatcaaggaaatgggctccacgattcgattacattcttacccaacaggctttagttgcggttgacaacggcaccccgcttaaccaggacctgatcagcaacttctttgaagatccagtgcacgaggctgtgaaagtttgtgctgagttgagaccaacggtcgacatctctgtgcccgctgatgctgatttcgtgagaccggagttgcgtcaagctagcaagtagaggtggtgaagaaacctgttttctttctgaaacactctgtgagagcgattgagggcctagtgagtccagtttacaatggtggtatctgtaagatgtggttatggatgttgaatttggtgtttcttttttctaacaaagtttgcactcttattcctttttattaccaaattaacaaatcctagttacaaccggggtataaggaactacgtcataataactaacaacaacgtacgtaaattcgaataaaaattattcgaaaaacagtaaacaaactccgagggcaaacacaatacacaaatatatctaagtactcatttccacattttgtggtttccgtacttgcctccatgcttcccaaacttcccatgcttgaacttaccatggtgttgcccataaccaccatagccatgggaaccatgaccataggaaccatgaccatgggatccatacccaggagacacatgatgagctccaaatgcagcagccccaagtgctgcaccaccagctaaaaatcccataccattgcctccatatcctgaatgatgatgatatggagcagttgaaccaggataggctgtggggggataaccagcagtggcttgtggtggatatccaccatatggaggataagtggcttgagggtatccaccagaaggataaccataaccttgaggaggatatgttccatgttgttgtggaggataatgtccaccaccatatccaccaatatgagaatacagtcctttctccccattatacccactac

SEQ ID NO: 2208 - DNA, 1815 bp, Avena sativa
ccgctcgcgcagtcaccctagtcctcgactcctcgcatcgcaaatggcggcggcgacttcctccgcttcctccctcgccttctcccatcccaagaccctaaaccccgccccccaaaccccagccgtcggttccgtatccttccccgcagctaagaccccatgccacctcgccgcctccgccggccgtcgcggcgccgtagccgccaaggttgcgtcgccgtcggtgatcagtaccaccatgccgtcgctcgatttcgatacctccgtcttcaagaaggagaaggtgtccttggccggccatgaagagtttattgtcaggggtgggaggaatcttttcccgctgcttccagaggcgttcaaggggatcaagcagattggcgtgcttggatggggttcgcagggtccagcacaagctcagaacttgagagactcacttgctgaggctaacttggacattgttgttaagattggtcttcggaaaggttccaaatctttccaagaagcacgtgcagctggtttcactgaagaaactgggaccttgggagatatatgggagactgtctcgagcagtgaccttcttttgttgctgatatcagattctgcccaggcagacaactatgagaaaatcttctcacacatgaagcccaacagtatccttggtttgtcacacggatttctccttggacatctgcaatcagttggccttgatttcccaaaaaacatcagtgtgatcgctgtatgtcccaagggaatgggcccatcagttagaagactttatgttcagggtaaagagatcaacggtgctggtatcaactctagctttgctgttcaccaggatgttgatggaagggctacggatgttgctctagggtggtcaattgctctaggctcacctttcacatttgctactactctagagcaggagtaccgaagtgatatcttcggcgagcgaggtattttgcttggcgctgttcatggcattgtggaggctcttttcagaagatacacagaacaaggaatggatgaggacttggcatataagaacactgtagagtgcattactggaattgtctcaaaaactatttcaaagaagggaatgctggaagtttacaactctttaacagaagaaggaaagaagcagtttaacgaggcatatagcgcagcttattacccaagcatggacatactatacgagtgctacgaagatgtttcttctggaagtgaaattagaagtgttgtgctggctgggaggagattttatgaaaaggaaggcctccctgcttttcctatgggcaacattgatcaaacacgtatgtggaaggtgggtgaaagggtgcgttccacccggccgcaaggtgatcttggcccattacatccattcacctctggagtgtttgttgcaatgatgatggctcagatcgaggtcctcagaaagaagggccactcgtattcagagatcatcaacgagagtgtgatcgagtctgtcgactccctgaacccattcatgcatgctcgaggggtggcattcatggttgataactgctccacgacagcccgcttagggtcaaggaagtgggctccgcgctttgactatgtcctgacccaacaagcttttgtgactgtcgacaagaaagcaccaattaatcaagatcttatcagcaattttatgtctgacccggttcatggtgccattgaagtctgtgctgagttgaggcccaccgttgacatctcagtgactgctgatgctgattttgtgcgcccagaactgcgacattcttcctgaagtttgtgttgatcgctggcacatccaagttt

SEQ ID NO: 2209 - DNA, 3638 bp, Brachypodium distachyon
gtggtgatagcgaaacctggcctacctttacgagattgattaataaagtgatgagcacgcctctagcggcaactcaaacgacagagccgcgagaggcagcaggcggcgttaaagaatgacgcgagagctcgcggatctccatgcgccgctgctgtagctagctgcaaacgctgccaaaaaagatactgcaccagaagaaaagaaacagtttgcgtgctgcgcggcagaggggcgcgcgccacggcagctccggtgcacgtgacccggcgggagcgaatcgaatcgcagccgtccaagtcgcggcgcatcggacggcggtggtagtcgtataaatccatccaggccgccccgcgagcggaaagcccattgctaccaaccaccgccgtgaacagcagcagcacagcagagcgcagacccagcagcgacaacacaatggcggcctcaaccatctccttctcccaccccaaaaccctagccgccgccgcggctgtgcccaaaacgctgccgatccccaccgcctcctccgtcgccttccccgcctcgcacccggcatgggtcctctccgccgcccgccgacgcgcggtcgcggccatggtcgcggcaccgacgacgacggcttccgtgggcgccgccatgccctcgctcgacttcgacacctccgtgttcaacaaggagaaggtctccctcgccggccatgaggagtatatcgtgaggggtgggaggaacctctttccgctgctccacgaggccttcaagggcgtcaagcagatcggagtcatcggatggggctcccagggtccagcacaagctcagaatctgagagattccctagctgaagcaaagtctgacattgttgttaagattggtctccggaaaggttctaaatcttttgaggaagcacgtggagctggattctctgaagagaatggaaccctgggagatatatgggagacgatttcaggcagtgatcttgtgttgctgctcatatctgattctgcacaggcagacaactatgagaaaatattctctcacatgaaaccgaacagtattcttggtttatcacatggatttctccttggacatttgcaatcacatggccttgatttccccaaaaacatcagtgttgttgctgtatgtccaaagggaatgggcccatcagtccgaagactttatgttcagggcaaggaagtaaatggggctggcatcaacgctagctttgctgttcaccaggatgttgatggaagggctactgatgttgctctaggatggtcagttgcactgggatctcctttcacatttgctactactttagaacaggagtacaagagtgacatcttcggggagcgaggaattttgctgggtgctgtccatggcatcgtggaggctttgtttaggagatacactgagcaagggatggatgaggccttgacatacaaaagtactgtagagggcatcaccggaattatatcaaaaactatctcaaagaaggggatgcttgaagtgtacaactccttgagtgaggaaggcaaaaaggagttcaacaaggcgtacagtgcatcattttatccttgcatggatatactttatgaatgctatgaagatgttgcctccggaagtgaaatccggagtgttgtgttggcagggcggaggttctatgataaggaaggtcttcctgctttccctatgggaaaaattgaccaaactcgtatgtggaaggttggtgagaaggtgcgcttgacccgcccagatggtgaccttggcccacttcaccccttcacggctggagtttatgttgcactcatgatggcccagatcgaggtcctaagaaagaagggtcactcttactcagagatcattaacgagagcgtcattgagtctgtggactccctgaacccgttcatgcacgcccgtggagtggccttcatggtcgacaactgctccaccactgcacgcctgggatcaaggaagtgggcaccacgctttgactacatcctgacccagcaagccttcgtgacggtggacaaggatgccccgatcaaccaggacctcatcagcaacttcatgtcagaccctgtccatggtgccatcgaagtctgtgccgagctgaggccgaccgtcgatatctcggtgaccgccgacgctgatttcgtgcgcccggagctccggcaatcttcatagatcagtcatttgtgtcggcctgggcagatgagtgtttttgatggattgactgtgtgtgtgcacctgtttgaacttgtgagctgctgtcggatttgggttggactaccgttccagaataaagttagttcccccgggccccggtgatgctgtgtttgtgcagcatttgccggaccatgtaatgtaggtcaaactgatcatccagctcagtcataacaaaatcttgtactccctctaacaaaagatgtctcaagtttgtcaaaatttggttgtatctagacatgacttagtgtatagatgcattcaaatttagtcaaaattgaaacattttttgttggacggtggcgatggatcattttagaggcgacgccctggagcaatgtgagttcgttcaacttcaacgaagccagccagcctgcagggcaactgcatcagctttttatcctctaggggcaaaaataacgcgggcatctccaaggccatatcaatggcatcagtctgttcttgtccgtggacaaagaaaaccaacccaatcggggctcgctaaatcaaagctggtgtgcatttgtccccagacatgttatactcaaattaaaatttgcattgtttggcaagtctggatattgtccacataaaacatactggcacaaaataaaggttcacacatgtcagatggacagatgacgttcatttgacatgtatccgttggatcaggacatctccaagggtaaaatgccaaatgaacatgtgtccggacaatatggcatgtggataactataacttcacccaacggatacatgttaaatggacaggccgacatgttaatactgagtcaataactatggtatctcggcactaataccaatttggatgtgccgaggaaccattaacgtctacttttaacatttagaggacgaaaattacatggaaaaaattaaaggaccgagtgcgtatgttttgtcaaatcggaaaacaaaaaatatacttttctctatttttatccatgacgcatcgatcaatctcagccgctccgcttcgcgtcggagtggccgcttgccttgcgaccaccggtactaccggagctccctcctctccccgtgccagcagcggccctccgatcaccagcttggtcctgctccggtgcggcggcggcggcggagcccctgcctgtgagccgctgcacgacggacttgaagtcctcggcggtgccggcctccacgaacaccgtctcgatgatcttcaccgtcgtcgcgggcttctttttcttcccttcttcctcctcccccgacatcgaatgtgtgaactcagaggtagaagaaatgcaagcaacaggaacaagaacaacaatgaggagagggaggtggcagtaataagtagctgaagagccgtcacgtaccggcgggaaatttgaccgccgagatgctgacggagtcgtgcaatctacaactttgaactcttctaa

SEQ ID NO: 2210 - DNA, 1835 bp, Flaveria ramosissima
tcgacgacggcgacggcgacaaccaccttctcaacattaacacccaccacctcatcgtcaacagctgcaccatctctaaaagttgactcccaaaaccctagggtttaacgtcggattactctcctccaaaacaacattcaaatcactcaaagctcgatccaatggcggatccggatccgctctcggagcccgtatggtctcagctccatcaataacccgacccacgcttctcgatttcgaaacctctgtgttcaaaaaggagaagattaaccttgctggtcatgatgagtatattgtgagaggaggaagagatttgttccatttgttgcctgatgcctttaaaggtatcaagcagattggtgttatcggttggggctctcagggtcctgctcaagctcaaaaccttagggattctcttgcagaagcaaaatctgacattgtagtgaagattggtttacgaaagggatcgagttcgtttaatgaggctcgtgctgctggctttactgaagaaactggtactcttggagatatttatgagaccatctcgggaagtgacttggtcctgctcttaatttcagattcagctcaggctgataactatgagaaaatcttttcacacatgaagccaaacagcatacttggattgtcccatgggtttcttcttggtcatctgcaatcagctggtcttgatttccccaagaacataagtgtggttgctgtgtgccccaaaggaatgggtccatctgtcaggaggctgtatgttcaaggaaaagaagtaaatggagctgggatcaatgcaagttttgctgtccatcaggatgttgatggaagagccactgatgttgcccttggatggtctgttgctctcggttcaccctttacattcgccactacacttgagcaagaatacaggagtgatatatttggcgagcgaggtattttacttggtgcggtgcatggtatcgtggagtcattgtttagaaggtataccgaaggtggtatgagtgaagaattggcttacaaaaatactgtagagtgcataactggcataatatcaaagaccatatcaactcagggtatgaaggctgtatacgagtcattgtcagaagaaggcaaaaaagagttcttgacagcatacagtgcctcttactatccttgtatggatattttgtatgagtgctatgaggatgtagcaagtggtagtgaaattagaagtgttgttttggctggtcgtcgattttatgaaaaggagggtttgccagctttccctatgggaaagattgatcagactcggatgtggaaagtaggcgaacaggttcgggctgtccgacccgctggtgatttaggtccgttgtatcctttcacagctggtgtatatgttgcactaatgatggcccagattgaggtgttgaggaagaaaggacattcttattctgagatcatcaatgaaagtttgatcgagtctgtggattccctaaacccgttcatgcatgctcgaggcgtctcctttatggttgacaactgttcaactactgcacggttgggatcaaggaaatgggcgccacgctttgattacattcttacccaacaggctttagttgccgtagacaatggagccccactaaaccaagacctcatcagcaacttctttgaagacccggtgcatgaagctgtcaaagtttgtgcagagttgagacccactgttgacatctcggtgcctgctgatgctgattttgtcagacccgagttgcgtcaatctagcaactagagatagtggtaagttcatacctcggtatgatctttaccttagttttcaaacaatgcaggaattatgt

SEQ ID NO: 2211 - DNA, 1863 bp, Artemisia annua
gcagccacttcccatactccactcactcactctctctctttccatcataaaacactttttcctgtcagtcagtcaatcatggcggccgccgcacctacttccatcaccatcacaccaaccaccaccgccacctcctcaacgtcatccaacaaaacacccattaaaaaagtagctttcagtaccccgtttacatcatctgttaagtcactacaagcagcacgtgttgtgacacgtgggtcttgtgctcttggtgctagcatggtggcggcgccggttgttagtagtgggacagaaccggttttgttggattttgaaacgagtgtttttaagaaggagaaagttaaccttgctggtcatgatgagtacattgtgagaggaggaagggatctgtttcatttgttgcctgaggcattcaaaggtatcaagcagattggagtgatcggttggggatctcagggtcctgctcaagctcagaatttaagggattctcttgcagaagcaaaatctgatattgtcgtcaagattggcttaaggaagggttcagcttcttttgctgaggctcgtgctgcaggttttacagaagaaaatgggactcttggagatatttatcccactattgcgggcagtgacttggtcctgctcctaatatctgattcagctcaggctgataattatgagaagatcttttcccacatgaagccaaacagcatacttggactttcccatggtttccttcttggtcatttgcaatcaatcggtcttgactttcctaaaaacatcagtgtggttgctgtatgtcccaaagggatgggaccgtcagttaggaggttgtacgttcaaggaaaggaggtcaatggagccgggatcaatgcaagttttggagtacatcaggatgttgatggcagagccactgatgtggccctcggatggtcagttgctcttggttcaccatttacatttgcaactacactagagcaggagtacaagagtgacatatttggggaacgaggtattttgcttggtgctgtgcatggtattgtggagtcattattcagaaggtacacagaacacggtatgtccgaagagttggcttacaagaacactgttgaatgcataaccggagtcatatcaaagaccatatcgactaagggtatgaaggccgtttatgagtcactttcagaagaaggtaaaaaggatttcttgacagcatacagtgcttcgtattatccctgtatggaaatcttgtacgagtgttatgaggatgtggcaagtggcagtgagattaggagtgttgtcttggctggtcgtcgcttttatgaaaaagagggtcttcccgccttcccaatgggaaaaattgatcaaaccagaatgtggaaagttggtgagcgtgtccgtgctagccgaccagctggtgatttaggtccattgtatcctttcacagccggtgtctacgtggcactaatgatggcccagattgaagtattgaggcagaaaggacactcgtactctgaaatcatcaacgaaagtttaatagaatctgtagattcattaaacccattcatgcatgctcgaggtgtttcattcatggttgacaactgttcaacgactgcaaggttgggatcaaggaaatgggctccacgttttgactacaatcttacacaacaagctttggttgatgtagacaatggcgcaccaatcaaccaggatctcgtgaaaaagttctttgaagatccagtgcatgaagctgttagagtgtgtgctgagttgagacctactgttgatatctcggtgcctgctgatgctgactttgtgagacccgagttgcgtcaatctagcaactaaatggcatgaatgaatttattt

SEQ ID NO: 2212 - DNA, 2082 bp, Elaeis guineensis
caaatccgggaggcttctcctttcccggatccacttggatgcaactgttggcggacgaggcggcgccgccgcccttggcgctcggatggtctccgtgccgtccgtcagcaagtctgcgccctctctcgacttcgagacgtccgtatttaagaaggagaagatcaacctcgccggtcaagatgagtatattgtaagaggtgggagggatttgttccatttgttgccggatgctttcagggggatcaagcagattggcgtaattggatggggatcccagggtcctgcccaagcacagaacttgagggactcgcttgctgtggcacagtcggacattgtggtcaagattggcctgaggaaaggttctcgttcctttgaggaagcacgtgctgctgggtttactgaagaaaatggaaccttgggtgatatctgggaaacaatttcaggcagtgaccttgtgttgctgctgatttcagattctgcacaggcggacaactacgagaaagtattctcacacatgaaaccaaacagcattctggggttgtctcatggttttcttcttgggcatttgcaatcccttggccttgatttccccaaaaacatcagcgtgattgctgtatgccctaaagggatgggcccatcagtgagaaggttgtatgttcaaggaaaagagataaatggtgcaggaatcaattctagttttgctgtacatcaggatgttgatggcagggctacagatgttgctttggggtggtcagttgctctgggatctccttttacattcgccactactttagagcaggaatacaagagtgacatttttggggagcggggtattttgcttggtgctgtgcatggaattgtggaggccttgttcagaaggtacacagagagtggaatgagtgaagaactggcttataaaaacaccgttgaatgcatcacgggaatcatatcaaggaccatttcaacaaagggcatgctctccgtctacagctctttgaccgaagaagggaaaaaggaatttagtgctgcatatagtgcatcatactatccctgcatggatatcttgtatgagtgctatgaagatgttgcatgtggcagtgaaattcgcagtgttgttttagctgggcgacgcttttacgaaaaggaagggcttcctgccttcccaatgggtaaaattgatcagacacggatgtggaaagttggtgaaagagtccgtgcaactcgacctgagggcaacttgggtcccttgcaccctttcactgctggggtttatgtggctctaatgatggctcagattgaggtcctaagaaagaagggacattcttattcagagatcattaacgaaagtgtgatcgagtcagtggattccctaaatcctttcatgcatgctcgtggggtgtcgtttatggtggacaactgttccacaactgcacgcttgggatcaagaaagtgggctccacgtttcgattatatcctcacccagcaagcatttgtagctgtcgacaagaacacacctatcaatcaggacctgctcagcaacttcttgtctgatccagttcatggtgctattgaagtctgcgcagagttgaggcctaccgtcgatatatccgtgcctccagatgcagattttgtgcgaccggaattgcgacaaactagcacttgagatatggcaagagattttgatggatagtccactgctggtgagatattttaagaggttaatatgaggattctagttctttaaatgtctaggttgcatgcgtatcggaacattgtggagtctgatgtagtgtctctgaatatatgttggtgcatagctgcgcgtcagttgtgctccttgctcttgtttgactgtgattgaggaattcctggtgttcgtttgtagcttaatgaggatttttctctcagtttcacttgctctttcttgtgcatttttggagttgagaggtgtctatgcggagaagactcttctaaatgtgtgaccaatccacttctgatgttgtagcttttcttgtgatctcctatgcatgaactaaatctgtcatctccacggaacaagcggaacagcttggaatgctcttg

SEQ ID NO: 2213 - DNA, 1989 bp, Gossypium raimondii
ctaccatcattggcggttacttactttactctctctctcaaagctttaattttggtttcttcacgtccattttcagatcctttgagtcctctcattccaaccccactcactactcataattgctgcggctcagctatggcctctcaaacctacatctctctcgatttccacacttgtgtcttcaagaaagagaaagtctccctcgctggtcaccacgagtacattgtgagaggaggaagagatttgtttacgttgctgcctgatgctttcaaagggattaagcagattggtgttattggttggggctcccagggacctgctcaagctcaaaatttaagggattctcttgctgatgcaaaatctaatatcattgtcaaggttggactcaggaagggttctccttcttttgccgaagctcgcgctgctgggttctctgaagaaaatggcactttgggtgatatgtgggaaactatttctggaagtgatcttgtattactcttaatttctgatgctgcacaggctgacaatcatgagaagatattctcccacatgaaaccaaatagcatccttgggctttcccatggctttcttcttggacacttgcaatcaatgggacttgatttcccaaagaacattagtgtaattgctgtgtgtcctaaaggaatgggtccatctgtaaggagactttatgttcaaggcaaagagatcaacggtgctggaatcaattctagttttggagtccatcaggactttgatggtagagctactgatgttgccttggggtggtcggttgcccttggatcacctttcacctttgttactactttagaacaggagtacaagagtgacatattcggggagcggggcattcttctcggtgctgttcatggaattgtggagtgtttgtttagaagatacactgaaaacggaatgagcgaggatcttgcttacaaaaacactgttgaatgcattacaggaattatatcaaagaccatctcaacaaagggcatcttggctgtgtacaattccttgtccgaagagggaaaaagggaattcgagattgcctatagtgcatcttatcacccatgcatggatatactgtatgagtgttatgaagatgtagctagtggaagtgaaatccgtagtgttgtattggctgcgcaacgattttatgagaaggatggtctccctgctttccctatgggaaaaattgatcaaacacgcatgtggaaagtcggtgagcgagtccgaaaggcacgtccatctggtgatttagggccattgtatccatttactgccggtgtctatgtggccttgatgatggctcagatcgagatattgaggaagaaagggcactcgtactctgagatcatcaacgagagtgtgatagaggcagtggattcgttaaatccatttatgcatgctcgtggagtttctttcatggttgacaattgctctacaacagcacgattgggatccaggaaatgggcccctcggttcgattacatcctaacccaacaggctttggtggctgtcgataatggcactcccatcaaccaggatctgcttagcaacttcttgtcagacccagtgcatggtgctatcgaagtttgtgctcaaatgaggccaacggttgacatttcagtgcaccctgatgctgattttgtgcgaccagagttgcgtcaatctggcaattgagtaggtggaatcttggaacttgagtgggcagctatagtgtgtttaagccaaaactttcacctcgtttataaatgagtgatgtagttttagctatgtctttagggtgtttgaacactaatggcactagattccctttttttttttcttccttatcagcctcttctttgatatgactcctttggatttactcttgagaatgcttttggtgatgaatcttttagactgctttttgaaagttttgttgaagttatatatgagtaagcaaaacagtttattgttggagatcttcaa

SEQ ID NO: 2214 - DNA, 1926 bp, Elaeis guineensis
gccgccctcggagctcgaatggtctccgtgccatccatcagcaagcccgctccctctcttgacttcgagacctccgccttaagaaggagaagatcaccctcgctggtcaaaatgagtatattgttagaggtgggagggatttattccatttgttgccagatgccttcaaggggatcaagcaaattggcgtgattggttggggatcccagggtcctgcccaagcacagaacttgagggattcacttgcagaggcacaatcagacattgtggtcaagattggtctgagaaaaggttctcgttcctttgaggaagcacgtgctgctgggtttactgaagaaaatggaaccttgggtgatatctgggagacaatttcaggcagtgaccttgtcttgttgctgatttcggattctgcacaggcagacaactacgagaaagtattctctcacatgaaaccaaacagcattctggggctgtctcatggttttcttcttgggcatttgcaatcccttcgccttgatttccccaaaaacatcagcgtgattgctgtatgtcctaaggggatgggtccatcagtgagaaggttgtatgttcagggaaaagagataaatggtgcaggaatcaattccagttttgctgtccatcaggatgttgatggcagggccacagatgttgctctggggtggtcagttgctctaggatctccttttacatttgccactactttagagcaggagtacaagagtgacatttttggggagcgtggtattttgcttggtgctgtgcatggaattgtggaggccttgtttagaaggtacactgagaatggaatgagtgaagaaaaggcttataaaaacacagttgagtgcatcacaggaattatgtcaaagaccatttcaacaaagggtatgctctctgtatacaactctctgactgaagaagagaaaaaggaatttaatgctgcatatagtgcatcatactatccttgcatggatatcttgtatgagtgttatgaggatgttgcctgtggcagtgaaattcgcagtgttgttttagctggacgacgcttttatgaaaaggaagggcttcctgctttcccaatgggtaaaatcgatcagacacgaatgtggaaagttggtgagcgagtccgtgcggctcgacctgagggtgacttgggccccttgcacccgtttactgctggggtttatgtggctctaatgatggctcagattgaggtcctaagaaagaagggacattcttactcagagatcattaatgagagtgtgatcgagtcagtggattccctaaatcctttcatgcatgctcgcggggtgtcattcatggtggacaactgttccacaaccgcgcgcctggggtcaagaaagtgggctccgcgttttgattatatccttactcagcaagcattagtagctgtcgacaagaacgctcctatcaatcaggacctactcagcaacttcttttccgatccagtgcatggtgctattgaagtctgtgcagagttgaggccaactgttgatatatctgtgccacctgatgcagattttgtgcgtccagaattgcgacaaactggcaattgagaaatggcaatagattttgatagatagcctacagccattgtgatattttgagagggtaatcttagcatgaaagctctttaaacatctaggttgtatgtgcatgcgaacattgtgcggtctctgagtgcgtagtgtctgaataaattggtgcgtggctgggcatcagttgtgtgtacgttgcacttgtttgacggtaattgagtaatccctgggagtcgtttgtagctttcagatcttttcccttttttttttttgttgtgtgtgtgtgtgtgtttgtcttgatgataactctctagtttagtatgacaaatcacgtcttgctgtattggtg

SEQ ID NO: 2215 - DNA, 2048 bp, Gossypium hirsutum
taccatgattggcggttacttacttaactctctctctcaaaactttagtttaggtttcttcacgtccattttcagatcctttgagtcctctcattccaaccccactgactactcataattgctgcggctcagctatggcctctcaaacccacatctctctcgatttccacacttgtgtcttcaagaaagagaaagtctccctcgctggtcaccacgagtacattgtgagaggaggaagagatttgtttacgttgctgcctgatgctttcaaagggattaagcagattggtgttattggttggggctcccagggacctgctcaagctcaaaatttaagggattctcttgctgatgcaaaatctaatatcattgtcaaggttggactcaggaagggttctccttcttttgccgaagctcgcgctgctgggttctctgaagaaaatggcactttgggtgatatgtgggaaactatttctggaagtgatcttgtattactcttaatttctgatgctgcacaggctgacaatcatgagaagatattctcccacatgaaaccaaatagcatccttgggctttcccatggctttcttcttggacacttgcaatcaatgggacttgatttcccaaagaacgttagtgtaattgctgtgtgtcctaaaggaatgggtccatctgtaaggagactttatgttcaaggcaaagagatcaacggtgctggaatcaattctagttttggagtccatcaggactttgatggtagagctactgatgttgccttggggtggtcggttgcccttggatcacctttcacctttgttactactttagaacaggagtacaagagtgacatattcggggagcggggcattcttctcggtgctgttcatggaattgtggagtctttgtttagaagatacaccgaaaacggaatgagcgaggatcttgcttacaaaaacactgttgaatgcattacaggaattatatcaaagaccatctcaacaaagggcatcttggctgtgtacaattccttgtccgaagagggaaaaagggaattcgagattgcctatagtgcatcttatcacccatgcatggatatactgtatgagtgttatgaagatgtagctagtggaagtgaaatccgtagtgttgtattggctgcgcaacgattttatgagaaggatggtctccctgctttccctatgggaaaaattgatcaaacacgcatgtggaaagtcggtgagcgagtccgaaaggcacgtccatctggtgatttagggccattgtatccatttactgccggtgtctatgtggccttgatgatggctcagatcgagatattgaggaagaaagggcactcgtactctgagatcatcaacgagagtgtgatagaggcagtggattcgttaaatccatttatgcatgctcgtggagtttctttcatggttgacaattgctctacaacagcacgattgggatccaggaaatgggcccctcggttcgattacatcctaacccaacaggctttggtggctgtcgataatggcactcccatcaaccaggatctgcttagcaacttcttgtcagacccagtgcatggtgctatcgaagtttgtgctcaaatgaggccaacggttgacatttcagtgcaccctgatgctgattttgtgcgaccagagttgcgtcaatctggcaattgagtaggtggaatcttggaacttgagtgggcagctatagtgtgtttaagccaaaactttcacctcgtttataaatgagtgatgtagttttagctatgtctttagggtgtttgaacactaatggcactagattcccttttttttttcttccttatcagcctcttctttgatatgactcctttggatttactcttgagaatgcttttggtgaatcttttagactgctttttgaaagttttgttgaagttatatatgagtaagcaaaacagtttattgttgagatcttcaattgcagtggtcattgcgttttaccactttgcaaaaacaataattctatgtgctccttttggccct

SEQ ID NO: 2216 - DNA, 2312 bp, Amborella trichopoda
ccctcttcccactgttgtctcaggcacagtcatccatggcggctgcttcgctctcccctgttgtagctacctcctcatcttcttctaatggggtaaaaaccccaaagctgagttcgagattggggttagggtttttatcgtcttcttcttcttccatttctaggtcatggcgtcagctggttttatccccaagtgcctcagggaaaggggccattggcgcaagaatggtgtccatgcctgctgttaagccggagaaggccttggactttgatactaaagtgtttaagaaagagaagatcacccttactggtcacgatgagtacatagtgagaggtgggcgtgatcttttccatttgcttcctgaggctttcaagggtattaaacagatcggggttattggttggggttctcagggtcctgcccaggctcaaaatttaagggattctttagcagaagcacaatctaatatcattgtgaaggtcggtctaaggaaaggatcccgttcttttgctgaggcacgcgctgctggatttacagaagagagtggaactttgggtgacatctgggaaactgtttcaaccagtgacctattgttagtattgatctcagatgctgcacaggctgatacctatgagaaaatattttctcacatgaagccaaacagcatccttgggctgtcccatggcttcctactaggacatctacagtcgttgggccttgatttcccgaagaatatcagtgtgattgcagtttgtcccaagggaatgggtccatctgtaaggaggctctatgttcagggcaaagagatcaatggtgcaggaatcaatgccagttttgctgttcaccaggatgttgatggcagagctacagatgtggcacttggctggtcagttgccctgggttcaccttttacctttgccactacgttggagcaggagtacaaaagcgatattttcggggagagaggcatcttattgggagcagtacatggaattgtggagtctttgttcagaaggtacactgaatttggcatgaatgaagaactggcttacaaaaatactgttgagagcataaccggaatcatatcaaagactatctcgacaaaaggtatgctatctatatacaactccctcagcgcagaaggaaagaaggaatttgagactgcatacagtgcttcatattatccatgcatggacatcttgtatgaatgctatgaagatgttgcttgtggcagtgaaatcaggagcgtggtattggctggacgacgtttctatgaaaaggatggactaccagccttccccatgggtaaaattgatcaaactcgaatgtggaaagtcggggaacgagtgcgatcagcccggcctgcaggtgacttgggtgccctctaccccttcactgcaggcgtttatgtggcattaatgatggcacagattgaagttctgagaaagaaggggcactcgtactcggagatcatcaacgagagtgttattgaggcagtggattctttgaaccctttcatgcatgcacgtggggtctcattcatggttgataactgttcaacaacagcacgtttgggagctaggaagtgggctcctcgctttgactatatcctcactcagcagacttttgtggctgcggacaaggaaactcccatcaatcaagatctcatcagcaatttcttgtctgaccctgtacatggggccattgatgcctgtgcacagttgaggcccactgttgacatatctgtgacagcagatgcagatttcgtgcgccctgaactacgccagtcaggtaactaagacttgggtgtcaccagtcaggtaattaagatttgggtatctgtggtgacagaagtgtggagaggtacagagcattttgtgatgaaaaagcctctcgtacgttatagagtttactacgatccggtaatgtatgtgatgattgggtaggtagaagaattgatcctaatgggacagatctgtgttgttccttgagctatttgtattgattggaattatctatatgcagtaactattagttcattcgaagcaaaacatatgcatgagttcgaatgtcgataaaagggaaatggagatgcgaacctttcaatgactaacaagaccttgtaataagtgcggaaatgagttagttttaagaagacaaggatattgaataaattattgtattattcacgataagtactagtattttattttatttttctgaattaagagaacatgaagcttagaccttagttggggcacaagtgctgctgccaccacgacccccaccccattctcggtggatctttgctt

SEQ ID NO: 2217 - DNA, 2314 bp, Solanum tuberosum
tcgacataaaatcgtaaacgacccctaaaacctgaggggcattagaatcacagtttcatgtcgccacttctcaattcggaaatgctgcatatcgttaccctagcaatactaatccaaacataaaaacgtgacccctcatttccactttctctctctacactttttacagtcatcggcggcacctcaacagagcaacaatggcgacaccggcggctacttctttctccatttcctcctcctcctcggccgtttcttcctcaaccaaatccctaaagcctgctctatctagtaacttagggttcttttctacttcatctccgtcgcttaaggctctcagagctaaatctcactcctacaatgtctctagctccggcggagcacttaatgttcgtatggttgctgctcctgctgctgtaaaggcaccgatgtctctcgattttgaaacatctgtttttaagaaggagaaagttaccctttctggacacgacgagtacattgtgaaaggagggagagatttgttcaagttgttgccggatgcattcaagggaatcaagcagattggagtcattggctggggttctcagggaccagctcaagcccagaacttgagggattctcttgcagaagcaaaatctgatatagtcgttaagattggtttgagaaagggttctcgctcctttgctgaggctcgtgcagctgggtttactgaagaaaatggtaccttgggagacttgtatgaaactatctctggtagcgatctagtgctgcttttgatttctgatgcagctcaggctgacaactatgaagaagtgttttctcacatgaaaccaaatagcatacttggtctttcgcatggattccttctcggccatttgcagtcattggaccttgactttcccaagaacatcagtgtgattgctgtatgtcccaagggaatgggcccatctgtccggagattatatgtgcaaggaaaagaaatcaatggtgctggaattaatgcaagttttgcagttcaccaggatatagatggaagagccactgatgttgctcttgggtggtcagttgcccttggttccccctttacatttgcaactaccctggaacaggaatacagaagcgatatatttggcgagcgaggcatattacttggtgctgtccatggcattgttgagtcgttgttcagaaggtacacagaaaatggaatgagtgaagagctcgcatacaagaatactgttgagtgcataaccggaaacatttcgaggaccatatcaacaaagggtatgttagctctatacaattcattggatgcggaaggcaagaaggtgtttgcgactgcatatagtgcttcatattacccttgcatggagatcttgtacgagtgctatgaggatgttgcagcaggtagtgagatcaggagtgttgtattggcaggtcgccgcttttctgagaaagaggggttaccagctttcccaatgggtaaaatagaccagacaaggatgtggaaagttggtgagcgtgttcgtgcaacacgaccatctggtgatctgggtcctctctatcctttcactgctggtgtctatgtcgcattgatgatggctcagattgaggttctgaggaagaaaggccactcttactcagagatcataaatgaaagtgtcatcgagtctgttgattccctgaatcctttcatgcatgcacgtggagtgtcattcatggttgacaattgctctacaacagcgcgtttgggatctaggaagtgggctcctcgatttgattacaatctcacccagcaagcactggtggctgtcgacaataacctgccaatcaatatggatcttatgaccaatttcgtatgtgatcctgtccatgaagctattgaagtttgtgcccaattgagacctacagtcgacatttcagttcctgcagatgctgactttgtccgtcccgagctcagacaaactgtcaactaaggttctttgtcggtcacttctattgagaatggtgatggttttatggaattggaaggagtaaggcattaggcaggaccatgtttagtctgatcgagcattttcaaaagtagagatcgtttctgtatgctgtgctttttggagtgtaaggagatctacttaataaaatatgaaaaaaaaatcaccgttttctgttattaactacgtgacctctgtactttggaattttatgtatttttgcagattaactgaataaaaactcagtttggagtctatttagccatggtattaatatgttttctcaatcaaaaggtttaaattaattgtatgaacagtgttgagaacgt

SEQ ID NO: 2218 - DNA, 2216 bp, Solanum phureja
cgagataaaatcgtaaacgacctaaaacctgaggggcattagaatcacagtttcatgccgccacttctcaattcggatatgctgcatatcgttaccctagcaatactaaaccaaacataaaaacgtgacccctcatttccactttctctctctacactttttacagtcatcggcggcacctcaacagagcaacaatggcgacaccggcggctacttctttctccatttcctcctcctcctcggccgtttcttcatcaaccaaatccctaaagcctgctctatctagtaacttagggtttttttctacttcatctccgtcgcttaaggctctcagagctaaatctcactcctacaatgtctccagctccggcggagcacttaatgttcgtatggttgctgctcctgctgctgtaaaggcaccgatgtctctcgattttgaaacatctgtttttaagaaggagaaagttaccctttctggacacgacgagtacattgtgaaaggagggagagatttgttcaagttgttgccggatgcattcaagggaatcaagcagattggagtcattggttggggttctcagggaccagctcaagcccagaacttgagggattctcttgcagaagcaaaatctgatatagtcgttaagattggtttgagaaagggttctcgctcctttgctgaggctcgtgcagctgggtttactgaagaaaatggtaccttgggagacttgtatgaaactatctctggtagcgatctagtgctgcttttgatttctgatgcagctcaggctgacaactatgaagaagtgttttctcacatgaaaccaaatagcatacttggtctttcgcatggattccttctcggccatttgcagtcattggaccttgactttcccaagaacatcagtgtgattgctgtatgtcccaagggaatgggcccatctgtccggagattatatgtgcaaggaaaagaaatcaatggtgctggaattaatgcaagttttgcagttcaccaggatatagatggaagagccactgatgttgctcttgggtggtcagttgcccttggttccccctttacatttgcaactaccctggaacaggaatacagaagcgatatatttggcgagcgaggcatattacttggtgctgtccatggcattgttgagtcattgttcagaaggtacacagaaaatggaatgagtgaagagctcgcatacaagaatactgttgagtgcataaccggaaacatttcgaggaccatatcaacaaagggtatgttagctctatacaattcattggatgcagaaggcaagaaggtgtttgcgactgcatatagtgcttcatattacccttgcatggagatcttgtacgagtgctatgaggatgttgcagcaggtagtgagatcaggagtgttgtattggcaggtcgccgcttttctgagaaagaggggttaccagctttcccaatgggtaaaatagaccagacaaggatgtggaaagttggtgagcgtgttcgtgcaacacgaccatctggtgatctgggtcctctctatcctttcactgctggtgtctatgtcgcattgatgatggctcagattgaggttctgaggaagaaaggccactcttactcagagatcataaatgaaagtgtcatcgagtctgttgattccctgaatcccttcatgcatgcacgtggagtgtcattcatggttgacaattgctctacaacagcgcgtttgggatctaggaagtgggctcctcgatttgattacaatctcacccagcaagcactggttgctgtcgacaataacctgccaatcaatatggatcttatgaccaatttcgtatgtgatcctgtccatgaagctattgaagtttgtgcccaattgagacctacagtcgacatttcagttcctgcagatgctgactttgtccgtcccgagctcagacaaactgtcaactaaggttctttgtcggtcacttctattgagaatggagtaaggcattaggcaggtccatgtttagtctgatcgagcattttcaaaagtagagatcgtttctgtatgctgtgctttttggagtgtaaggagatctacttaataaaatatgaagaaaaaaaattcacctttttctgttattaaactacgtgacctctgtactttggaattttatgtatttttgcagattaactgaataaaaactcagtttggagt

SEQ ID NO: 2219 - DNA, 1964 bp, Musa acuminata
ctcatggcggcgaccgccgtggcgacgatttccttggctacctcgtccacccctcccgcctcccgcgccaaaatccagaaaccagcgcccggaaccctggtcctcggatcctccgccgcctcgctgtcgtcgtcctccatatcgctgcggcacgtcgtgccggccggacggggtggcggccgcggcgccgccttcggtgctcggatggtgtcgatgccctctgtcgagaagcccccgccgtcactcgacttcgagacgtcggttttcaagaaggagaagattacccttgccggccacgacgagtacattgttaaaggtggaagggatttgttctacttgttgccggacgcattcaaggggatcaaacagattggggtgatcggatggggatctcagggccctgcacaagcacagaatttgagggattcacttgtggtggcaaagtccgacattgtggtcaagattggtctgaggaaaggttctcgttcttttgatgaagcacgtgcagctggattcaccgaagaaaatggaactttgggtgatatctgggagacagttgcaggcagcgatcttcttctgctgctgatttctgatgctgcacaggcagacaattatgaaaaagtattctctcatatgaaaccaaacagcattctggggctgtcacatggtttccttctagggcacttgcagtccctcggccttgatttccccaagaacatcagtgtaattgctgtgtgccccaagggaatgggtccatcagtgagaaggttatatgttcagggtaaagagataaatggtgctgggattaattctagttttgctgtacaccaggatgttgatggcagggcagtggatgttgctcttggatggtcagttgctctaggatctccttttacatttgctacgacattggagcaggagtataagagtgatatttttggagagcgcggtattttgcttggtgctgtgcatggaattgtggaagcattatttagaaggtacaccgagaatggaatgagtgaagagcttgcttacaagaacactgttgagtgcatcacaggaatcatatcaaagaccatttcaacaaaggggatgctctctgtatatagtgctttgaccgaagaggggaagaaagaattcaatgctgcatatagtgcatcatactatccttgcatggatatattgtatgaatgctatgaggatgttgcctgtggaagtgaaatctgcagtgttgtattagctggacggcgcttccaggaaaaggaagggcttccagctttcccaatgggtaaaatcgatcaaacacgaatgtggaaagttggcgagcgagttcgtgctacacgtcctgcaggtgatttgggccccctacatccctttacagctggagtttatgtagctttgatgatggctcagattgaaatcttaagaaagaaagggcattcttactctgagatcatcaacgagagcgtaatcgaatctgtggattccctgaatcctttcatgcatgctcgtggggtgtcattcatggtggacaattgttctactactgcacgactgggatcgagaaaatgggccccgcgttttgactacatcctcacacagcaggcatttgtctcagtggataaaaacagatctatcaatcaggaccttatcagcaactacttgtacgatccagttcatgatgccataggagtatgcgcacaactgaggccgactgttgatatatcagtgcctcccgatgcagattttgtccgtccagaactgcgacaatcgagcaactaggatccgaggtgagtttctgatggtactattttggcatgtctgagggctatatcacaggtttagcttagtcgaggtgtagttttgttcgggagtttatgagatgcagggtctagttctccgaacaacccgaactttatgctatccatgcttcgaagtgccagaataaattagccctccttttc

SEQ ID NO: 2220 - DNA, 1986 bp, Valeriana officinalis
actcatggcggctacatcctttgctccttcttcctttgccgctgcctcctcttcctcttcatccgcatctaaaaccctaggactcaatgcaggctttctaggctccacttccttgaaaaccgcctcaaaccctctgagggctccagttttgtccatccatgccggtggttcgggatctgcgtcgtctagtgtcgctcgtatggtatctatgcctgcgattaagcctcctactttgcttgattttgacacatctgtctttaagaaggagaaggttactctcgccggttacgatgagtatattgttaaaggaggtagagatttgtttcctttgttgcctgatgcattcaagggaatcaaacagattggtgtcattggctggggttctcaggggcctgctcaggctcaaaatttaagagattctcttgaagaagcaaaatcaaatatcgttgtcaagatcggtttaaggaagggttcaagttcatgctcagaagcacgtgctgctggttttactgaagaaaatggaactctaggtgatatgtatgagaccatttctagcagtgatttggttttgcttttgatttctgatgcagcccaggctgataattacgaggaagttctatcacacatgaagccgaatagcatattagggctttcacatggttttcttttgggtcatttacagtcgattggaaaagattttccgaaaaacataagcgtagtagccgtttgtcccaagggtatgggtccatctgtaaggagactttatgtacaaggtaaagaagtaaacggtgctggaatcaatgccagttttgctgttcatcaggatgttgatggtagagcaacagatgttgcactcgggtggtcagttgcacttggttctcccttcacattcgctacaacacttgagcaggaatacaagagtgacatattcggcgaacgaggtattttacttggtgctgtgcatggtattgtggagtctttatttagaagatatactgaaaatgggatgagcgaagaacttgcttataagaatactgttgaatgcattactggaaacatatcgaagaccatttcagcaaagggaatgttggccgtctacaattcgttgtctgaagacggtaaaaaggaatttgaggccgcatacagtgcttcattttatccgtgtatggatattttatacgaatgctacgaggatgtagcaagtggaagtgaaattcgcagtgttattttggctggacgccgtttctacgagaaagaaggattaccggcattcccgatgggtaaaatcgacaaaacaaggatgtggaaagtcggtgaacaggtccgcaaaacaaggccagctggggatttaggtccattaaacccttttactgctggtgtttatgttgcacttatgatggctcagattgaggtcttgaggaagaaagggcactcttattcagagatcattaacgaaagtttaatcgaatcggtggactctttgaacccgttcatgcatgcacgaggagtatcattcatggttgacaattgctcgacaactgcgagattaggatcaaggaagtgggccccgcgattcgattacatcttgacccaacaagccttggtggcagttgaccagggttcgccggtcaaccaagacctgatcggcaattttatgtcagaccctgttcactctgccatcgaggtctgtgcccagttgagaccatctgttgatatttcggttcctcaagatggacaagatgctgactttgtccgtcctgaacttcgtcagtccagcaactaaaatgttcttgaatcaagaacagggacggagtcagagattaatgttcctttgtaagatttgaattttgagcttcttccctttttccccctcaatatgtttgggcacttttgttatgtggaactgagatgtacttatgttgtttagagattgtatttctcttcttgttgggtgcgaagttttcatatttatataatctactgtaa

SEQ ID NO: 2221 - DNA, 2016 bp, Theobroma cacao
aaataaaaaaaatgccaaatttaaatcctaaacggagcgtctagccaaagaaaatcaatcggcatgcgtcccacgtcgtcggtacgtcaggtgacgagcatagcagtgtccagtgagaaattgacgagtaaaagctctttatcaacactgaaacaagcgtacacacaaaaagcagcaagcaaggaaggggaccagaggctatcactaaacggctaaagctaaagctctgcctctcttcgcatcctttcggtttcgacgcctagtatgaatcctccggcatcgctcgacttccacacctctgttttcaacaaggagaaggtctcccttgctggtcaccatgagtacattgtgaaaggaggaagaaatttgttcaagctgctgcctgacgctttcaaggggattaaacagattggcgttattgggtggggttctcagggaccagctcaagctcaaaatttaagagattcccttgcagaagcaaaatctgatattgttgtcaaggttggacttaggaagggttctcattcttttgccgaagctcgtgctgctggtttcactgaagataatggaacactgggtgaaatatgggaaactatttctggcagcgatcttgtgttacttttgatatctgatgctgcacaggctgacaattgtgagaaaatattctcacacatgaaaccaaaaagcatacttggtctctcacatggctttcttcttgggcatttgcaatctatgggacttgatttcccaaaaaacatcagcgtaattgcggtttgtcccaaaggaatgggtccatcagtaaggagactctatgttcaaggcaaagagatcaatggtgctggtattaattccagttttgcagtccaccaggatgttgatggtcgagctactgatgttgcacttggctggtcagttgctcttggttcgcctttcacatttgctactactttagagcaggagtacaagagtgacatctttggggaacgaggcattttgcttggtgcggttcatggcattgtggaggccttatttagaagatacacagaaaatggaatgagtgaggacctggcttacaagaatactgttgaatgcataacaggaattatatcaaagacaatttcaactcagggcatgttggctgtgtacaattctttttctgaagagggacggaaggaatttgagactgcatatagtacttcatattatccatgcatggatatcttgtatgagtgctatgaagatgtagcttgtgggaatgaaatccgcagtgttgtcttggctgggcggcgtttttatgaaaaggatgggctcccagccttcccaatgggtaaaattgatcagacacgcatgtggaaagttggagaacaagtatggagggcaagactagcaggtgatttaggaccattatatccatttacagctggtgtttatttggcattaatgatggcccagattgagatcctgaggaagaaagggcactcctactctgagatcattaatgaaagtgtgatagagtcagtggattcattgaatccatttatgcatgctcgtggagtttcctttatggttgacaactgctccacaactgcacgattgggatcaagaaaatgggctcctaggttcgattacatccttacccaacaggccctggtggcagtggacaatggcactcccatcgaccaagatttgatcagcaactttctgtcagatcctgtacatggagccattgaagtctgtgctcagttgaggcctacagttgatatttcagtgcccccagatgctgattttgtgcgacctgagttgcgtcaatcaagttagtaagtggagatctttaagcttgagctagccaaccttttatgaaagggttgtttgtgaaacttgcttgaatgtatgaatagtggagttttatcgatgtgttacttttgttgggatttttaagtagaaacgtatttaatatcaagatcagcacacaaataaatcacataagatataatatttaacatggtttggcatcca

SEQ ID NO: 2222 - DNA, 2237 bp, Brachypodium distachyon
gcccacgggacgcagctgagcagatccaggaatcccctcttttcccctcgcagtcagtcaccctagtcatcgcatccccaatggcggcggccacttcctccgcttcctcccttgccttctcccaccccaaaaccctgaaccctgcctccaaaaccccagccgtgggctccgtatccttccccgccgctcagaccccatgcatcctcgcctcctcggccggccgctgccgtgccgtagtagcaaaggtcgcgtcgccgtcggtgatcggcgccaccatgccatcgctcgacttcgagacctccgtcttcaagaaggaaaaggtgtccttagccggccatgatgagtacattgtgaggggtgggaggaatctcttcccgctgcttccggaggcgttcaaggggatcaagcagatcggcgtgcttggatggggctcgcagggtccagcacaagctcagaacttgagggattcacttgctgaggcaaagtcggacatcgttgttaagattggtcttcggaaaggttccaaatctttccaggatgcacgtgcagctggatttactgaagaaaatgggaccttgggagatatatgggagactgtctcaagcagtgaccttctattgttattgatatcagatgctgcccaggcagataactacgagaaaatcttctcacacatgaaaccgaacagtattcttggtttgtcacatgggtttctccttggacatttacaatcagttggccttgattttccccaaaacatcagtgtgatagctgtatgccccaagggaatgggcccgtcagttagaaggctttatgttcagggtaaagaggtcaacggtgccggtatcaactctagctttgctgttcaccaggatgttgatggaagggctacagatgttgctctaggatggtcaattgctctaggttctcctttcacctttgctactactctagagcaagagtaccggagtgatatttttggcgagcgaggtatattgcttggtgctgttcatggcattgtggaggctcttttcaggcgatacacagaacaaggaatggacgaggtcttggcgtataagaacactgtagagtgcatcactgggattgtctctaaaactatttccaagaaggggatgctcgaagtgtacaactcctttacagaagaaggaaagaagcagttcaaagaggcatatagtgcagctttttacccaagcatggatatactctatgagtgctatgaagatgtttcttctggaagtgaaataagaagtgttgtgctggctgggaggagattttacgaaaaggagggtctccctgctttccctatgggcaacattgatcaaacacgaatgtggaaggtgggtgaaagggtgcgtgcaacccggccacaaggtgatcttggccccttacatcccttcactgctggagtgtttgtcgcactaatgatggcacagattgaggtccttagaaagaagggccactcgtactcagagatcatcaatgagagtgtgattgagtctgtggattccctaaacccattcatgcatgctcgcggggtggccttcatggtggataactgctccaccacagctcggctagggtcgaggaaatgggctccacgctttgactatgtcttgacccaacaagctttcgtgaccgtcgacaagaatgcaccaattaaccaagacctcatcagcaatttcttgtccgatcctgttcatggcgccattgaaatctgcgctcagctgaggcccaccgttgacatctcagtgactgcagatgctgattttgtgcgcccagaactccgacagtcatcctaaagtatgtgatgatcagcaggacatctcatctggtgtgttttaggaactaatatatcagtctagccgtttgaactataaatgtattggtatctcaaacaaatttcagtgtatgactggttttgtggatactggaatgttgtttcaggaataaaagtcgtggttaaggtaaaatatgtttttgtcggtacctttagttgcttctgaagatccttcttagcagatggtatgtgatgatcggcaggacatctcatcgggtgtatttaggaactatatcagtgtagccgttcgaactataaatgtaatgctatctcaaacctgaagtaaatgattagtgtatgactggttttgtggacactggagtattgtttttctggaataaaagtcgtggttaatcataaatatgtttttggcagcacc

SEQ ID NO: 2223 - DNA, 2186 bp, Brachypodium distachyon
aggaatcccctcttttcccctcgcagtcagtcaccctagtcatcgcatccccaatggcggcggccacttcctccgcttcctcccttgccttctcccaccccaaaaccctgaaccctgcctccaaaaccccagccgtgggctccgtatccttccccgccgctcagaccccatgcatcctcgcctcctcggccggccgctgccgtgccgtagtagcaaaggtcgcgtcgccgtcggtgatcggcgccaccatgccatcgctcgacttcgagacctccgtcttcaagaaggaaaaggtgtccttagccggccatgatgagtacattgtgaggggtgggaggaatctcttcccgctgcttccggaggcgttcaaggggatcaagcagatcggcgtgcttggatggggctcgcagggtccagcacaagctcagaacttgagggattcacttgctgaggcaaagtcggacatcgttgttaagattggtcttcggaaaggttccaaatctttccaggatgcacgtgcagctggatttactgaagaaaatgggaccttgggagatatatgggagactgtctcaagcagtgaccttctattgttattgatatcagatgctgcccaggcagataactacgagaaaatcttctcacacatgaaaccgaacagtattcttggtttgtcacatgggtttctccttggacatttacaatcagttggccttgattttccccaaaacatcagtgtgatagctgtatgccccaagggaatgggcccgtcagttagaaggctttatgttcagggtaaagaggtcaacggtgccggtatcaactctagctttgctgttcaccaggatgttgatggaagggctacagatgttgctctaggatggtcaattgctctaggttctcctttcacctttgctactactctagagcaagagtaccggagtgatatttttggcgagcgaggtatattgcttggtgctgttcatggcattgtggaggctcttttcaggcgatacacagaacaaggaatggacgaggtcttggcgtataagaacactgtagagtgcatcactgggattgtctctaaaactatttccaagaaggggatgctcgaagtgtacaactcctttacagaagaaggaaagaagcagttcaaagaggcatatagtgcagctttttacccaagcatggatatactctatgagtgctatgaagatgtttcttctggaagtgaaataagaagtgttgtgctggctgggaggagattttacgaaaaggagggtctccctgctttccctatgggcaacattgatcaaacacgaatgtggaaggtgggtgaaagggtgcgtgcaacccggccacaaggtgatcttggccccttacatcccttcactgctggagtgtttgtcgcactaatgatggcacagattgaggtccttagaaagaagggccactcgtactcagagatcatcaatgagagtgtgattgagtctgtggattccctaaacccattcatgcatgctcgcggggtggccttcatggtggataactgctccaccacagctcggctagggtcgaggaaatgggctccacgctttgactatgtcttgacccaacaagctttcgtgaccgtcgacaagaatgcaccaattaaccaagacctcatcagcaatttcttgtccgatcctgttcatggcgccattgaaatctgcgctcagctgaggcccaccgttgacatctcagtgactgcagatgctgattttgtgcgcccagaactccgacagtcatcctaaagtatgtgatgatcagcaggacatctcatctggtgtgttttaggaactaatatatcagtctagccgtttgaactataaatgtattggtatctcaaacaaatttcagtgtatgactggttttgtggatactggaatgttgtttcaggaataaaagtcgtggttaaggtaaaatatgtttttgtcggtacctttagttgcttctgaagatccttcttagcagatggtatgtgatgatcggcaggacatctcatcgggtgtatttaggaactatatcagtgtagccgttcgaactataaatgtaatgctatctcaaacctgaagtaaatgattagtgtatgactggttttgtggacactggagtattgtttttctggaataaaagtcgtggttaat

SEQ ID NO: 2224 - DNA, 1949 bp, Flaveria ramosissima
cgaatcgggagcccaggccacatataactagggctactgacacacccctcacgccacctttgcctccgccgttccccctcctccaccacattttccggcaatggcgacggcgacggcgacggcgaccaccaccttctccaccgtagccccaccacctcatcatcaccgtctctcaaaatctcccccaaaaccctagggtttaacgtagggtttccgttgtctaaaccctcagccaaatcgctcaaagctcgttccaatggtggctgtggttctgctattggagctcgtatggtttcagctccggcgttaagcaaacctccaatgcttcttgattttgagacctcagttttcaaaaaggagaagattaaccttgctggtcatgatgagtatattgtgagaggagggagagatttgtttcatttgttacctgaggcttttaaaggtatcaagcagattggtgttattggatggggttctcagggtcctgctcaagctcagaatcttagggattctcttgcagaagcgaaatctgatattgttgtgaagattggcttacgaaaggggtcgagttcatttaacgaggctcgtgctgctggctttactgaggaaactggaacccttggagatatatacgagactatctctggcagtgacttggttctgctcttgatttctgattcagctcaggctgataactatgagaaaatcttttcccacatgaagccaaacagcattcttggactttcacatgggttccttcttggtcatctgcaatcagttgggcttgatttccccaagaacataagtgtggttgctgtgtgtcccaaaggaatgggtccatctgtcaggaggttgtatgttcaaggaaaagaggtcaatggagccggaatcaatgcaagttttgccgtccatcaggatgttgatggaagagccactgatgttgcacttgcatggtcagttgctcttggctcaccctttacattcgccactacacttgagcaggagtacagaagtgatatattcggggagcgaggcattttacttggagcggtgcatgggattgtggagtccttgtttagaaggtatacagaaggtggtatgagtgaagatttggcttacaaaaacaccgtagagtgcattactggcataatatcaaagataatatcgactcagggcatgaaagctgtatacgagtcattgacagaagaaggcaaaaaggagttcttgacagcatacagtgcatcttactatccttgtatggacattctgtatgagtgctatgaggatgtagcgactggaagtgagattagaagcgttgtgttggctggccgtcgattttatgaaaaggagggtttgccagcattccctatgggcaagattgatcagactcgaatgtggaaagtaggtgaacgtgttcgggctgcccgacctgcaggtgatttaggcccattgtatcctttcacggctggcgtctatgttgcactaatgatggcccagattgaggtgttgaggaagaaagggcattcttattctgagatcatcaatgagagcttgatcgagtcggtggattcactgaacccattcatgcatgctcgaggtgtgtcgtttatggtggataactgttcaacaactgcaagactgggatcaaggaaatgggctccccgctttgattatattcttacccaacaggctttagttgctgtagacaatggggccccacttaaccaggacctaatcagcaacttctttgaagatccggtgcatgaagctgtcaaagtttgtgcagagttgagacccactgttgacatctcagtgcccgctgatgctgattttgtcagacccgagttgcgtcaagctagcaactaagtattgactcccaggctcttgtctagtttatcattgtgctatgcagatttctactgtatgatgtgttacgactttgttgaatt

SEQ ID NO: 2225 - DNA, 2006 bp, Silene vulgaris
cgtatctcaccacaccatcacccatcgttaaagcttctctcaaatcaacccttaaaccctcttctttgaatctagggtttttgagccccgccgctttttcagtgaaatctccaagcatcaaaaatggcgccggatcttctctttcagcacacatgatggtttctgtacccgccattgataaaccttcaatcgcccttgactttaatacctctgttttcaccaaggagaagattaatcttgctggccatgacgagtacattgttcgaggaggaagggatttgtttcatttgttgccggaagctttcaaaggaattaagaagattggtgttattggttggggctctcaggcacctgcccaagctcagaacttgaaggagtctttggcagaggcaaaatctgatattgttgtcaagattggtcttcgcaaaggctctcgttcatttgctgaagctcgtgctgctgggtttactgaagagagtgggactttgggtgagatgtgggaaactattgctgagagtgatcttgtgatgttgcttatttctgattctgctcaggctgacaattatgagaaggtgttttctcacatgaaaccaaacagcatccttggattgtcccatgggtttcttctgggacatctgcaatcaatcggtcaagatttccccaagcacatcagtgttgttgctgtttgccccaagggaatgggcccttctgtaaggaggttgtatgtgcagggcaaagagatcaatggtgctggaataaactctagctttgctgtccaccaggatgttgatggtagggccgctgatgtggcacttggctggtctgttgctctcgggtctcctttctcatttgccacaactcttgagcaagagtacaagagtgatatctttggggaacgaggtatcttacttggggctgttcatggcctcgtggagtgcttgttcagaagattcactgaaaatggaatgagcgaagaagatgcttacaagaacactgttgaatgtgttaccggtgtcatatcaaagaccatctcaactaagggaatgctcgccttgtacaattctctgtcagaagatgggaaaaaggaatttgaggctgcatacagtgcctcctattatccttgcatggagatattgtatgagtgctatgaagatgttgctagtggaagtgagatcagaagtgttgttttggcaggccgccgctttcaagagaaagaaggtcttcctgctttcccaatggggaaaattgatcaaacccgaatgtggaaggtaggtgagcgagtgagagcggtgagaccagctggtgatttgggcccgttgaatcctttcactgctggcgtttatgttgccctcatgatgtcccagatagagattctgaggaagaagggccactcctactcagagatcatcaatgagagcttgattgaggctgttgattcgttaaacccattcatgcacgcccgtggtgtctccttcatggttgataactgttcgaccactgccagacttggttcaaggaaatgggccccacgattcgattacatcttaaaccaacaagccctagtagcagttgacaacaatgctccaatcaaccaagatttgatcagcaacttcttttcggatcctgttcatgaggccattggagtttgcgccgagctcaggccttccgtagatatctccgtgactgctgatgctgatttcgtccgccctgagttacgccaggcttgaaattagagctcacagtctgattgatcaattgagatgggaatctcctcttcatatcattgtatgcttagcttgctgtctttctcgtttaagcgggagtactttttatttttctctttttaaaacggtttagtatcggagtatttgcgagagcagttcttgtttaacttgttatctggacctatgtaatattttgcagtttttctattagtttcatacacatgtgccttgttctgctggtgttccagaggaaataattaataaaatctttgatcaccagaa

SEQ ID NO: 2226 - DNA, 2186 bp, Solanum lycopersicum
taaacgacccctaaaatgtgaggggcattaagaatcacagtttcatgtcgccacttctcaattcggatatgctgcatatcgttaccctagcaatactgatccaaacataaaaacgtgaccctcatttccactttctctctctacacttttcacagtcatcggcggcacctcaacagagcaacaatggcgacaccggcgactacttctttcgccatttccacctcctcttcctcggccgtttcttcctcaagcaaatcattgaagcgtgctctttccagtaacttagggttcctttctacttcttctctgtcgcttaaggctctcagagctaaatcttactcctacaatgtgtctagctccggcggaccacttagtgttcgtatggttgctgctcctgctgctgtgaaggcaccgatgtctctcgattttgaaacgtctgtttttaagaaggagaaagttaccctttctggacacgacgagtacattgtgaaaggagggagagatttgttcaagttgttgccggatgcattcaagggaatcaagcagattggagtcattggctggggttctcagggaccagctcaagcccagaacttgagggattctcttgcagaagcaaattctgatatagtcgttaagattggtttgagaaagggttctcgctcctttgctgaggctcgtgcagctgggtttactgaagaaaatggtaccttgggagacttgtatgaaactatctccggaagcgatctagtgctgcttttgatttctgatgcagctcaggctgacaactatgaagaagtgttttctcacatgaaaccaaatagcatacttggtctttcgcatggattccttctcggccatttgcagtcattggaccttgactttcccaagaacatcagtgtgattgctgtatgtcccaagggaatgggcccgtctgtccggagattatatgtacaaggaaaagaaatcaatggtgctggaatcaatgcaagttttgcggttcaccaggatatagatggaagagccactgatgttgctcttgggtggtcagttgcccttggttccccctttacatttgcaaccaccctggaacaggaatacagaagcgatatatttggcgagcgaggtatattacttggtgctgtccatggcattgtcgagtctttgttcagaaggtacacggaaaatggaatgagtgaagagcttgcatacaagaatactgttgagtgcataaccggaaacatttcgaggacaatatcaacaaagggtatgttagctctatacaattcattggatgcggaaggcaagaaggtgttcgcgactgcatatagtgcttcatattacccttgcatggagatcttgtatgagtgctatgaggatgttgcaacaggtagtgagatcaggagtgttgtcttggcaggtcgccgcttttctgagaaagaggggttaccagctttcccaatgggcaaaatagaccagacaaggatgtggaaagttggtgagcgtgttcgtgcaacacggccatctggtgatctgggtcctctctatcctttcactgctggtgtctatgtcgcattgatgatggctcagattgaggttctgaggaagaaaggccactcttactcagagatcataaacgaaagtgtcattgagtctgttgattccctgaatcctttcatgcatgcacgtggagtgtctttcatggttgacaattgctctacaacagcgcgtttgggatctagaaagtgggctcctcgatttgattacaatctcacccagcaagcactggtggcagtcgacaataacctgccaatcaatatggcccttatgactgatttcgtatgtgatcctgtccatgaagctattgaagtttgtgcccgattgagacctactgtcgacatttcagttcctgcagatgctgactttgtccgtcccgagctcagacaaactgtcaactaaggttctttgtctgtcatttctattgagaatgagtatggcattaggcagtgccatgtttagtctgatcgagcattttcaaaggtagagatcgtttctgtatgctgtgctttttggggtgtaaggagatctacttatatttctgttggtaaaaaaaaaaacaacctttttctgtactatggaattttatgtacttttgcagattaactgaataaaaactcagtttggag

SEQ ID NO: 2227 - DNA, 1640 bp, Ambrosia trifida
aaacaccctttaaatccctcaaagctcaagccttttcatctgggtctgctcttggagctcgtatggttgcatccccaaccatcactaagtctccagtctctcttgatttcgatacatctgttttcaagaaagagaaggtcaaccttgctggtcatgaagagtatattgtgagaggaggtagagatttgtttcatttgttgcctgatgcttttaaagggattaaacagattggtgtcattggttggggttctcagggtcctgcacaagctcagaatttaaaggattcacttgctgaagcaaagtctgatattgtagtcaagattgggttgaggaagggttcgagttcgtttgctgaggctcgtgctgctggatttagtgaagagaatgggactcttggagatatttatgaaactatttctggtagtgatttggtcttgttattgatatctgattcagctcaggctgataactatgagaaaatcttctctcacatgaaaccaaacagcatccttggactttcccatggtttcctccttggtcatttacaatcttctggtctggatttccccaaaaatgtcagtgtggttgctgtatgtcccaaaggaatgggcccatcggttagaaggctatatgtgcaaggaaaagagatcaacggagctggtattaatgctagttttgctgtccatcaggatgttgatggcagagccactgacgttgcacttggatggtcagttgctcttggttcaccttttacatttgccacgacactagaacaggagtataaaagtgatatatttggcgaaagaggtattttacttggtgctgtgcatggtatcgtggaggcattatttagaaggtacacagaacaaggtatggctgaagatttggcttacaagaacactgttgaatgcataaccggagtaatatcaaagaccatatccactaagggtatgaaggctgtctacgagtctctctcagaagaaaggctaaaaaagatttacttgacggcatacagtgcttcttatcatccctgcatggaaatcttgtatgagtgttacgaggatgtagccagtggcagtgagattaggagcgttgtttggccggccgccgctttatgaaaaagagggtctgccagcgttcccaatgggcaaaattgatcaaactcgcatgtggaaagttggtgaacgggttcgtgctacacgacccgctggtgatttaggcccgttatatcctttcacagcaggagtctacgtggctctaatgatggctcagatcgaggtattgaggaataaagggcactcttactctgaaatcatcaatgagagtttaatcgaatctgtggattcattgaaccctttcatgcatgctcgtggcgtttcattcatggtggacaactgttccacaactgcgaggttagggtcagaaaatgggctccacgcttcgactacaatctgacccagcaggcgttggttgcagtagacaacggtgcaccagttaaccaggatcttgttaagagcttctttgaagatccggttcatgaagcggtcaaagtgtgtgcagagttgagacctaccgtcgatatctcagtgcctgcagatgccgattttgtgagacctgagctgcgtcaatctagcaactag

SEQ ID NO: 2228 - DNA, 1631 bp, Flaveria ramosissima
acgtaggtttccgttgtctaaaccctcagccaaatcgctcaaagctcgttccaatggtggctgtggttctgctattggagctcgtatggtttcagctccggcgataagcaaacccccaatgcttcttgattttgagacctctgttttcaaaaaggagaagattaaccttgctggtcatgatgagtatattgtgagaggagggagagatttgtttcatttgttacctgaggcttttaaaggtgtcaagcagattggtgttattggatggggttctcagggtcctgctcaagctcaaaaccttagggattctcttgcagaagcgaaatctgatattgttgtgaagattggcttacgaaaggggtcgagttcatttaacgaggctcgtgctgctggctttactgaggaaactggaacccttggagatatatacgagactatctctggcagtgacttggttctgctcttgatttctgattcagctcaggctgataactatgagaaaatcttttcccacatgaagccaaacagcattcttggactttcacatgggttccttcttggtcatctgcaatcagttgggcttgatttccccaagaacataagtgtggttgctgtgtgtcccaaaggaatgggtccatctgtcaggaggttgtatgttcaaggaaaagaggtcaatggagccggaatcaatgcaagttttgccgtccatcaggatgttgatggaagagccactgatgttgcacttgcatggtcagttgctcttggctcaccctttacattcgccactacacttgagcaggagtacaggagtgatatattcggggagcgaggcattttacttggagcggtgcatgggattgtggagtctttgtttagaaggtatacagaaggtggtatgagtgaagatttggcttacaaaaacaccgtagagtgcattactggcataatatcaaagataatatcgactcagggcatgaaagctgtatacgagtcattgacagaagaaggcaaaaaggagttcttgacagcatacagtgcatcttactatccttgtatggacattctgtatgagtgctatgaggatgtagcgactggaagtgagattagaagcgttgtgttggctggccgtcgattttatgaaaaggagggtttgccagcattccctatgggcaagattgatcagactcgaatgtggaaagtaggtgaacgtgttcgggctgcccgacctgcaggtgatttaggcccattgtatcctttcacggctggcgtctatgttgcactaatgatggcccagattgaggtgttgaggaagaaagggcattcttattctgagatcatcaatgagagcttgatcgagtcggtggattcactgaacccattcatgcatgctcgaggtgtgtcgtttatggtggataactgttcaacaactgcaagactaggatcaaggaaatgggctccccgctttgattatattcttacccaacaggctttagttgctgtagacaatgggaccccacttaaccaggacctaatcagcaacttctttgaagatccggtgcatgaagctgtcaaagtttgtgcagagttgagacccactgttgacatctcagtgcccgctgatgctgtatttt

SEQ ID NO: 2229 - DNA, 2066 bp, Gossypium hirsutum
atcatttctacttctgttacgatgcggctactaccttctctcctccttctccactccctcgctcaattcttcctccagaacccacaaaactttaaccacccctaatctaggcttcttggcctcagtgtcgagatccttgaggtctctcaaagcaaccaggctgactactgataatgcttgtggctcagctatggcctctcgtatggtctccattcctgctgtccagacacacatatctctcgattttgagacctctgtcttcaagaaggagaaagtctccctcgctggtcaggacgagtacattgtgagaggaggaagagatttgtttaagttgctgcctgacgctttcaaagggattaagcagattggtgttattggctggggctcccagggacctcctcaagctcaaaatttaagggattctcttgctgatgcaaaatctgatatcattgtcaaggttggactcaggaagggttctcgttcttttgatgaagctcgtgctgctgggttctctgaagagaatggcactttgggtgatatatgggaaactatttctggaagtgatcttgtgttactgttaatttctgatgctgcacaggcagacaattatgagaagatattctcctacatgaaaccaaatagcatcctggggctttcacatggctttcttgttggacacttgcagtcaaagggacttgattttccaaagaacattagtgtaattgctgtgtgccccaaaggaatgggtccatctgtaaggagactctatgtccaaggcagggagatcaatggtgctggaatcaattctagttttggagtccatcaggatgttgatggtagagctactgatgttgccttggggtggtcggtcgcccttggatcacctttcacctttgctactactttagagcaggaatacaagagtgacatctttggggagcggggcattcttcttggtgctgttcatggaattgtggagtgtttgtttagaagatacactgaaaacggaatgagcgaggatcttgcttacaaaaacactgttgaatgcattacaggaattatatcaaagaccatctcaacaaagggcatgttggctgtatacaactccttgtccgaagagggaaaaagggaatttgagactgcctatagcgcatcttattacccgtgcatggatatactgtatgagtgctatgaagatgtagccagcggaagtgaaatccgcagtgttgtattggctgggcaacgattttatgagaaggatggtctccctgctttcccaatgggaaaaattgatcaaacacgcatgtggaaagtcggtgagcgagtccgaaaggcacgcccatctggtgatttagggccattgtatccatttactgccggtgtctatgtggccttgatgatggctcagatcgagatattgaggaagaaaggacactcgtactctgagatcatcaacgagagtgtgatagaggcagtggattcgttaaatccatttatgcatgctcgtggagtttctttcatggttgacaattgctctacaacagcacgattgggatccaggaaatgggcccctcggttcgattacatcctaacccaacaggctttggtgactgtcgataatggcactcccatcaaccaggatctgcttagcaacttcttgtcagacccagtgcatggtgctatcgaagtttgtgctcaaatgaggccaacggttgacatttcagtgcaccctgatgctgattttgtgcgaccagagttgcgtcaatctggcaattgagtaggtggaatcttggaacttgagtgggcagctatagtgtgtttaagccaaaactttcacctcgtttataaatgagtgatgtagttttagctatgtctttagggtgtttgaacactaatggcactagattcccttttttttttttcttccttatcagcctcttctttgatatgactcctttggatttactcttgagaatgcttttggtgaatcttttagactgctttttgaaagttttgttgaagttatatatgagtaagcaaaacagtttattgttggaaaaaagaaa

SEQ ID NO: 2230 - DNA, 2330 bp, Beta vulgaris
gctctactctttcgaccctccgccactttttctcatccctttctctctcctctcctgcaacacctcttacctaaaatactaaaagcatccttcaatggcggctaccgcagcaacttcattttctctctcctcctcatcttcctccgtccccgtacccaaactccttaaaccttcggcgttgaatctagggtttctcggctcgtcttcttcaaataccgcattgaactctcttaaggttcgtgcttttccttctagagctactaacaatggaggatcggcgctctctactcaaatggtttcagctccttcttctatcaatccaccttcatcagctacttttgactttgagagttctattttcaacaaagagaagattactctctctggtcatgacgagtacattgtgaggggagggaggaatttgttccctcttttgccggatgcttttaagggtgttaagcagattggtgttattggatggggatctcaggccccagctcaagctcagaacttgaaggattctctaactgaggcaaaatctgacattgttgtcaagattggtctccgcaaaggatctcgctcttttgctgaggcacgtgctgctggttttagtgaagagaatggcactctgggtgagatgtgggagactatttccgagagtgatcttgtgctgctgctaatttcggattcagctcaggctgataattacgaaaaggttttctcccatatgaaaccaaacagcattcttgggctctctcatggatttcttttggggcatctgcaatctctggggcaggattttcccaagaacatcagtgtgattgctgtatgccctaagggaatggggccttctgtaaggaggttgtatgttcagggtaaagagatcaatggtgctggaatcaactctagttttgccgttcaccaggatgttgatggtagggctacaaatgtagcacttgcctggtcggttgctcttggctcacctttcacatttgccactactcttgagcaggagtacaagagtgacatttttggggagcgaggtatcttgcttggtgctgttcacggaattgttgagtgcttgttcagaaggtacacggataatggaatgagcgaagatttagcctacaagaacactgttgagtgcatcactggggttatatcaaagaccatctcaacaaagggaatgctgtccctgtacaattctttgtcagaagaaggaaaaaagaattccaagctgcttacagtgcctcattttacccttgcatggacattctgtacgagtgctatgaagatgttgctagtgggagtgagatccgaagtgttgttttggctggacggcgcttttatgagaaggaagggctcccagcttttccaatgggtaatatcgatcaaacccgcatgtggagaattggtgagaaggtcagagcagttagacctgcaggcgacttaggcccattgtatccatttactgctggggtctatgttgctctaatgatggcccagatagagattttgaggaaaaagggtcactcctactctgagattatcaacgagagtgtgattgaagcagtggattctttgaaccccttcatgcatgctcgaggtgtctcatttatggtcgacaactgctcaactacggcaaggcttggatcaagaaaatgggccccccgttttgattacatcctgaaccaacaagctatggtagctgttgacaatggtgcttcaatcaaccaagacctgatcagcaatttcttgtcagatcccgttcatgaagcgattggagtttgcgcgcagctcagaccttctgttgatatctctgtgactgctgatgctgattttgtccgccctgaactgcgccaggctagcagttaaaagctcccaaggtctctaagtcataagtattaggtatggagatataaaactcccaagtttattgtactctaggttttagcttttgctgtccaatgaaatgagacgcgtgatattttctccaagttttggctagagtttacgggttaatttgggacatgggagagtgctttgtctaacttatatgttgtaatgtggtatgtctcggcaatttccaccttctagttgttcttggttcatgtgattctgtaggaaataaatatcacttaaattaaccaataatttttacagatgaatagccaagaggttccatcccacatgaaaatattgtctgatatatgcttttcacccctttctttgtaaaaactcttctatcttcttccacttaactgagcaccgggtaatcaccacctcgagactgccagccatctccattgctctacaccaccagtctgtcc

SEQ ID NO: 2231 - DNA, 2172 bp, Gossypium hirsutum
cctaagtcctgttcgaaaccgtctctcacaccagctttcgtctttcagcaatggccgccaccactacaaccacttcctttaaagccgcactcctttctacaccgtcgatatcttcatcgaccaaatcaaccgtcctcaaaccacgctttacatcatcatcgtcctcacggtattcgccgattccaaaatcactgatagctcatcatgtctctacaaagaccaacgccatcgtcgccaagatggggacagtcccttcgccagtttctgagacgacatcgcttgacttccatacctccgttttccagaaagaaaagatctctcttgctggtcacgaagagtacattgtgagaggaggacggcatttattccctttattggatgatgcttttaagggaatcaaacagattggtgttattggttggggttctcaggggccagctcaagcacagaatctgagggattctcttgcagaggcaaaatctgatgttgttgtgaagattgggttgaggaaaggctctcgctcctttgctgaagcccgtgctgcaggatttactgaagagaacggaactctgggggacatatgggaaactgttgctggaagtgatctcgtgttattgttgatctctgattctgcacaggcggataattatgaaaaggtcttctcccacatgaagccaaatagcatccttgggctttcccatggatttcttcttggccatttacaatcgttggggcttgattttcctaagaacatcagtgtaattgctgtctgcccgaagggaatgggaccttctgtgaggaggctttatgttcagggaaaagagataaatggcgctggaattaatgctagttttgctgtccatcaggatgttgatggtagagctacagatgtggccttgggatggtcggttgcccttggttctccgtttacattcgccaccacattagagcaggaatacaaaagtgacatttttggggagagaggcatcttgctaggtgctgttcatggggttgttgaatgcttgtttagaaggtatgtggaggatggaatgagtgaagaattggcttacaaaaacactgttgagtgcataacaggaattgtgtcaaagaccatttcaacaaagggtatgctagctgtatacaactcattgtccgaggaaggaaaaaaacgatttgaggccgcttacagtgcctcatattatccttgcatggaaatcctatatgagtgttacgaagatgttgcaagtggaagcgagattcgcagtgttgttttggctgggcgtcggttttatgaaaaggagggtctacctgccttccctatgggtaaaattgatcagacacggatgtggaaagttggtgagcgtgtccgagcaactagagcgaaagatgatttaggtccactgtgccctttcacttctggggtttttgtggcgctaatgatggcacagatcgaggtcttgagaaagaagggccactcgtactcagaaatcatcaatgagagtttgattgaagctgttgattccttgaaccccttcatgcatgctcgaggagtttctttcatggttgataactgttccacaaccgcacgattgggatcaagaaaatgggctccacgttttgattacaaccttactcaacaagcattcgtagcagtggattcaggtgctcccatcaaccaggacctgataagcaacttcttatctgatcctgttcatgaagctatcgaagtctgtgcaaagctaagacctactgttgatatatcagtgcccccagatgcagattttgttcgtcctgaattgcgccaatctagctagactggaagagaatattttctcatggacgaggctgttttgcagtaaatcttaatttagttttgctacatgtgaagaggaggataagtttttatggctgtcttagtttgtgtttggtttaagaggaggataagtttctatgacctgttagtttatgtttggtttaaaagaattatgtaaggtgaacttcttaagattcatgagttgcttatctgcaaatggtatggttggcctagcctgttcagtatttgattaattttatgaatttggtggctcagtaaaacttaatgccaaaatgcggtattggcagcctttgtgcgtaggtttagcaatacactgaataaaagaaaatcatgcttgt

SEQ ID NO: 2232 - DNA, 1798 bp, Ambrosia trifida
aaaccctaggtttttcttctcttccaaaccctccattaaacccctcaaagctcgctccaatgggtctgctcttggtgcccgtatggtttcagcaccagccataaccaaaccccctaccctccttgattttgatacctctgtttttaaaaaagaaaagattaaccttgctggtcatgatgagtatattgtgagaggtggacgggatttgttccatttgttgcctgatgcttttaaaggtattaagcagattggtgttattggttggggttctcagggtcctgctcaagctcaaaaccttagggattctcttgcagaagcaaagtctgatattgtagtcaagattggtttacgaaagggttcgagttcgtttaatgaggctcgggctgctggattttcggaagaaagtggaacgcttggagatatctatgagactatctctggtagtgatttggttctgcttttgatttctgattccgctcaggctgataactatgagaaaatcttttcacacatgaagccaaacagcatacttggactttcacacgggttccttcttggtcatctgcaatcagctgggcttgatttccccaagaacataagtgtggttgctgtgtgtcccaagggaatgggtccatctgttaggagactgtatgttcaaggtaaagagattaacggagccggaatcaatgcaagttttgctgtccaccaggatgttgatggaagagccactgatgtcgcacttgcgtggtcagttgctcttggttcgccttttacgtttgccactacacttgagcaggagtataagagtgatatattcggggagcgaggtattttgcttggtgcggtgcatggtattgtggagtctttgtttagaaggtataccgaagatggtatgagtgaagaattggcttacaaaaatacagtggagtgcataactggtactatatcaaggataatctcgactcagggcatgaaagccgtatatgagtcattggacgaagacggcaagaaagagttcttgacagcgtacagtgcatcttactatccttgtatggacattctgtatgagtgctatgaggatgtggccactggcagtgagataagaagcgttgtgttggctggccgtcgattttatgaaaaggagggtttgccagcattccccatgggcaagattgatcagactcgaatgtggaaagtaggtgaaagagttcgggctgtccgacccgcgggtgatttaggccccttgtatcctttcaccgctggtgtctatgtcgcactaatgatggctcagattgaggtgttgagaaagaaaggacattcttattccgagattatcaatgagagcttgattgagtcagtggattcattgaatccgttcatgcatgctcgaggtgtgtcgtttatggtggacaactgctcaacaactgcaaggctgggatcaaggaaatgggctccacggtttgattatattcttacccaacaggctttagttgctgtagacaacaaagccccacttaaccaggacctgatcagcaacttctttgaagatccagtgcgcgacgctgttaaagtttgtgcggagttgagaccgactgttgacatctcagtgcccgctgatgctgattttgtccgacctgagctgcgtcaaggtagcaactgagtatgactcccaggctcttgtctagttaaatctatcatgcgctatgcagattttttttctgtatgtgtgcctagttcttacgaatgttgcattccgacttatgttgaattttgtaataaaagttgttcgtccaaaaaa

SEQ ID NO: 2233 - DNA, 1821 bp, Ambrosia trifida
tcacattcaatcacaccactgacaacagcacacacaccttctcacttaaccccaccacctcctcatcaccttccctcaaaacccttccaaaaccctagcctttttcttctcttccaaaccctccattaaacccctcaaagctcgctccaatgggtctgctcttggtgcccgtatggtttcagcaccagccatatccaaaccccctaccctccttgactttgatacctctgtttttaaaaaagaaaagattaaccttgctggtcatgatgagtatattgtgagaggtggacgggatttgttccatttgttgcctgatgcttttaaaggtattaagcagattggtgttattggatggggttctcagggtcctgcacaagctcagaatcttagggattcacttgcagaagcaaagtctgatattgtagtgaagatcggtttacgtaagggttcgagttcgtttaatgaggctcgggcagctggattttcggaggaaagtggaacacttggagatatttatgagactatctctggtagtgatttggttctgcttttgatttctgattccgctcaggctgataactatgagaaaatcttttcacacatgaagccgaacagcatacttggactttcgcacgggttccttcttggtcatctgcaatcagctgggcttgatttccctaagaacattagtgtggttgctgtgtgtcccaaaggaatgggtccatctgtcaggagactgtatgtacaaggcaaagaggttaacggagccggaatcaatgcaagttttgctgtccaccaggatgttgatggacgagccactgatgttgcacttgcatggtcagtcgctcttggttcaccttttacttttgccactacacttgagcaggagtataagagtgatatattcggggagcgaggtattttacttggtgcggtgcatggtattgtggagtctttgtttagaaggtataccgaagacggtatgagcgaagaattggcttacaaaaatacagtggagtgcattactggcattatatcaaagataatctcgactaagggcatgaaagctgtatacgagtcattggatgaagaaggcaagaaagagttcttgacggcatacagtgcatcctactatccttgtatggacattctgtacgagtgctatgaggatgtggcgaccggcagtgagataagaagcgttgtgttagccggccgtcgattttatgaaaaggagggtttgccagcattcccgatgggcaagattgatcaaactcgaatgtggaaagtaggtgaacaggttcgggctgtccgacccgcgggtgatttaggccccttgtatcctttcaccgctggtgtctatgtcgcgctaatgatggcccagattgaggtgttgaggaagaaaggacattcttattctgagattatcaatgaaagcttgattgagtcagtggattcattgaacccgttcatgcatgctcgaggcgtgtcgtttatggtggataactgctcaacaactgcaaggctgggatcaaggaaatgggctccacggtttgattatattcttacccaacaggcgttagttgctgtagacaataaagccccagttaaccaggacctgatcagcaacttctttgaagatccagtgcacgatgcggttaaagtttgtgctgagttgagaccgactgttgacatctcagtgcctgctgatgctgattttgtccgacctgagctgcgtcaaggtagcaactgagtatgagtcccaggctattgtctagttaatctgtcatggtgctatgcagtattttttttcggttatctgtg

SEQ ID NO: 2234 - DNA, 1955 bp, Flaveria ramosissima
tccacactcttgtactccaccggcgtcactcatggcggccgccgcacctaccttctcctccgccgcacctaccaccgtctctccgtcgtcgtcgtcttcaccgactctcaaaaccgcccctcaaaccctaggtttcaccacagcgtttctatcatccaaaacgtcattcaaatcgcttcaaactcgcctattaacttcccacggtggctccggctccgccctcggagctcgtatggttgcagtgccggtgatcagcaagtctccggcgtctctcgatttcgatacgtcggttttcaaaaaggagaaagtcaacctcgctggtcatgaagagtacattgtgagaggaggtagagatttgtttcatttgctgcctgatgcattcaaaggtattaagcagattggcgtgatcggttggggttctcagggtcctgcacaggctcagaatttgagggattctcttgcagaagcaaaatctgatattgtagtgaagattggcttaaggaagggttcgagttcatttgctgaggcgcgtgctgctggtttcagtgaagaaaatgggactcttggagatatttatgagactatttctggtagtgatttggtcctgctcttgatatctgattcagctcaggctgataattacgagaaaatcttctcccacatgaaaccaaacagcatccttggactttcccatggtttccttcttggtcatttacaatcaatcggtcttgatttccccaaaaatgtcagtgtggttgctgtgtgtcccaaaggaatgggtccatcagttagaaggctatatgttcaaggaaaagagatcaatggagctgggattaatgcaagttttgctgtccatcaggatgttgatggcagagccactgatgttgcacttggatggtctgttgctcttggttcaccttttacatttgctactacactagaacaagagtataaaagtgatatatttggagaaagaggtattttacttggtgctgtgcacggtattgtggagtcgttatttagaaggtacacagagcaaggtatgactgaagatttggcttacaagaacactgtagaatgcataacaggagtaatttcaaaaaccatatcgtccaagggtatgaaagctgtttatgagtcactctcagaagaaggcaaaaaagatttcttgattgcatacagtgcttcttattatccctgcatggaaatcttatatgagtgttatgaagatgtggccagtggcagtgagattaggagtgttgttttggccggccgccgcttttatgaaaaagagggtctcccagccttcccaatgggaaaaattgatcagacccgcatgtggaaagttggcgaacgggttcgtgctacacgacccgatggtgatttaggcccattatatcctttcaccgcaggtgtctacgtggcactaatgatggcccagattgaggtattgaggaagaaaggacactcttattctgaaatcatcaacgaaagtttaatcgaatctgtggattcattgaaccctttcatgcatgctcgaggtgtttcattcatggtggacaactgctccaccactgcacggttagggtcaaggaaatgggctccacggttcgactacaacctgacccaacaggccttggttgcagtagacaatggcaccccagtgaaccaggaccttgttaaagccttctttgaagatccggttcatgaagcggtcaaagcgtgcgccgagttgagacccacggtcgacatctcgggtgcctgcagatgctgtattttgtgagacctgagctgcgtcagtctagcagctaaggaaagggatggtttaagttatttactattttacacatgccatggtgttatgtatgaaggtttgtttgttatggatatgtattttggtggtttgttgaattttggtaattctagaataatggtggtttggtgaaaaaaatatt

SEQ ID NO: 2235 - DNA, 1796 bp, Lactuca sativa
gccgtttctcctcgtctattacacgataatggcggcggcggcaacaactctctttctcaaccttggcacctaccgcttcgtcgtcggcagcatcggcttctctcaagctcgccccccaaaccctagggtttaatgtcggctttctgtcttccaaaacttcctccaaatccctcaaagctcgctctaatggcagttctggatctgctctcggggctcggatggtttctgccccagcgataactaagcctccgacgctgcttgattttgaaacctctgttttcaataaggagaagattaaccttgctggttatgacgagtatatcgtgagaggaggaagagatttgttccatttgttgcctgatgcctttaaaggtatcaaacagattggggttattggatggggttctcagggtcctgcacaagctcagaatcttagggattcccttgtcgaagcaaaatctgacatcgtagtgaagattggattacgaaagggttcaagctcattcaacgaagctcgtggtgctggtttctctgaagaaaacggaactctcggagacatttatgaaaccatctccggcagtgacctggttctgctcttgatatccgattcagctcaggctgataactatgagaaaatcttctcacacatgaaaccaaacagcatccttggactttcccatggattccttcttggacaccttcaatcagctggacttgatttccccaagaacataagcgtggttgctgtttgccccaagggcatgggtccatcagtaaggagactgtatgttcaaggaaaagagatcaatggagctggaatcaatgccagttttgcagttcatcaggatgttgatggaagagccactgatgttgcacttgcatggtctgttgcccttggttctccttttacattcgccaccacacttgaacaggagtacaagagtgacatatttggggaaagaggtattttacttggtgctgtgcatggtattgtggagtctttgtttagaaggtatacagaaggtggtatgagtgaagatttggcttacaaaaatacagtcgaatgcatcactgggaacatatcaaagacaatctcaactcagggaatgaaagctgtgtatgagtcattaacagaagaaggcaagaaagaattcttaacagcatacagtgcctcatactacccttgcatggacattttatacgagtgctatgaagatgtagcaagtggcagtgagataagaagtgttgtgttagctggacgtcgattttatgaaaaagagggattaccagctttccccatggggaaaatcgaccagacccgtatgtggaaggtcggtgaacgggtccgtgctagccgacccgcgggtgatttgggtccgttgtatcccttcacagcaggtgtctatgttgcactgatgatggcacagattgaggtgttgaggaagaaggggcactcatactctgagattatcaatgaaagtttgattgagtctgtggattctttgaacccgtttatgcatgcgcgaggtgtgtcgtttatggtggacaactgttcgacaactgcaaggttggggtcgaggaagtgggccccacggtttgactatattttgacccaacaggctttggtggcggttgacaatgggagcccgcttaaccaggatctgattagcaacttctttgaggacccggttcatgaagcggttaaggtgtgtgctgagttgagaccaacaattgacatatcggtgcctgttgatgctgattttgtgagacccgagttgcgacaagcgagcaactag

SEQ ID NO: 2236 - DNA, 1699 bp, Pennisetum glaucum
gcgccggccgtcggcaaggccatgccgtcgctcgacttcgagacctccgtcttcaacaaggagaaggtctcgctcgccggccacgaggagtatatcgtgaggggcgggaggaacctgttcccgctgctcccggaggcgttcaagggggtcaagcagatcggagtgattggatggggctcccagggtcccgcccaagctcagaacctgagggattcactggcagaagcaaagtcggacattgttgtcaagattggtctccggaaaggttccaaatcgttcgaggaagcacgtgctgctggattcactgaagagagtggtacactgggtgatatttgggagactgtttcaggaagcgaccttgtgttgctattgatatcagatgctgcacaggcagacaattatgagaagatcttctcatacatgaaaccgaacagtatccttggtttatcccatggatttcttttgggacatctgcaatcgcttggacttgatttcccaaagaacatcagtgtgattgctgtatgtcccaagggaatgggtccatctgtccgcaggctttatgtccagggcaaagaagtaaatggtgctggcatcaactctagctttgctgtgcaccaggatgttgatggaagagcaactgatgttgctctagcatggtcagttgcgcttggctctcccttcacatttgctaccacattggaacaggagtacaagagtgatatctttggagagcgaggcattttgctgggtgctgtccatggcattgtggaggctctgttcaggaggtacacagagcaaggaatggatgaagagtcagcctacaaaaacactgtggagggcatcactggaattatttcgaagaccatctcaaagaaggggatgcttgaagtctacaactctttaagcgaggaaggcaagaaggagttcaacaaggcttacagtgcctcgttttatccttgtatggatatactctatgagtgctatgaagatgtggcctctggaagtgaaatccgcagcgtggtgttggctgggcgaagattttatgagaaagagggtctcccagcttttccaatgggcaacattgatcaaactcgcatgtggaaggtgggtgagaaggtgcgctcgacccgtccagagggcgatcttggcccgctgcatcccttcactgctggagtgtacattgccctgatgatggctcagattgagatcctgaggaagaagggacactcctactcggagatcatcaacgagagtgtgatcgagtcggtggactcactgaaccccttcatgcacgcccgcggggtggccttcatggtggacaactgctccacgacggctcgcttgggatctaggaagtgggctccccgcttcgactacatcctgacgcagcaggccttcgtgacggtggacaaggacgccccgatcaaccaggacctcatcagcaacttcatgtcggacccagtccacggcgccatcgaggtctgcgccgagctgaggcccaccgtggacatctccgtgcctgccaacgctgacttcgtgcgcccggagctccggcagtcttcctagattgtgagtttgcctccgagttaagagtagtgttgtgtctgttgagcacttgagcgactgcttgaagtctgaacgactgaacctgtgtgagctgctaccttgggacctgaggaagcttgggtatctgttttct

SEQ ID NO: 2237 - DNA, 1763 bp, Brassica napus
cgtctcgtctacttcaaagtctctgaggtcgctcactgccaccgtccctggaaatggaaccggatcttccctctccgcgagaatggttgcgtcgtctgcggtcagagcacccgtgtctctcgatttcgagacgtctgtgttcaaaaaggagaaagtctctctcgctggctacgatgagtacattgtgagaggaggaagggacttgttcaagcatcttcctgatgctttcaaagggattaagcagattggtgtcattggctggggctctcagggacctgctcaagctcagaatctaagggattcacttgtggaggctaagtctgacattgttgttaagattgggcttagaaagggatctaaatcgtttgaggaggcacgtgctgttggcttcaccgaagagagtggtactttgggtgatatatgggaaactatctctggcagcgatcttgtattgcttttgatctctgatgctgctcaggctgataactatgagaaaatattctcacacatgaagccaaacagcattctcggcttgtcacacgggtttctactagggcatttacagtcaatgggacttgatttcccaaagaacatcagcgtggtagctgtttgccctaagggaatgggtccatccgttaggaggctttatgtccaaggcaaagaaatcaacggtgctggaatcaacgctagttttgcagtccaccaggatgttgacggtagagccgctgatgttgctctgggatggtcagtagcacttggttctccttttacttttgctactactcttgagcaagagtacaagagtgacatcttcggagaaagaggtattttgcttggtgcggttcacggaatcgtggagtctctctttagaaggtacactgaaaatggaatgagcgaagacttagcttacaagaacacagtagagtgcatcacaggaacaatctcaaggactatctctactcagggcatgttggctgtctacaactacttgtctgaagaaggcaaaaaggacttcgagactgcatacagtgcatccttctacccttgtatggagattctctacgaatgttacgaggatgtagcagctggcagcgagatccggagtgttgtcttggccggtcgtcgcttctatgataaggagggattgcctgcattcccgatgggtaagattgatcagacaagaatgtggaaggtcggtgaacgtgtcaggaagtccagaccagctggtgacttgggtccgttgtatcccttcaccgctggagtttacgttgcccttatgatggctcagattgagatcttgaggaagaagggtcactcatactcggagatcatcaacgagagtgtgattgaatctgttgattctctcaatccgtttatgcacgctagaggagtgtccttcatggtggacaactgctcgaccacagcgagattgggatcgaggaaatgggcaccgaggttcgactacaacctgactcaacaagctttggtggctgtggacagtggtgcaccaatcaacaaagacttgataagcaacttctttgctgatccagtccatggtgctatcgaggtctgtgcacagctcaggcctaccgttgatatctctgtgcctgaagatgcagattttgttcgacctgagctgcgtcagtctagctgagtgaagggttgaatgattattatcagtttcttttgatgtaacgtttaaaaacaaggcaaaaggtttgaggtttaggcgtgagtgttcgtttggacggtttgaataatga

SEQ ID NO: 2238 - DNA, 1882 bp, Chelidonium majus
aagtgagtgggagagttggggaggtctcttgaataccccccgagtgttatctgttcttatctcttatctgtaatttcccttgaatcatcatcaataaaaccctaattccatttacagttcttatcagatggtttcagtgcctgcggtcaagcccttgactactctagattttgaaacctctgtcttcaataaggagaaggtcacacttgctggtcatgacgagtatattgttaaaggaggaagggatttgttccatttgttgccggatgctttcaagggaattaagcagatcggagttattggttggggttctcagggacctgcccaagctcagaacttgagggattcacttgtagaggcaaagtctgacattgttgtcaagattgggttgaggaagggctcccgttcttttgctgaagcacgtgctgctggttttactgaggagactgggacactgggggatatatatgaaactatctcaggcagtgatctcgtgttgctattgatttctgatgctgcacaggcagataattatgagaaaatattctcccacatgaagcctaacagcatacttgggctctcccatggatttcttcttggacatttgcagtccttggggattgatttccccaagaatattagtgttattgctgtgtgccccaagggaatgggtccatctgtaagaaggctctatgtacaaggcaaagagataaatggtgctggaattaatgctagctttgctgtccaccaggatgttgatggtagagcaacagatgttgctctagggtggtcagttgctcttggttctcccttttcatttgccactactctagagcaggagtacaagagtgacatttttggtgaacggggcattttactcggagctgttcatggagttgtggagtccttgtttagaaggtacactgagaacggaatgaatgaagaccttgcttacaagaacactgttgagtgcatcactggaattacatcaaagaccatctcaactgagggcatgctagctgtatacaactctttgtcagaggaaggtaaaaaggactttcaaactgcatacagtgcctcatattatccttgtatggagatattgtacgagtgctacgaggatgtagcttgtgggagtgagatccggagtgttgtcttggctgggcgtcgattttatgaaaaggagggcctaccagcttttcctatggggaagatcgatcaaacacgaatgtggagagttggtgaacgagtccgttcaacacgacaagcgggtgatttgggtctgatgtatcccttcactgctggagtttacgtagctttaatgatggctcagattgaggtattgaggaagaaggggcactcttactcagagatcatcaacgaaagtgttattgagtcggttgattctttgaatcccttcatgcatgcacgtggagtctcctttatggttgataactgttccacaacagcacgattggggtcgaggaagtgggctccacgatttgactacattctcactcaacaggccttggtggcagtcgacaataatagtcccatcaaccaggaccttattagcaacttcttgtctgaccctatccacggggcgatcgaagtttgtgcccaattgagaccaactgttgacatatctgtgccagcaaatgcagattttgtaaggccagagcttcgtcagtctagcaattaaacttggaagagagtcaacgatgaccctttttaaagggacatcttgagtaagtacccgaaggcttttaccaatttagttatccagtgtgatttgcatgatatgagctctgtaagttgtcatgtatgttttgttttcttgaatatatctgaataattggtatggtatctttatttcaatttt

SEQ ID NO: 2239 - DNA, 1862 bp, Momordica charantia
tggtgtccgtgcctgcgattaagccctttaactttcgtctttcgttattttgacgcatctgtcttcaagaaggagaaagtcaatctcgccggccacgacgagtatattgtgagaggaggtagggatctttttcccttgctgccggaagcattcaaggggatcaagcaaattggtgtcattggctggggttctcagggacctgcacaggctcagaatttgagggactcgcttgctgaagctaagtctgatattgtggttaagattgggctgaggaagggctcccgttcttttgcagaagctcgtgcagctggtttctctgaagagaatgggactttgggtgatatctatgaaactgtttcgggaagtgatcttgtcttgcttctgatttctgattctgcacaggctgataattatgaaaaaatattctctcacatgaaaccaaacagcattcttgggctttcccatgggtttcttcttgggcatttgcagtcattggggcttgatttccctaagaattttagcgtgattgctgtttgtccaaaggggatgggtccatctgtgaggagactttacgttcaaggaaaagagataaatggtgcaggaattaattctagttttgcagttcaccaggatgttgatggtagagccacagatgttgcgttgggatggtctgttgcccttggctctccattcacatttgctacgtctctagagcaagaatacaagagtgacatctttggcgagcgaggcattctacttggtgctgttcatggaattgtggagtccttgtttagaaggtacactgaaaatggaatggctgaagagctggcttataagaacactgttgaatccataacagggattatatcaaagaccatttccactaagggaatgttggcggtgtacaattctttctctcctgatgagaaaaaggaatttgagaaagcatatagtgcatcatattatccctgtatggatattctctacgaatgttatgaagatgtagctagtggaagtgagattcgcagtgttgtgcttgctggacggcgattttacgaaaaggaaggtttaccagctttcccaatggggaaaattgaccaaacccgaatgtggaaggtcggtgaacgtgtccgccaagtacgtcctgcaggtgaccttggcccgctacatcctttcactgctggtgtatatgtggcattgatgatggcgcagattgagatactgaggaaaaagggacactcttactctgaaatcatcaatgaaagcgtgatcgaatcagtggactctctgaacccattcatgcatgctcgtggggtttcatttatggtcgacaactgctccacaaccgcacgattgggatcacgaaaatgggctccacgttttgattacattgtcacccaacaagccctggtcgccatcgacaacggttcagctgttaaccaggacctcatcagcaacttcctgtctgacccagttcatggagcaattgaaacatgcgcccagttgagacctaccgtcgacatttctgttccacctgatgccgattttgttcgcccagagcttcgtcagtctggcaactagaaactgccaacaataggaggcccttgaattgagttggtcgatctcgtcgaaggaactgctgtatgtatctttgaatatgtagcgttatttcgattttcttcaaggtctaagtttaatatctatggtaagtagtatcaaacttatgttactgagctgagtagtagttaataagttatgttctaaaattgctgtggtcattttgtttaagctgttgctgtgtacacttgcgggatcacatcagagaactctcagttgctacatttatgtcatcttagatttat

SEQ ID NO: 2240 - DNA, 1832 bp, Fagopyrum esculentum
tgctctctctgctcgtatggtctccgtgtcaccctcggtcaagtctgccacgattcttgattttgaaacctccgcgtttcagagggagaaagtcagccttgctggccacgatgagtatattgtgcgaggagggaggcatttgtatcctctattgccagaagcttttaaggggattaaacagattggagttattggttggggatctcagggtcctgctcaagcccagaatctgagggattccttggctgagatcaagtcagatattgtggtgaagattggcctgaggaagggatctagttcttttgctgaggctcgtgctgctggattcacagaagagactggatctttgggtgaaatgtgggaaactatctcttctagtgaccttgttatgttattgatctccgatgctgcccaggctgattgttacgagaaagtgttctcccacatgaagccaaacagcatcttgggattgtcccatggattcttgctcggccatctgcagtcaattggacaggatttccccaagaacatcagtgttgttgccgtatgtcccaagggcatgggtccatcagtgaggaggttgtacgtacagggtaaagagattaatggagccggtattaatgctagttttggtgtccaccaggatgttgatggaagagcaactgatgttgcactcgggtggtcagttgcccttggttctcctttcacttttgccactaccttggagcaagagtacaaaagtgacatctttggggagagaggaattctgctcggtgctgttcacggtattgttgaatccttgtttagaagatacactgaaaatggaatggatgaagaccttgcctacaagaataccgttgagagcataacaggaactatctcaaagacaatttcaacccagggaatgctggctgtatacaatgctttgtcagagcaaggaaagaaggaatttgaggctgcatatagcgccgccttctacccttgcatggacatcttgtatgaatgttacgaagatgtggccagtggcagtgagattcgcagtgttgtcttggctggacgtcggttctacgagaaggaaggtcttccagctttccccatgggcaaaattgatcagaccagaatgtggaaggtcggtgaacgtgttagatccacaaggccagcaggtgaccttggtcctctgtaccccttcacagctggtgtctttgttgcttgtatgatggctcagattgaggtcttgaggaagaagggacactcatactccgagatcatcaacgagagtgtgatcgaatccgtcgactccttgaacccattcatgcacgcccgaggcgtttccttcatggttgacaactgttcgaccacagcaagactgggatcccggaagtgggccccaagattcgactacatcctaacccaacaagccctggttgcagtcgacaaaaacgctccagttaaccgtgacctcatcagcaacttcttgtcagacccggttcacggagccattgaggtctgtgctcagctaagacccaccgtggacatctctgtcaccgctgatgccgactttgtccgcccggagctgcgccaatctggcaattgaaatttgccttgaacgctttttccatattgtatgtcatattagattatgcttcatgctcttgctaatttatgttatgctcgaggaactctgttctttcccttcagttttttttccagagttttttttgcctactttagttataatctttagtgtcctgttcaaatcatacgctgtatgtcaaagattatgttatgtgatcttgcctttaccttcatagtgatgggataaataagattct

SEQ ID NO: 2241 - DNA, 1765 bp, Flaveria ramosissima
tcaaccttaacacccaccacctcatcgtcaacagctgcaccatctctaaagtgctccaaacctagggtttaacgtcggattactctcctccaaaacaacattcaaatcactcaaagctcgatccaatggcggatccggatccgctctcggggcccgtatggtctcagctccatcaataacccgacccacgcttcttgatttcgaaacctctgtgttcaaaaaggagaagattaaccttgctggtcatgatgagtatattgtgagaggaggaagagatttgttccatttgttgcctgatgcctttaaaggtatcaagcagattggtgttattggttggggctctcagggtcctgctcaagctcaaaaccttagggattctcttgcagaagcaaaatctgacattgttgtgaagattggtttacgaaagggttcgagttcgtttaatgaggctcgtgctgctggatttactgaagaaactggaactcttggagatatctatgagactatctcggggagtgacttggtcctgctcttaatttcagattcagctcaggctgataactatgagaaaatcttttcacacatgaagccaaacagcatacttgggctgtctcatgggtttcttcttggtcacctgcaatcagctggtcttgattttcccaagaacataagtgtggttgctgtgtgccccaaaggaatgggtccatctgtcaggaggctgtatgttcaaggaaaagaagtaaatggagctgggatcaatgcaagttttgctgtccatcaggatgttgatggaagagccactgatgttgcccttggatggtcagttgctcttggttcaccttttacatttgcgactacactcgagcaggaatacaggagcgatatatttggcgagcgaggtattttacttggtgcggtgcatggtattgtggagtcattgtttagaaggtataccgaaggcggtatgagtgaagaattggcttataaaaatactgtagagtgcataactggcataatatcaaagaccatatcaactcagggtatgaaggctgtatacgagtcattgtctgaagaaggaaaaaaagagttcttgacagcatacagtgcctcttactatccttgtatggacattttgtacgagtgctatgaggatgtagcaagtggtagtgaaataagaagcgttgttttggctggtcgtcgattttatgaaaaggagggtttgccagctttccctatgggaaagattgatcagactcggatgtggaaagtaggcgaacgggttcgggcggtccgacccgctggtgatttaggtccattatatcctttcacagctggtgtatatgttgcactaatgatggcccagattgaggtgttgaggaagaaaggacattcttattctgagatcatcaatgaaagtttgatcgagtcagtggattccctgaacccgttcatgcatgctcgaggcgtctcctttatggttgacaactgttcaactactgcacggttgggatcaaggaatgggcgccacgctttgattacattcttacccaacaggctttagttgccgtagacaatggacgccccactaaaccaagacctcatcagcaacttctttgaagcccgtagcatgaagctaggtctaaagtttgtgcagagttacgacgaaccccattggttgacattcgtcggtcgccgtgctggatcggcttgtagttttcgtacacgaccccgtagttcggccgttacaacttcgtaacgctaaacg

SEQ ID NO: 2242 - DNA, 1560 bp, Brassica juncea
tctctcgatttcgagacgtctgtgttcaaaaaggagaaagtctctctcgctggatacgatgagtacattgtgagaggaggaagggacttgttcaagcatcttcctgatgctttcaaagggattaagcagattggtgtcattggctggggatctcagggacctgctcaagctcagaatttaagggattcccttgtggaggcaaagtctgacattgttgttaagattgggcttagaaagggctctcgctcatttgaggaagcacgtgctgttggcttcaccgaagaaagcggtactctcggtgatatatgggaaactatctctggcagtgatcttgtgttgctcttgatctctgatgctgctcaggctgataactatgagaaaatattctcccacatgaagccaaacagcattctcggtttgtcacacgggtttctactgggccatttacagtccatgggactcgatttcccaaagaacatcagcgtggtagctgtctgccctaagggaatgggtccatctgtgagaaggctttatgtccaaggaaaagaaatcaacggtgctggaatcaacgccagttttgctgtccaccaggatgttgacggtagagccgctgatgttgctttgggatggtcagtagcacttggctctccttttacttttgctaccactcttgagcaagagtacaagagtgacatctttggagaaagaggtatcttgcttggtgcggttcacggaatcgtggagtctctctttagaaggtacaccgagaatggaatgagtgaagacttggcttacaagaacacagtagagtgcatcacagggacaatctcaaggactatctctactcagggaatgttggctgtctacaactccttgtccgaagaaggcaaaaaggatttcgagactgcatacagtgcatcattctacccttgcatggagattctctatgagtgttacgaggatgtagcagctggcagtgagatccggagtgttgtcttagccggtcgtcgcttctatgataaggagggcttgcctgcattcccaatggggaagatcgatcagacaagaatgtggaaggtcggtgaacgtgtcaggaagtcaagaccagctggtgacttgggtccgttgtatcccttcaccgctggagtttacgttgcccttatgatggctcagatcgagatcttgaggaagaagggtcactcatactcggagatcatcaacgagagtgtgattgaatctgttgattctctcaatccgtttatgcacgctagaggagtgtccttcatggtggacaactgctcgaccacagcgagattgggatcgaggaaatgggcaccaaggttcgactacaacctgacgcaacaagctttagtggctgtggacagtggtgcaccaatcaacaaagatttgataagcaacttctttgctgatccagtccatggtgctatcgaggtctgtgcacagctcaggcctaccgttgatatctctgtgcctgaagatgcagattttgttcgacctgagctgcgtcagtctagctgagtgaatggttgaatgattatc

SEQ ID NO: 2243 - DNA, 1963 bp, Tropaeolum majus
acacccaaattccatctttgagcaaatacctaaacccccatttctgagcatccaccccaacaacaatggccgccgcttcgtttacacactcacccatctcacagttaacatcatcttcatcatgtaggactaagctctctggaatcaagccagggtttgtagtgacatctccatcatcctcatcatcatactcaccctctctaaaccatctgaagctccgtatcccatccgccgattcttcttcactcggaaggtcttcgatctccgccaaaatggtcgccgctcctgctgttggaggtcttacgaagacttttgatttcgagacgtcggttttcaagaaggagaaggtcactctcgctggacaggaggagtatattgtgagaggagggcgagatttgttccatttgttgcctgatgctttcaaggggattaagcagattggtgttattggttggggatctcagggtcctgcccaagctcaaaacttgagggattctttggtagaagctaaatctgacattgttgtcaagattgggttgaggaagggctcatcttcttttgctgaagcacgttctgctggattcagtgaagagaatggaactctgggtgacatctatgaaactatttcaggcagtgacctcgtgatgttattgatctctgatgcagctcaggctgacaactacgagaagatcttctcccacatgaaacccaacagcatccttgggctatcccatgggtttcttttgggtcatttacaatccttggggctcgactttcccaagaacatcagtgtaattgctgtttgcccgaaaggaatgggcccatctgtgaggaggttgtatgttcaaggtaaagaggtgaatggtgcaggaatcaatgccagtttcggtgtccaccaggatgttgatggtagagctactgatgttgccttgggatggtctgttgctcttggatctccattcactttcgccaccacattagaacaggagtacaaaagtgacattttcggggagcggggcattttgctcggtgctgttcacggagttgtagagtgcttgttcagaaggtatgtcgaccaaggaatggcagaagacgaggcttacaagaacactgttgagtgcatcaccggaaatgtttcaaagaccatctcgacaaagggtatgctggccttgtacaactctttgtcggaggatgacaaaaagatcttccaggctgcctacagtgcctcatattatccttgtatggacatcttgtacgagtgttacgaagatgttgctagcggaagtgagatccgaagcgttgttttggctggccgtcgattttacgaaaaggagggtctaccttctttccccatgggtaagattgatcaaacaaaaatgtggaaggttggtcagcgagttcggtcaacaaggccagctggtgacttgggtcctctgcatcctctaaccgctggtgttttcgtggctcttatgatggcacagattgagcttttgaggaagaagggtcactcatattctgaaatcatcaacgagagtgtgatcgaagcagtggattcattgaaccctttcatgcatgctcgtggagtctcgttcatggttgataactgctccacaactgcacgattgggagctaggaaatgggcaccacgtttcgattacgtacttaaccaacaagctatggttgctcttgatgacggtaccccagtcaaccaagacctcgttagcaacttcttgtctgaccctgttcatggagcgattgaagtttgcgcccagttgagacccaccgttgatatttcggtacccgccgatgctgatttcgttcgccctgagttgcgtcaatctagttagaaataaatctgtaccttgggtattaaggttaggagtttggttttttctgagaagcctgaaacgggttttacttattatgttctgttttgttgttaagtttgtattagaagctgtct

SEQ ID NO: 2244 - DNA, 1989 bp, Amorphophallus konjac
cgggccttcaagccctcctctggagcccagggcttccgcctgggcttcctcccgtcgctctccatggcggcaccgcggctcctcgtctcgcggtcccccagcgatgctgttgccgcgaggggcggctccgccctgggtgcccgcatggtctcggcaccctccatccagaagacgtcccttgatttcgagacctccgtcttcaggaaggagaagatcagcctcgccggccatgacgagtacatcgttaaaggaggcagggatctcttacacctgctgcccgacgccttcaagggtatcaagcagataggtgtcattggatggggatcccagggccctgcccaagcacagaacctgagggattccctcgccgaagcaaaatctgacattgtggttaagattgggctaagaaaaggttcacgctcttttactgaggcacgggctgcggggttcagtgaagaaaatggaactctgggtgacatctgggaaactgtttcgggcagtgatcttctgttgttgttgatttctgatgcggcacaggctgataattatgagaaaatattctcgctcatgaagccaaacagcattctcgggctttctcatggctttcttcttggccacttgcagtcacttggccttgattttcctaagaacattagtgtcattgctgtatgccccaaggggatgggcccatcagtaaggaggctttatatccagggcaaagaagtaaatggtgcagggatcaattccagttttgctgttcatcaggatgttaatggccgagccactgatgttgctttgggatggtcaattgctctaggctctccgtttacatttgccaccaccctggagcaggagtacaagagtgacatttttggggagcgtggtattctacttggagctgtacacgggattgtggaagccttgtttagaaggtacactgaaaatggaatgagtgaagaggtggcctataagaatactgttgagtgcattacgggaattatatcaaagacaatttctacaaagggaatgttatctgtttatgactccttatctgtggatggcaagaaagacttccaggctgcatacagtgcatcatactatccttgcatggatattctctacgagtgctatgaggatgttgcctgtggtaacgaaattcagagtgttgttcttgctggtcgacgcttctatgagaaggacggattgcccgctttccctatgggcaagattgaccagacacgtatgtggaaggttggtgagcgagtccgtgcagcacgtcctccaggtgacttgggtcccttgcatcctttcactgctggagtttatgtggcactgatgatggctcagattgaagtgttgaggaagagagggcattcctactctgagattataaacgagagcgtgattgaggcagtggactctctgaatccctttatgcatgctcgaggggtgtcattcatggtcgataattgctccacaacagcacgcctgggatcaagaaagtgggctccccggtttgattacatcctcactcagcaggcctttgtgactgtggacaagggtttgcccatcaaccaggatctgctcagcaacttcttgtctgacccagtacatggcgccatggaagtctgtgcacagctgaggcccagtgttgacatatcagtgcccccggatgcagattttgtgcggcctgagctgcgtggaacgagcagttagattggatacttgatggagatggtctcgagaaaatggcttccttaatgtttcaggtaataggctttgtgttgctgagtgtatccctcagagatgtttgtcaagtggcgcagttggttagttatgggttgcatgtaccaattatgctctgtttttacttactgtattgctcggttgttttggactatattcttcctttggtccccctcttgcaccatattctgcggagcttgttcaatgagcgacatttatatagtttacgtaatccttatattt

SEQ ID NO: 2245 - DNA, 1805 bp, Fagopyrum esculentum
tgctaagacgttgaggcctttgatacttcgctctatgccacgcaacaatgccgcaggaggaggatccgcccgcatgatgttggtgccttctgtcaagcctgccaccactctcgacttcgaaacctccgtgtttcagaaggagaaagttagccttgctggccacgatgagtacattgtgagaggagggagacacttgtttcctctcttgcctgatgcgttcaaggggattaagcagattggagttattggctggggatcccagggtcctgctcaagctcagaacctgagggattcattgactgagatcaaatcagatattgtggttaaggttggattgcgtaagggatctcgttcctttgttgatgctcgtgctgctggattcacagaagagagtgggactttgggtgacatgtgggaaactatttctactagtgaccttgtgatgttattgatatcagatgctgccagctgattgttacgaacaggtgttctcccacatgaagccaaacagcatcttgggattgtcccatggattcttgcttgggcatctgcagtcaagtggacaggatttccccaaaaacattagtgtcattgccgtatgccctaagggaatgggtccttctgtgaggaggttgtacgttcagggtaaagagataaacggtgctgggatcaactctagttttggagttcaccaggatgttgatggaagagcaactgatgttgcacttggatggtcaattgccctcggttctcctttcacatttgccactaccttggagcaagagtacaggagtgacatctttggagaaagaggcattctacttggtgctgttcacggattgtggaatccttgttcaggagatacactgagaatggaatggatgaagagcttgcctacaaaaacacggttgaaagcataacaggaatcatctcaaagacaatttctaccaagggaatgctggctgtatacaatgctttgtcagaagaaggcaagaaagaattcgagactgcatacagtgctgcttactacccttgcatggacattttgtatgaatgttatgaagatgtagccagcggaaatgagattcgcagtgttgtcttggctggacgcaggttctatgagaaagaaggtcttccagctttcccaatgggtaatatagatcaaaccagaatgtggaaggttggtgagcgcgttagagccacaagaccagcaggtgatctcggtcctctctatcctttcacagccggtgtctatgttgcttgtatgatggcccagattgagatcttgaaaaagaagggacactcatactctgagatcatcaatgagagtgtgattgaatctgtggactcattgaacccgttcatgcacgctcgtggggtctcgttcatggttgataactgttccaccacagctcggcttggttccaggaaatgggccccaagattcgactatatcatcactcaacaagccctggttgcagttgacaacaacgccgcagttaacagggacctcatcagcaacttcttttccgacccagttcatggagccattgacgtttgtgctcagctgagacccactgtcgatatttctgtgacagctgatgcggatttcgtgcgcccggagttgcgccaatctggaaactaagagtttgtagtcctccatgtattgctatatttagattatgtttttttttccccatgttgctcgtctgtggtactgtttcaatgtttttccgtagctttgagttatgttgatgttaatgttgctggaataaaagctagatattacaaatttgaattcgttt

SEQ ID NO: 2246 - DNA, 1819 bp, Pseudoroegneria spicata
  misc_feature (9)..(10): n is a, c, g, or t
  misc_feature (46)..(50): n is a, c, g, or t
  misc_feature (469)..(469): n is a, c, g, or t
  misc_feature (830)..(830): n is a, c, g, or t
  misc_feature (1817)..(1817): n is a, c, g, or t
ccacccctnntgcgccctcgccgcccccgcccgccgccgcgcggtnnnnnccatggtcgcggccccggccaaggtcggcgccgccatgccgtcgctcgacttcgacaccgccgtcttcaacaaggagaaggtctccctcgccggccacgaggagtacatcgtcaggggcgggcgcaacctcttcccgctgctcccggaggcgttcaagggcgtcaagcagatcggcgtcatcggatggggctcccagggtccggcgcaggcgcagaacctgagggattccttggtggaagccaagtctgacatcgtcgtcaagattggcctcaggaaaggttccaagtcttttgaggaagcacgtggtgctggattcactgaggagaacggaaccttgggagacatatgggagacggtctcaggcagtgatcttgtgctgctgttgatttcagattctgcacaggcagacaactatganaagatcttctctcacatgaaaccaaacagcattcttggtttatctcatgggtttctccttggacatctgcaatcacatggcctcgatttcccaaagaacatcagcgtggttgctgtatgccccaagggaatgggcccgtcggttcggagactgtatgttcagggcaaggaagtaaatggtgctggcatcaacgctagctttgctgttcaccaggatgttgatggaagggcaactgatgttgctcttggatggtcggttgcactaggatccccgttcacctttgctactaccttagaacaggagtacaagagtgatatctttggggagcgaggaattttgctgggcgctgtccatggcatcntggaggctctgtttaggagatacacggagcaaggaatggacgaggagctggcatacaaaagcactgtggagggcatcactggaattatctctaagaccatctcaaagaaggggatgcttgaggtatacaactccttgagcgaggagggcaaaaaggagttcaacaaggcatacagtgcatcattttacccttgcatggacatactctacgaatgctacgaagatgttgcctctggaagtgaaatccggagtgttgtgttggctggccggaggttttatgacaaggaaggccttcctgctttccctatgggcaaaatcgaccaaactcggatgtggaaggtcggcgaaaaggtgcgctcgacccggccagatggtgaccttggcccactccaccccttcacggctggagtttatgttgcacttatgatggcccagattgaggtgctgaggaagaaggggcactcctactctgagatcatcaacgagagcgtgatcgagtcggtggactcgctgaaccccttcatgcacgcgcgcggggtggccttcatggtggacaactgctcgacgacggcccgtttggggtcgaggaagtgggcaccccgcttcgactacatcctgacccagcaggcgttcgtgacggtggacaaggacgcgcccatcaaccaggacctcatcagcaacttcatgtcggaccccgtccacggcgccattgaggtctgcgccgagctgaggccgaccgttgacatctcggtgacggccgacgccgactttgtgcgccctgagctccggcagtctgcctagattcggggctgaaagagttttttgttttattgatggacatgaatggactgtaatgtatgtgtgcgactagctatttgaacttgtgagctgctgtcaggtagagagagcccctattgggggtggaacgagtgagtcgtcttcgtttcccgaataataaagttagttcgtccggttggatgttgttgcnaa

SEQ ID NO: 2247 - DNA, 2012 bp, Vitis vinifera
aaaaacttggcttttgtactggcgttcatcactgcgcgttgatggcggcgaccacctcctttacccctggagtgtctgctccggcaccgctgtcttcttcaccaccatgtaaggcgttctccaaaaccctaggatttaagctagggtcctcaccgtcgtcttcgaccaccctgaaacccctcatttcacgtgctcccgccaatggacgtccctctctctcagttcgcatggtctcacttccgtctgttctccccacgacgtcgctcgatttcgaaacctccgtcttcaagaaggagaagatcgctctggctggtcacgacgagtacattgtcagaggagggcgtgatttatttcatctgttgcctgatgcattcaaggggatcaaacagattggagttattggtcggggttctcagggtccagcccaagttcagaacctgagggattctcttgcagaagctaaatcggatattgtggtcaagattggattaaggaagggttctcggtctttagctgaagctcgtgcagctggattcactgaagagaatggaactctgggtgatatatgggaaaccattgctggcagtaatcttgtgttgttattgatttctgattcagcacaggctgataactatgagaaggtcttctcccacatgaaaccaaacagcatgcttggactttcccatgattttcttcttggacatttacagtctctggggcttgattttcctgaaaacatcagtgtaattactgtatgtcccaagggaatggggccttctgtgagaagactgtatgttcagggcaaagaggtaaatggtgcaggaatcgattccagttttgctgttcatcaggatgttgatggtagagctactgatgttgccttgggatggtcagttgcccttggttctccttttacatttgccactacattagagtacgagtatcagagtgacatttttggggagcgggggattctacttggtgctgttcatggagttgtggagtccttgtttagaaggtataccgagaatggaatgaatgaagatctggcttaaaagaacactgttgagtgcattacaggaataatatcaaagaacatctctgcaaagggcatgctggctgtatgcaactccttgtcagaggatgggaaaaaagaatttgagattgcatatagtgcctcattttatcgttgtatggacatcctgtatgagtgttatgaagatgttgctagtgggagtgagattcgtagtgttgtgttggctgggcgacgattttatgtacaaggagggcctgccagcttttccaatgggtaaagattgatcaaacacgaatgtggaaagttggtgagcatgtttgaaaggctcggcctaaaggtgacttaggtccattatatcctttcactgctggggtttttgtggcactaatgatggctcagattgaggtcttgaggagaaaggggcattcatactcagaaatcatcaatgaaagtctgattgaatccgttgattctctgaatccctttatgcatgcccggggagtctcattcatggttgataactgttcgacaacggcacggttgggatcaggaaaatgggccccacgcttcgactacattatcacccaacaggctttagtggcagtggacatgggcgcctctgtcaaccaggatcttattagcaacttcttgtctgatccggttcatggagccattgaagtctgtgctcaattgagatcaactgttgatatttcagtgcctccagatgcagattttgttcgcccagagttgcggcagtccagtagttgataggacttggaagatttagtttagctgcatgggaacttttctcttaggatggagtgttaggctgttagccatccaaattttatcttgtcctgcagggctagtttcttgttggttgttcgaagcatgagcatctactttcatttgtcttttgtcttttaagaacatctcagttcaaaatgtgccttttgcccttaatattattatttcc

SEQ ID NO: 2248 - DNA, 1788 bp, Humulus lupulus
tctcgatttcgatacatctgttttcaagaaggagaagattaacctcgccggtcacgatgagtatattgtaagaggaggaagaaatttgttccatttgttgcctcatgcttttaagggtatcaagcagattggtgtgattggttggggttctcagggacctgctcaagctcaaaatttaagagactctcttgctgaggcaaagtctgatatcgtggttaagattgggttgaggaagggatctcgctcttttgctgaagctcgtgcagctggtttcactgaagagagtgggacactgggtgatatttatgaaacaatctcaagcagcgatcttgttatgctactcatttctgattctgcacaggctgataacttcgagaaattttctcacacatgaagccaaacagcatccttggtctttcccatggttttctttgggccatttgcagtcggttggaatggatttccccaagaacattagtgtaattgctgtatgtcccaaggggatgggtccttctgtgaggaggctttatgtccagggcaaagagataaacggtgcaggaattaattccagttttgcagtgcaccaggatgttgatggacgagctaccgatgtggccttggggtggtcagttgcccttggctctcctttcacatttgccactactctggaacaggaatacaagagtgacatctttggcgagcgaggcattttactcggggctgttcatggcattgtggagtccctattcagaaggtacactgaaaatggaatggctgaagatctggcttacaagaacactgttgagtgtattactggaattatatcaagaaccatttcaactaagggtatgctgtctgtatacaattccctgtctgcagaaggcaaaaaggattttgagacagcttatagtgcctcgttctatccttgcatggatatcttgtatgagtgttacgaagatgtagccagttgcagcgagatccgcagtgttgtcttggctggccgacgattttatgaaaaggagggtcttccagccttcccaatgggtaacattgatcagacaaggatgtggaaagtgggtgagaaagtccgatcaacccgaccagctggtgatttaggtccattgtacccatttacagctggtgtctatgttgcattgatcatggctcagattgagatcttgaggaagaaagggcactcctactcagagatcatcaacgaaagtgtgatcgagtcagtggattcattgaaccccttcatgcatgcccgtggagttgcattcatggttgataactgctctacaacagctcgattgggatcaaggaaatgggcgccacgcttcgactacatacttactcaacaagcctttgttgcagtggacaatggcacacccatcaaccaggacctcatcagcaacttcctatcagatcccattcatggtgccattgaagtatgtgcacagctgagacccaccgtggacatttcagtcactgcagatgcagacttcgtgaggcctgagttgcgtaaccagggcaattgaaggtgaaacctttattatggcagttacgttagtgtaagggcagtagattctgtcatgagtctagtgaggtgtgatttagaatctagaagaaataagttggcctactatagctattaggggctgtgttttgtatcctaatgttatgtatgtgctgtgtttctttcttaaataaaagaccaagcgtaggtgttttagcattgtagaggtgacaatgagtagttaattataagaacgaggattccatccttat

SEQ ID NO: 2249 - DNA, 1778 bp, Flaveria ramosissima
tcccatataagtagggctacagctacactcacaaaccaccatattcattcactccgcctcttctcctccaccattcaccaccaccatggcgacggcgacggcgacaaccaccttctcaaccttgacccccgccacctcatcatccacagctgcaccctctctcaaagttgctcccaaaaccctagtgtttaacgttggattgctctcctccaaacctacattcaaatcactcagagctcgctccaatggcggatccggatccgctctcggagctcgtatggtctcagctccagcaataacccgacccacgcttcttgatttcgaaacctctgtgttcaaaaaggagaagattaaccttgctggtcatgatgagtatattgtgagaggaggaagagatttgttccatttgttgcctgatgcgtttaaaggtattaagcagattggtgttatcggttggggctctcagggtcctgctcaagctcaaaatcttagggattctcttgcagaagcaaaatctgacattgtagtgaagattggtttgagaaagggttcgagttcgtttaatgaggctcgtgctgctggctttactgaagaaactggaactcttggggatatttatgagactatttcaggcagtgacttggttctgctcttaatttctgattcggctcaggctgataactatgagaaaatcttctcacacatgaagccaaacagcatacttggactgtcccatgggtttcttcttggtcatctgcaatcagctggtcttgattttcccaagaacataagtgtggttgctgtgtgccccaaaggaatgggtccatctgtcaggaggctgtatgttcaaggaaaagaagtaaatggagctgggatcaatgcaagttttgctgtccatcaggatgttgatggaagagccactgatgttgcccttggatggtcagttgctcttggttcaccttttacatttgccactacactcgagcaggaatacaggagcgatatatttggcgagcgaggtattttacttggtgcggtgcatggtattgtggagtcattgtttagaaggtataccgaaggcggtatgagtgaagaattggcttacaaaaatactgtagagtgcataactggcataatatcaaagaccatatcaactcagggtatgaaggctgtatacgagtcattgtccgaagaaggcaaaaaagagttcttgacagcatacagtgcctcttactatccttgtatggacattttgtatgagtgctatgaggatgtagcaagtggtagtgaaataagaagtgtcgttttggctggtcgtcgattttatgaaaaggagggtttgccagctttccctatgggaaagattgatcagactcagatgtggaaagtaggcgaacgggttcgggcggtccgacccgctggtgatttaggtccgttgtatcctttcacagctggtgtctatgttgcactaatgatggcccagattgaggtgttgaggaagaaaggacattcttattctgagatcatcaatgaaagtttgatcgagtcagtggattccctgaacccgttcatgcatgctcgaggcgtctcctttatggttgacaactgttcaactactgcacggttgggatcaaggaaatgggcgccacgttttgattacattcttacccaacaggctttagttgccgtagacaatggggccccactaaaccaagacctcatcagcaacttctttgaagacccggtgcatgaagctgtcaaagtttgtgcagagttga

SEQ ID NO: 2250 - DNA, 1486 bp, Trigonella foenum-graecum
acgacactctcagtcgagactcaagactctctctctctatggcatctgattcgaacgctaccaacacgctccaagccattcgctacaaccgtggttctcttcagcttcttgatcagacaaagcttcctttagaaagcgtttacttggaaattcgtaattcaaatgatggctggaatgctatacgggatatggtggtccgaggagcacctgctattgctattgcagcggcactctctctggctgtagaggtgtccaatttagatgatttcaatgggtctactgatgacgctgtttacttcctgcagaagaagttggactatcttgtctcaagtcggccaaccgcggtgaacttatcagacgccgcgactaaactcaaagaaatcatttctaaggctgctgctaccacttcagaggccaagggtgtgtttcaggcttatctagaggctgctgaaataatgcttgaggatgatgttgcatctaacagagcaattggaacttttggagctagttttattcaaaaccaaacagaaaaactaaagctttccgttttgacccattgcaacactggaagtttagccacggctggatatggtactgctcttggtgtaatccgtgcactaaacagcggaggagttttagaaagggcttattgcacagaaacacgcccattcaatcaaggatccagacttactgcctatgagttggtacatgacaaaataccagcaactcttatagcagattctgctgcggctgcattaatgcaagcagggcgtgtggatgctgttgttgttggcgcagaccgtgttgcatcaaatggtgacacagccaacaaaattggaacctatagtgttgccttatgtgccaagtttcataatgtaccttttttgtggctgcaccattgacttccattgatctatcactttcttccggacaacaaattgtcattgaagagagatctcccaaggaattgttgaactcgcgtggaggacttggagagcaggttgctgcctccggaatatctgtgtggaatccggcttttgatgttacacctgctaatctaatatctggtatcatcactgagaagggtgtcattacaaagacgtctgctggtgatgcttttgacataaaagctttcgtaaagaaaacaggttaagggtggaatgtattcagtactaatgatctatggtgtgatataagatgttttgttttgtttcacccattgtagatttcagttgtatgttttagaggggcgttgtatatcagctcattcaatataactaactgtccccggagaataaatggggacctggttaataaactagtcaatgagaaatcggtggctactatgacttgcctggataaaatggaatggtagttctcagaaaacaggacatggttctgtttttgttacttacaatacaagacataattgtttgagatattataaaactatgtaatgcttcatatgatgtatgtcaaataaata

SEQ ID NO: 2251 - DNA, 1424 bp, Cicer arietinum
ttcattcccaccaattctctgtatggcatctgattcaaacgccaccaatatgctccaggccattcgctacaaccgcggttctcttcagcttctcgatcagacaaaactcccgttagaaagcgtttacttggagattcgggattcaaatgatggctggaatgctatacgggatatggtggtccggggagcacctgctattgctattgcagcggcactcgctctggctgtggaggtgtccaatttagatgatttcagtgggtctactgatgacgctgcttacttcctacataagaagctggaatatcttgtaactagtcggccaactgcggtgaacttatcagacgccgcaacaaaactcaaagaaatcatatctatggctgctgctacgacttcagaggctaggggtgtttttcaggcttatgtagaggctgctgaaataatgcttgaggatgatgttgcatcgaacaaagcaattggaatatatggagctagttttattcaaaaccatacagagaaacataagctttctgttttgacccattgcaacactggaagtttagcaactgctggatatggtactgctctcggtgtaatccgtgcacttcacagcggaggagttttagaaagggcttattgcacagaaacacgtccattcaatcaaggatccagacttactgcctatgaattggtacatgacaaaataccagcaactcttatagcagattctgctgctgccgcattaatgcaagcaggacgtgtggatgctgttgttgttggtgcagatcgagttgcatcaaatggtgacacagccaacaaaattggaacctatagtgttgccttatgtgccaagtttcataatgtgcctttttatgtggctgcacccttgacttccattgatctatcactttcttctgggaaacaaattgtcattgaggagagatctcccaaggaattgttgaacacacgtggaggactcggagagcaggttgctgcctcaggaatatctgtgtggaatccggcttttgatgttacacctgctaatctaatatccgggatcatcactgagaagggtgtcattacaaagacatctgctggtgatgcctcctttgacataaaaacttttgtacagaaaacaagctaagggcggatcgtagtaacggattcaataccaatgatcctttgtgtgaaatgagatgttgtgttatattgactgtagaatttcgttgtatgttttagaggggagttgtagaccaactcgatcaatgtaagtgtcctggaaaataaataaggtcctggttaataaacaagtcaatgagaaattgcggcgaccaaggataaaatggaatggtacaagttctcggaaaacaaaagacatgatttttgtattattgacaacacagggcatgattgaataagatataaag

SEQ ID NO: 2252 - DNA, 1542 bp, Cajanus cajan
gggggcggaagaatctttgtgcgtgataaaagaagagaaacgcatgattgcggggggattgcacgcagagagttgaacacctctttcgggaacgcaaccctaggtcgctgaattcgtttctatggcatgcgagtccaaccaagtttctgccaccaacacgctccaatccatttgctacaaccgcggttcccttcagcttctcgatcagagaaagctccctttagaaacactttacttggacattcgggattccactgatggctggaatgccattcgggatatggtggtccgcggagcacctgctattgcgattgcagcagcgctctctttggctgtggaggtgttcaatttagatgattttaatgggtcagctggtgatgctgtttccttcctgcagaagaaattagagtatcttgtctcaagtcggccaacagcagtgaacctatcagatgctgtgacaaaactcaaagaagtcatatcaaatgcagctgctaccacttcagaaggcaagagtgttttccaggcatatgtagatgctgctgaagttatgcttgaggatgatgttgcctcaaataaagctattggttcttatggagctagttttattcaacaattaacaaagaaacaaaagctttctgttttgactcattgcaatactggaagtttagccacagcaggatatggtactgctctgggtgtgatccgtgcgcttcacagtggaggagttctagaaagggctttttgcacagaaacacgcccattcaatcaaggatctagacttactgcctttgagttggtgcatgaaaaaataccagcaactcttattgcagattctgctgcagctgcattgatgaaagcaggacgcgtggatgctgttgttgttggggcagatcgtgttgcatcaaacggtgatacagccaacaaaattggaacatacagcgttgccttgtgcgctaagtttcataatgtacctttttatgtggctgcacccctgacttccattgatctatcactttcttctggacaagaaattgtcattgaggagaggtcccccaaggaattgttgaacacacatggaggacttggagagcagattgctgcctctggaatttctgtgtggaacccagcttttgatgttactcctgctaatctaatatctgggatcataactgagaagggtgttattacgaagacatctgctggtgatgcttttgacataaaagctttcgtacagaaaacaggttaaggtggagtgagatttttcttacgttacaacattgtagatttgaaaagtatgtgttagaggagaatagtgatgtgactgcaggatcagctcgttcaatggtatgcgctctttaagagcatctttcgtacacaagttggataagacttaactagacctaattttatgacatgatacattttaatgttatgcaatgtttgctatgacatggaataaaatattacactacatgagatagtgttgtaatatgtttagtgatcgattgttttacattaaattagatagaattttttactggg

SEQ ID NO: 2253 - DNA, 1567 bp, Lotus japonicus
cgcgcttctctcagaagctcttgcatccagtggcaaacggagcgttgaacctcttcccctaaaacactgactcaacgacctatggcatcatcgggttcgaacgaactcaccggcaccaacacgcttcagtccattcgctacaatcgcggttcccttcagcttcttgatcagagaaaactccctctagaaacaatttacttggagattcgcgattcaaccgatggctggaatgccattcgggatatggtggtccgaggagcacctgctattgccattgcagccgcactcgccctggctgtggaggtatctaatctaggtgattttagtgggtcgcccagtgatgcggcttccttcctgcagaacaagttagaatatcttgtctcaagtcggccaactgcagtgaacctatcagatgctgcaacaaaactcaaagaagtcatatctggagctgctgctaccgcttcagaggccaaaagtgtttttcaggattatatagaggctgctgaaattatgctcgtcgatgatgttgcctcaaatagagcaattggttcttatggagctacttttattcaacaccaagttgagaagcctaagctttctgttttgacccattgcaacactggaagtttagctactgctggatatggtactgctctgggtgtaatccgtgcacttcatagtggaggagctttagaaagggcttattgcacagaaacacgcccattcaatcaaggatctagactgactgcctttgagttggtacatgataaaataccagcagctcttatagcggattctgctgcagctgcactaatgaagtcgggacgcgtggatgctgttgttgtgggggcggatcgtgttgcatcaaacggagacacagccaacaaaattggaacctacagtgttgccttatgtgccaagtttcataatgtacccttttatgtggctgcaccattgacttcaattgatctctcactttcttctggagaagaaattgtcattgaggagagatctcccaaggagttgttgaactcacgtggaggacttggagagcaggttgctgcatcaggaatttctgtatggaaccctgcttttgatgtcacacctgctaacataatatctgggattattactgagaagggtgtcattacaaagtcatctgctgctgatgcttttgacataaaagctttcatacaaaaaacactttaagggctgaaagtgtttagtgtcaatgacctatggtggagttagatttttctaacacattgcatccattttagattggaaagtattgtgttaaattttttgtttgaggttgtgacttcagcacaggattagcttcttcaatggaaatgtcccgggaaataaatcgcggcctgtttaataaacatgtcaataagaaattggcggcgatcatgccctacatgcttaaaatcgaatgccatgggttctttgaaagtcagtttgatcacctggttgtatgataaaattcaaatattatgaagtgtgttatgtgctttattggaaattgcattaaataaggtaataaaagttctcagtactaagg

SEQ ID NO: 2254 - DNA, 1713 bp, Vigna unguiculata
ggaggattctttgggtggtggtggaggaagatgcccaggaatctttgtttctgcagtaaaatagtgaaaaagcacgattgggaatccctttgtttctgctgtgtaagagagagaaaagaagcacgattgcgtaatctttatctgcagtgaaagatatagagaaaagacacagcatcgtattcctttgtttatgcagtagaagagagaaaaacgcacgattgcgaatttctgaaactccggtaaagtagtaaacacacactaaccttcttcggcaaccgaaccctaaaaccctgaatctgtttcggaaagcgaagccatggcacgtgagttcaacgatgttgcagcaacgcttcaatccatacgttacaaccgcggctccctccagcttctcgaccagagaaagctccctctggagacaacttacttggaaattcgggattcaacagatggctggaatgccattcgggatatggtggtccgaggagcacctgctattgcgattgcggcggcactctctttggctgtggaggtgttcaatttagacggtttcaatgggtcagctggtgaagctgtttccttcctccagaataaattagaatatcttgtctcaagtcggccaactgcagtgaatctatcggatgctgcgggaaaactcaaagaagtcgtatcaactgctgctgctaccacttcagagggcaggactgttttccaggcatttatagaagctgctgaagttatgcttgaggatgatgttgcctcaaatcgagctattggctcttatggagctagctgtattcagcaacaaactgagaaaaaaaagctctctgttttgacacattgcaatactggaagtcttgccacagctggatacggtactgctctgggtgtgatccgtgcacttcacagtgcaaaagttctagaaagagcttattgcactgaaacacgcccgtttaatcaaggatctagactgactgcctatgagttggtgcatgaaaaaataccagcaactcttattgctgattctgctgcagctgcgctaatgaaagctggaagtgtggatgctgttgttgttggggctgatcgtgttgcatcaaatggtgacacagccaacaaaattggaacctacagtgttgccttgtccgcaaagtttcataatgtacctttttatgtggctgcccccctcacctccattgatctatcactttcttctggacaagaaattgtaattgaggagaggtctcccaaggaattgttgaacgcacgtggaggacttggagagcaggttgctgcctcaggaatttctgtgtggaacccggctttcgatgttactcctgctaatctaatatctgggatcatcacggagaagggtgtcattacgaagacttctgatgatgcatttgacatcaaagctttcgtgcagaaaacaggttaaggtagagtggattttatcatgtttggtgagagtgttgtgacagtgtcaatgtttggtgagagtgttgtgacaggaggaacaactagttcaatgttggtgtccttgaaaaactaatctggacatagttatggttagtaaacaagtcaataagaattcatggaaaccgtgccttgtgtggctaaaatggaattgtggggtttttaagagcctttttggtacgctagtttgataagacttgataacaaaacctaattgtataacatgattacattttaacatta

SEQ ID NO: 2255 - DNA, 1744 bp, Vigna unguiculata
  misc_feature (1714)..(1716): n is a, c, g, or t
  misc_feature (1719)..(1719): n is a, c, g, or t
  misc_feature (1721)..(1726): n is a, c, g, or t
ggaggattctttgggtggtggtggaggaagatgcccaggaatctttgtttctgcagtaaaatagtgaaaaagcacgattgggaatccctttgtttctgctgtgtaagagagagaaaagaagcacgattgcgtaatctttatctgcagtgaaagatatagagaaaagacacagcatcgtattcctttgtttatgcagtagaagagagaaaaacgcacgattgcgaatttctgaaactccggtaaagtagtaaacacacactaaccttcttcggcaaccgaaccctaaaaccctgaatctgtttcggaaagcgaagccatggcacgtgagttcaacgatgttgcagcaacgcttcaatccatacgttacaaccgcggctccctccagcttctcgaccagagaaagctccctctggagacaacttacttggaaattcgggattcaacagatggctggaatgccattcgggatatggtggtccgaggagcacctgctattgcgattgcggcggcactctctttggctgtggaggtgttcaatttagacggtttcaatgggtcagctggtgaagctgtttccttcctccagaataaattagaatatcttgtctcaagtcggccaactgcagtgaatctatcggatgctgcgggaaaactcaaagaagtcgtatcaactgctgctgctaccacttcagagggcaggactgttttccaggcatttatagaagctgctgaagttatgcttgaggatgatgttgcctcaaatcgagctattggctcttatggagctagctgtattcagcaacaaactgagaaaaaaaagctctctgttttgacacattgcaatactggaagtcttgccacagctggatacggtactgctctgggtgtgatccgtgcacttcacagtgcaaaagttctagaaagagcttattgcactgaaacacgcccgtttaatcaaggatctagactgactgcctatgagttggtgcatgaaaaaataccagcaactcttattgctgattctgctgcagctgcgctaatgaaagctggaagtgtggatgctgttgttgttggggctgatcgtgttgcatcaaatggtgacacagccaacaaaattggaacctacagtgttgccttgtccgcaaagtttcataatgtacctttttatgtggctgcccccctcacctccattgatctatcactttcttctggacaagaaattgtaattgaggagaggtctcccaaggaattgttgaacgcacgtggaggacttggagagcaggttgctgcctcaggaatttctgtgtggaacccggctttcgatgttactcctgctaatctaatatctgggatcatcacggagaagggtgtcattacgaagacttctgatgatgcatttgacatcaaagctttcgtgcagaaaacaggttaaggtagagtggattttatcatgtttggtgagagtgttgtgacagtgtcaatgtttggtgagagtgttgtgacaggaggaacaactagttcaatgttggtgtccttgaaaaactaatctggacatagttatggttagtaaacaagtcaataagaattcatggaaaccgtgccttgtgtggctaaaatggaattgtggggtttttaagagcctttttggtacgctagtttgataagacttgataacaaaacctaattgtataacatgattacattttaacattannnaangnnnnnnacaagattttagcattta

SEQ ID NO: 2256 - DNA, 1422 bp, Glycine max
attgcacgcagttcctggaaagtagcaaagtaaagctctcttggttttgggaaccgaaacctaagaaaaacgcagaatctgtttcggaaagcgaaggaggcatggcatttgagtccaacgaagttgcagccacaacgctccaagccatatgctacaagcgcggttccctccagcttctcgatcagagaaagctccctctggagacagtttacttggaaattcgggattcaacggatggctggaatgccatacgggaaatggtggtccggggagcacctgctattgcaattgcagcggcactctctttggctgtggaggtgttcaatttagattttaatgggtcagctactgatgctgtatccttgctgcagaagaaattagaatatcttgtcacaagtcggccaactgcagtgaacctatcagatgctgcgacaaaactcaaagaagtgatatcaaatgctgctgctaccacttcagagggaaggagtgttttccaagtgtatatagatgctgctgaagttatgcttgaggatgatgttgcgtcaaatagagctattggttcttatggagctagtattattcaacaacaaacagagaaacaaaagctttctgttttgactcattgcaacactggaagtctagccacagctggatatggtactgctctgggtgtcatccgtgcacttcatagtgccggagttctaaaaagggcttattgcacagaaacacgcccatttaatcaaggatctagacttactgcctttgagttggtgcatgaaaaaataccaggaactcttattgccgattctgctgcagcggttattggccggacatgtggatgctgttgttgttggggcagatcgggttgcatcaaatggtgacacagccaacaaaattggaacctacagcgttgccttgtccgctaagtttcataatgtacctttttatgtggctgcacccctaacttccattgatctatcactttcttctggacaagaaattgtcattgaggagaggtctcccaaggaattgctgaacacacatggaggacttggagagcagattgctgcctcaggaatttctgtgtggaacccagcttttgatgttactcctgctaatctaatatcggggatcatcactgagaagggtgtcattacgaagacatctgctggtgatgcatttgacatcaaagccttcgtacagaaaacaggttaaggtagagtgagatttttatcacacgttacaacattgtaggcttgaaaagtattggagtggtagggttctttaagagcctctttggtacgcaagttagataagacttattaactttgagacctaattgtataagatgataacatcaatatattatgcaatgtttggtatggcatggaaaaatatattatattgcatgagataattatg

SEQ ID NO: 2257 - DNA, 1733 bp, Phaseolus coccineus
aaagaatatctattgtttgggtagtggtggaggaggcgaaggaatcttgtttgtgcagtaaaagagggaaaagcacgattgcgtattcctctgtgtctgcggtgaaacaaaaagcatttcgtacagtaaaagagagagagaaaaaaagaacacgacctttgtttctgcactaaaaaagcagattgcgaatttctgaaactcacactaaaccttcttcgagaacccaaccctcaaacgctgaatctgcttccgaacgcgaagccatggcacgtgagttcaacgatgttgttgcagcaacgctccaatccatacgctacacccgcggttccctccaccttctcgatcagagaaagctccctctggagacaacttacttggaaattcgggattcaacggatggctggaatgccattcgggatatggtggtccggggagcacctgctattgcgattgcggcggcactctctttggcagtggaggtgttcaatttagatggtttcaatggttcagctggtgaagctgtttccttcctgcagaataaattagaatatcttgtgtctagtcggccaactgcagtgaatctgtcggatgctgcgacaaaactcaaagaagtcgtctcaaatgctgctgctaccacttcagagggcaggagtgttttccaggcatttatagaagcttctgaagttatgcttgaggatgatgttgcctcaaatcgagctattggctcttatggagctacctgtattcagcaacaaacagagaaacaaaagctttctgttttgacgcattgcaatactggaagtctagccacagctggatatggtactgctctgggtgtgatccgtgcacttcacggtggaggagttctagaaagggcttattgcacagaaacacgcccatttaatcaaggatctagacttactgcctatgaattggtgcatgaaaaaataccatcaactctgattgctgattctgctgcagctgcattaatgaaagcaggaagtgtggacgctgttgttgttggggctgatcgtgttgcatcaaacggtgacacggccaacaaaattggaacctacagcgttgccttgtccgcgaagtttcataatgtacctttttatgtggctgcacccctcacttctgttgatctatcactttcttctggacaagaaattgtaattgaggagaggtcccccaaggaattgttgaacgcacggggaggacttggagagcaggttgctgcctcgggaatttctgtgtggaacccggctttcgatgttactcctgcaaatctaatatctgggatcatcacggagaagggtgtcattacgaagacttctgctggtgatgcatttgacatcaaagcttttgtacagaaaacaggttaaggtagggtgggatttttctcacacgttacaacgtttgtagatttgaaaagtttgttaggggagagtgttgtaacacaaggatcaactcgttcaatgttggtgtcccaaaatctaatatggacctagttataattagtaaacaagtcaataagaaattggtggaaaccatgccttgtgtggctaaaatggagtggtagggctgttaagagcctttttggtaccctggtttgatgagactgagaacaaaacctttttgtataacatggttaaattttaacattatgcaatttttggtataacattttaatattgcacgaaataatagtcaaatgtttgttttatgatcca

SEQ ID NO: 2258 - DNA, 1826 bp, Citrus sinensis
  misc_feature (1818)..(1818): n is a, c, g, or t
ccccctcaaccccacaacaaaaaaaaataaaaataaaaaataggataacacttttataaatacaataccgaaagtgttgtaatttaattcaaaaatcagaattatatttatgtaatttttcatacataaaagaaaaaaaacttaaaaaaaatataaaaggcgtcggcctgattcacgccgcctcggttggtggcgcagtgtgtaacagacatacactcacttatatactgtttttcagcgaatcattggtaatatttgcgtcagcttctgcgaagcgagatcgtaaagcagccgcaagagagtgaaaacagatggctcttgattccgtttcgaccgacaacaactctcttcagtccatttgctacaggcgtggctcccttcagcttctcgaccagagaaagcttcctctggaaactatttatttggaaattcgcgattctgccgatggatggtctgcaatacgggaaatggtggtgcggggggcgcctgccattgctatggcagcggcactttccctggcagtggaggtgtttaatttgaatgcatttagtgggactgctgccgatgcagcttcatttcttggcaataagttggaatatcttgtctctagtcgaccgactgcagtgaatctttcagatgctgccgcaaaactcaaagaaatcatatcaaaggctgccgctactgcttcagaagccaatagtgtatttcaggcctacatagaagctgctgaaattatgctcaaagatgatgttgctacaaacaaagctattggttcttatggggcaagttttcttcagaaccagctcaaaaattctaaattctctgttcttactcattgcaacactggcagtcttgcaacagctggatatggtaccgcccttggtgtgatccgtgcacttcattctgagggagtgttagaaagagcttattgctctgaaacacgtccattcaaccaaggatctagactcactgcttttgagttggtacatgatcgcataccagctactcttatagccgactctgctgcggctgcattgatgaaagatggtcgtgtgagtgctgtcattgtcggagcagatcgagtggctgcaaatggtgacactgctaacaagattggaacctacagccttgcattatgtgcaaagtttcataatattctgttttatgtggctgctccactgacgtcaattgatttaaccctttcttctggacaagagattgtcatagaggagaggtctgctaaagaattgttgtgctctcgaggaggacttggtgaacaagtagctgcatctggaatctctgtctggaatccggcttttgatgttaccccagctaatttgatcactggaattataacagaaaagggtgtcgttacaaaggcaggtgctgatgatgcttttgacataaaggatttcatacaaaagacagcctgaggctctgatgcaaaagaaggtgatttttaaccggatgaagtgtacccttgtaaatttaaacaagaaatgaagttctccagcctgggcgaagatctgtgggaaggaacattgtatctcgctgctttagactccctgttgttgtgatgattgcaggcatgtatttttttggttaatctggcagctaagtgcaaacattataattatttgaagtaaaaatagaactcttataggacaagttcaaattagaaagtggatcggagagtaccagtcgtgtgtatttaatcctcgcttttttttatttcttctagggatattattgtttgagtactttaaaaattataatatatctaataattataaaaatcattatagtctatcaggactnatatttat

SEQ ID NO: 2259 - DNA, 1811 bp, Citrus clementina
caacaaaaaaaaataaaaataaaaaataggataacacttttataaatacaataccgaaagtgttgtaatttaattcaaaaatcagaattatatttatgtaatttttcatacataaaagaaaaaaaattaaaaaaaatataaaaggcgtcggcctgattcacgccgcctcggttggtggcgcagtgtgtaacagacatacactcacttatatactgtttttcagcgaatcattggtaatatttgcgtcagcttctgcgaagcgagatcgtaaagcagccgcaagagagtgaaaacagatggctcttgattccgtttcgaccgacaacaactctcttcagtccatttgctacaggcgtggctcccttcagcttctcgaccagagaaagcttcctctggaaactatttatttggaaattcgcgattctgccgatggatggtctgcaatacgggaaatggtggtgcggggggcgcctgccattgctatggcagcggcactttccctggcagtggaggtgtttaatttgaatgcatttagtgggactgctgccgatgcagcttcatttcttggcaataagttggaatatcttgtctctagtcgaccgactgcagtgaatctttcagatgctgccgcaaaactcaaagaaatcatatcaaaggctgccgctactgcttcagaagccaatagtgtatttcaggcctacatagaagctgctgaaattatgctcaaagatgatgttgctacaaacaaagctattggttcttatggggcaagttttcttcagaaccagctcaaaaattctaaattctctgttcttactcattgcaacactggcagtcttgcaacagctggatatggtaccgcccttggtgtgatccgtgcacttcattctgagggagtgttagaaagagcttattgctctgaaacacgtccattcaaccaaggatctagactcactgcttttgagttggtacatgatcgcataccagctactcttatagccgactctgctgcggctgcattgatgaaagatggtcgtgtgagtgctgtcattgtcggagcagatcgagtggctgcaaatggtgacactgctaacaagattggaacctacagccttgcattatgtgcaaagtttcataatattctgttttatgtggctgctccactgacgtcaattgatttaaccctttcttctggacaagagattgtcatagaggagaggtctgctaaagaattgttgtgctctcgaggaggacttggtgaacaagtagctgcatctggaatctctgtctggaatccggcttttgatgttaccccagctaatttgatcactggaattataacagaaaagggtgtcgttacaaaggcaggtgctgatgatgcttttgacataaaggatttcatacaaaagacagcctgaggctctgatgcaaaagaaggtgatttttaaccggatgaagtgtacccttgtaaatttaaacaagaaatgaagttctccagcctgggcgaagatctgtgggaaggaacattgtatctcgctgctttagactccctgttgttgtgatgattgcaggcatgtatttttttggttaatctggcagctaagtgcaaacattataattatttgaagtaaaaatagaactcttataggacaagttcaaattagaaagtggatcggagagtaccagtcgtgtgtatttaatcctcgcttttttttatttcttctagggatattattgtttgagtactttaaaaattataatatatctaataattataaaaatcattatagtctatcaggactatatttatt

SEQ ID NO: 2260 - DNA, 1865 bp, Citrus sinensis
ctttgtaatcttttctctctgttaataaaatcctgcctcattcccccctcaaccccacaacaaaaaaaaataaaaataaaaaataggataacacttttataaatacaataccgaaagtgttgtaatttaattcaaaaatcagaattatatttatgtaatttttcatacataaaagaaaaaaacttaaaaaaatataaaaggcgtcggcctgattcacgccgcctcggttggtggcgcagtgtgtaacagacatacactcacttatatactgtttttcagcgaatcattggtaatatttgcgtcagcttctgcgaagcgagatcgtaaagcagccgcaagagagtgaaaacagatggctcttgattccgtttcgaccgacaacaactctcttcagtccatttgctacaggcgtggctcccttcagcttctcgaccagagaaagcttcctctggaaactatttatttggaaattcgcgattctgccgatggatggtctgcaatacgggaaatggtggtgcggggggcgcctgccattgctatggcagcggcactttccctggcagtggaggtgtttaatttgaatgcatttagtgggactgctgccgatgcagcttcatttcttggcaataagttggaatatcttgtctctagtcgaccgactgcagtgaatctttcagatgctgccgcaaaactcaaagaaatcatatcaaaggctgccgctactgcttcagaagccaatagtgtatttcaggcctacatagaagctgctgaaattatgctcaaagatgatgttgctacaaacaaagctattggttcttatggggcaagttttcttcagaaccagctcaaaaattctaaattctctgttcttactcattgcaacactggcagtcttgcaacagctggatatggtaccgcccttggtgtgatccgtgcacttcattctgagggagtgttagaaagagcttattgctctgaaacacgtccattcaaccaaggatctagactcactgcttttgagttggtacatgatcgcataccagctactcttatagccgactctgctgcggctgcattgatgaaagatggtcgtgtgagtgctgtcattgtcggagcagatcgagtggctgcaaatggtgacactgctaacaagattggaacctacagccttgcattatgtgcaaagtttcataatattctgttttatgtggctgctccactgacgtcaattgatttaaccctttcttctggacaagagattgtcatagaggagaggtctgctaaagaattgttgtgctctcgaggaggacttggtgaacaagtagctgcatctggaatctctgtctggaatccggcttttgatgttaccccagctaatttgatcactggaattataacagaaaagggtgtcgttacaaaggcaggtgctgatgatgcttttgacataaaggatttcatacaaaagacagcctgaggctctgatgcaaaagaaggtgatttttaaccggatgaagtgtacccttgtaaatttaaacaagaaatgaagttctccagcctgggcgaagatctgtgggaaggaacattgtatctcgctgctttagagtcccttttgttgtgatgattgcaggcatgtattttttggttaatctggcagctaagtgcaaacattataattatttgaagtaaaaatagaactcttataggacaagttcaaattagaaagtggatcggagagtaccagtcgtgtgtatttaatcctcgctttttttatttcttctagggatattattgtttgagtactttaaaaattataatatatctaataattataaaaatcattatagtctatcaggactatatttatt

SEQ ID NO: 2261 - DNA, 933 bp, Trifolium pratense
  misc_feature (642)..(642): n is a, c, g, or t
ctggttttcatttttcagtcactgagctaacaattctagcaaaaatggaagctattgtaaaatctatctaccttacaagaattccaaactctcaaacttgttctgcttctctgtttaatccaccactcttattgcaatctaatgccacttcagtaactttcaattcagcaacacatcatttgcacaagtgctttctttctcagcaaagatacggtgttttactttccaaatcaaaagaaaaggggaacatgggagctatatatgcatcagaggctgcaagcccaacaacaactgttacagaaagatggattcttgaaccaattggagatggtgattcaaggcatataggcttcaaggttgagaggccaggtgcatatgaaattgcttctagcgaagtgaccgtaggacgtgttccagacaaagctgatctggtgatcccagttgcaacagtgtctggcgtgcatgcacgcattcggaaaaaacaagacaatcttctagttatagatttggatagcaccaatgggacatacgtcgatgatataagactgagacctggagtagttaccactgtatcttctgggagttgtattacttttggggacactaatttggctatgttccgtgtatcaaagatacaaggcnagaaggttgttgatacagttggagaaacagaaggtgaattagacaatggtgacaaatctgatagtactgaaacaagttgaacttctagttgtaatgtatactactttgttttgtatagttaaaatattctgcattgttttgcaatgccattttgatacaaagcatatttatagataaatttgcattttgacaagaacatgcatgtcacaagcaggagtacagccagaaccttgagtcaggggtgccaagaaaacaatttttagttattaaattttgttttttgcatgttaa

SEQ ID NO: 2262 - DNA, 2159 bp, Trigonella foenum-graecum
agagaattcagaaaagcctgcttcttttgcaaagactttgactcaatctgatgcaaacaatggtggaggcttttctgttcctagatactgtgctgagaccatttttccacggcttgattactcggctgaaccaccggtacagacggtgattgcgaaggatgttcacggcgaggtttggaagtttagacatatctataggggaacaccaaggaggcacttgttaacaactggttggagtagttttgtgaatcagaaaaaacttgttgcaggtgattctatagtgtttttgagaggtgaaaatggagaactttttgttgggattcgtcgcgcgaagagaggtattgttaatggattggaaacaccttctggatggagttctggtaatggaagttgtggtcttggtgttggaccttatggtggtgctttttctgtttttttgagagaggagaataaggtggggggtgttggttgtaatttagggggtggaagagtaaaagtgagtggtgaatctgtgaaagaagctatgagacttgcagctagtaatcaaacattcgaggttgtttattatccaagagcaagtactcctgagttttgtgttaagacttcagctgttaaagctgctatgagaattcaatggtgttctggaatgaggtttaagatgccatttgaaaccgaggattcatcgaggattagttggttcatggggactatttcttctgctcaggttgttgatccgattcgttggcctaattccccttggagacttcttcaggtaacttgggatgaaccggatttgctacaaaatgtgaagcgagtaagtccatggttggtcgaattagtagcaaacatgtcagtgattcatctcgcacccttctcaccaccaaggaagaaactccgttttccacaacatccggatttccctctcgatgttgttcaatttccaataccaaccttttcaggcaacccttttaaccctttgggttgtctatcttcttccgatcattataacgctcctgccgcaggcatacagggagccaggcatgctcaaattggaatatctttatcggatcttcaccttaacaacaacaaatttcagttaggtgtgtttccaaataatcctgcgaagatttctaatgttagcaacaaaacaatcaaccatgataataagagcaaagaaagcttatcatgtttgttaactataggaaactctcacaagagaaatttggagattaaatctgatagtaatgttaagagacaccaatttttgctttttggtcaaccaattctcactgagcaacaaatctctagaaaatcttctagtgatgatgtgttattgtccaagaataaggacaaagagaagtggtttttcagtgatactactcaatcttcactttctgaacagttttcaccagcaaaatcttctactactagtgctagtgctgacttttgttggcaacttggattagacactggtcattgcaaggttttcttggagtcagaggatgttggaagaaccttagacttgtcatgtgttggttcttatgaagaactatatagaaaactggctaagatgtttggaatagaaagatctgagatgttgaatcatgtactctatcgcgacgcaacaggtgctgttaaacaaactggtgaagaacccttcagtgacttcatgaagacagcaaaaagattgacaattttgatggattcagatagcaaagatactagaagggtgtctatcacaggaactaggaatgctgaacgtggattagatgcatcaaataagacaggacctatgagcatctttgtttaagatggtgttgcattgcatctcaattattattgttctatgatttcagaagttgaaggatatataaccttgttaaagagacctttaaattgaatcaaatattggattatgaatttttgtttaagttgtactagaaaacaattatgatcgcacgattactgtaattattactctttaagccccctcaatatctctaagaccctttaaatacattatcggtaaaaaaaatttctttttctttcatttataactatcagttgtgtatttaatgagtttttagagacaggaagcttaaagagtaatgctctattactattctaatgttaaccaacatttggtttccattagcaac

SEQ ID NO: 2263 - DNA, 2337 bp, Lotus japonicus
actgtttgatcactcattcaatgaaggaagctgacagaagcagcttggatccacagctatggcacgcatgcgccggcggcatggttcagatgccgccggtgaactccaaggtgttctacttcccacaggggcacgcggaacacgcacagtgcagcgtggacttcgcagcttccctaagaatcccaccgctcatcctctgccgcgtcgccgccgtgaaattctccgccgacccagaaaccgatgaagtgttcgccaagatgaggctggttcccctgagaaactcagagcttgatcacgaagatggcggtgatggtgcttctgatggaaacgccaccgagggttcagagaagccagcgtcgttcgccaagacgttaacacagtccgatgctaacaacggtggcggtttctctgttccgcggtactgcgcggagaccattttcccacggctggattactcggctgaaccgccggttcagaccgtcatcgccaaggacgttcacggcgaggtttggaagttccggcacatatacagaggcacgccgcgccggcacttgctgacaaccgggtggagcagttttgtcaaccagaagaagctcgttgcaggggactctgtcgtgtttctgagagctgaaaacggcgatctctgcgtcgggattcgccgggccaagaggggtatcggcggcggggcagaggtgccgtccgggtggagttccggcgccggtgccggaaactgcggtcttgggccttatggggctttttctgtgttcttgagagaagaaggtaagcttttgaggaatggttgtggcggtggcaactcgagtcctggcggtgttggaaggccaaaagtgagtggtgaatctgtgagggaagctatggcattggctgggagcaatcaagcttttgaggttgtttactatccgagagctagtactcctgagttttgcatcaagacttcagctgtgaaagctgctatgaggattcaatggtgttctgggatgaggtttaagatgccatttgaaactgaggattcttcaaggataagctggtttatggggaccatagcttctgttcaggttgttgatcctatacgttggcctaattccccttggagacttcttcaggttacttgggacgagccagatttgctacacaatgtgaagcgtgtaagcccgtggctggttgagttggtctcaaacatgtcaaccatccaccatctcacacccttctctcctccgcggaagaagctccggtttccgccacacccggacttcccgcttgacattcaatttccgttaccggcgttttcaggcaaccccctcgggcctagcagccccttgtgttgtctatctgacaatgctcctgcaggcatacagggagccaggcatgctcaaattggaatatctctctcagatatccacctccacaacaaactgcagttgggggtgcttccaactaacataaccaaccatgatcataaaagcaaggaaagcttatcatgcttgctcaccatgggaaattctcaaaaaagtttggagaaatctgatgatgatgtgaagagacaccaattttggctttttggtaaaccgatactcactgagcaacaaatttctagaagaagagcttctagtgatgatgataatgtgttgttgtctcagaattgtaattcaccaaagaaagagaagtggttttttggtgactctcaaatccaatcatcaccagaaaagtcttctactacttctagtggtgaattctcttggcaacttggtttggacactggtcattgcaaggttttcttggagtcagaagatgtgggaagaacactggacctgtcacgtgttggttcttatgaagagctttataggagactggccaacatgtttggaatggaaaggtctgagctgttgagtcatgtgctctaccgtgactccacaggtgctgttaaacatactggtgaagaacccttcagtgacttcatgaagacagcaaaaagattgaccattctgacagattctgcaggcagcaaagatactagaagggtcttgattacaggaactaggaatgctgaacgtggattggatgcgtcaaataagacaggtcctctgagtatatttgcttaatatggtgtggcacatgagactttggtttttagctttgatttgtgaagtttgaaggatgtagttaccactcttacttactagaggagactgaatatgaagtaaactttcacattctataaagaagattgccatatttttgtttatctgaagttgaagaaaacaatgattattcctctattatggacaattgctattcaatattaaccaagatttgggttcc

SEQ ID NO: 2264 - DNA, 3090 bp, Cicer arietinum
gttacgaactctctttgttagcgttcaactatcagcggctcgcaccgtcacgattctcatattccgccgccgtcaccgccgccggtgaatacaaacctgtagtcataaccaaaagtgtttcgtttcaattcactcaagtacctcaattgagccgccacaatgcttcacaacaagttattccctaagaaaaccagaggtggcaaaatcataaggcaattgagggagcattacttgcgagatgatatatattgcggtgctccgttttgtactgtttgtgattcttctggtgctcgccttagtgagtctgcttccacaattcttgttgttgacaccaatgttgttctcaatcagattgatttgctggagaatccggccattgatgatgttgttgtactgtccattgtgctggaagaggttaagaacaagaatttgtctgtttacaatcggattagagctatctgtgacaattcaatgaggaaattctgtgtcttttccaatgagtaccacagggatacttatgttaaggatatgcgtggggaaactaaaaatgataggaatgatagagctattagagtggctgcacagtggtatcagaagcatctaggtggtgcagtaaaggttttgcttataactaatgataaagagaacaaaaggaaggctagtgaagagggcatttgcgcagaaacagttgagtcttatgtcaagtctttggaccggcctgatttacttgacctgcttgtgcggccttcatctgaagatgtagatatggaagaggttgaagatctcagaccatccaagaggaaagtaatttattcagagcataagccgatgtcagaaatcacatctggtttgcatcgtggaatatatcatcaagggaaacttcgtgtaaaccgttacaatccattcgaagcatatgttgggagtgagagcattggtgatgaaataattatttatgggcgctctaacatgaaccgagcttttgatggtgatattgtggctgttgaacttctgcctcaggaccaatggaaagaagagaagtctctatctatagctggtgaagaagatggggacgaggatgaagatgttcatctagccccaaatagtgccgatgttgcacccagaactattcctcagcaatgttctactggagaagtaaatgctggatcctgtcgcccttgtggttgtattgttggtattataaagagaaactggcactcgtattgtggatctttggagccaatgcctatgcctggagggagtggcggcgttgcccatgccttgtttgtctccaaagatcgtagaattcccaagattcgtatccaaacccgccaactcgagaaccttttggacaaaaggattattgtatcagttgattcttgggatcgtcaatctcgatatccatcaggccattatgtgcggactataggagagataggtgatagagatactgaaagtgaggtggttttgatagaaaatgatataaattcaaggccattctcttcacaagtgctggcatgcttgccgccattgccatggtcagtcacttctgaagatttgtccattccatttaggcaggacttgcgtcatttgcgtgtcttcagtgtggaccctccaggctgcaaggatattgatgatgcactccactgctacgctcttccaaatggaaactttgaagttggagttcatattgccgatgtgacaaattttgtgtttcctggcactccacttgatgatgaggcttctcaaaggggtacatccgtctaccttgttgagcggagaatagacatgcttcctaaacctttaacagaagacgtatgttctcttcgatctgatgtggaaaggctagcgttctctgtcatatgggaaatgacacctgaagcagacattatttccactagatacacaaaaagtgtcataaaatctgctgcggcattgtcttatgttgaagcacaagcaaggatggatgatagtcgattgatggatccagtaactactgacttgagaaatatgaatagtttagccaagaaaatgagattaaggcgtattgagagaggagctttgactcttgcatctgcagaagtcaaatttcaaattgacaccgagactcatgatccccttgatattggcatgtaccagatccgggaagccaaccaaatggtggaggagtttatgcttgctgctaatgtttctgttgcacaacaaattcttaagagctttcctctgtgctcgttattaaggcgtcatccaactccaaccagagagatgcttgaacccttgctacgtgttgctgctgcagttggcctgaacttggatgtttcctcgtcaaaagcattggctgattctcttgaccatgctgtgggtgatgatccatacttcaataagttgattcgcattctggcaaccagatgcatgagtcaggcagtttatttctgtagtggggaccttagccctccagaatatcagcattatgggcttgcaacacctttatatacccatttcacatcacctataagaagatatgcagatgtcattgtacacaggctacttgctgcttctttaggaatatccaagttaccgcctgtatttcaagacaggctgcagctcactagtatagcagacaatttaaattataggcacagaaatgctcagatggctgggcgggcctctgtagagctgcatactctcatttatttccggaagaggccaacggatacagaagctaggatagtaaagataagatctaatggattttttgtgttcgttcccaaatatggcatagaaggacctgtatatttgacaacaagagctgaaaagggaagtggagaatggtatgtagatgagcaagagcagaagattaaaaagatggatggtagcctttcatacagcattttgcagacagttcaaatccacatggaggttgtggagcctcagcctaaccggccaaaacttcagcttactctcatatagagaggtatatgaacattgaacaagaaagcgtgctgtgaaatgtacatcctatttatattgctatccacgcctcggctaagatttctgatatcggaattgactaaccttcagtgttgttggaag

SEQ ID NO: 2265 - DNA, 3404 bp, Cajanus cajan
caatctcctccgtcgccgccaacatgctccacaacaagtccttcgtcaagaaaaccaaaggtggcaaagtcatgaagcaagtgcgggagcactacctgcgtgacgatatatactgcggcgcaccgttttgcaccgtttgcgattcctccgccgctcgcctcagtgcttcgccttccaccattctcgtcgtcgacaccaatgtcgttctcaaccagattgatttgctggagaatcccgcgttcgacaatgttgtggtgttgtccatcgtgctggaagaggttaagaacaagaacatgtctgtttacaaccgtgtaagatctatctgcagcaattccatgaggaaattctttgttttctccaatgaataccacagggatacatatgttaaggaaatgagtggggaaactaaaaatgataggaatgatcgagctatacgagtggctactcagtggtatcagaatcatcttggtggtgcagtaaaggttttgcttataactaatgatagagagaacaaaaggaaggcttgtgaagagggcatttttgctgaaacagttgagtcatatgtgaagtctttagaccgacctgatttactggacctgcttgtgcggcctgcatctgaagatgtgcacatggaagaggttgaagatcttagaccatccaagaggaaactaatctattctgagcataagccgatgtctgaaattacttctggtttacatcgtggaatatatcatcaagggaaacttcgtgtaaaccgtcataatccatttgaagcatatgttgggagtgagagtattggtgatgagataattatttatgggcgctcaaacatgaatcgagcatttgatggagatattgtggcagttgaacttctgcctcaggaccagtggcaagaagcttcatctctatctatagccggtgaagaagatgaggatgtggatgaagatgttcatctagctccaaatagtgctgatgatgcacctagaactattcctcagcagggttcttctgaaaaagtaaatgctgcacccagtcgcccttctggtcgtattgttggcattataaagagaaactggcattcgtattgtggatctttggacccaatgcctatgcctgcaggaagtggtggtattgcccatgcactgtttgtctccaaagatcgcagaattcccaagattcgaatccaaacccgtcaacttgagaaccttttggataagaggattattgtggcagttgattcttgggatcgccaatcacgatatccatcaggccattatgtgagaactataggggagataggtgatagagatacagaaagcgaggtggttttgatagaaaatgatataaatacacgaccattctcttcacaagtgctggcatgcttgccaccattgccatgggtagtctcttctgaagatttgtctaatccaatcaggcaggacctgcgtcatttgcgtgtcttcagtgtggaccctccaggctgcaaggatattgatgatgcactccactgtcatgctcttccaaatgggaactttgaagttggagttcatattgctgatgtgacaaattttgttcatcctggaaccccccttgatgatgaggctgcacaaaggggtacatctgtctaccttgttgagcggcggatagacatgcttcccaaaccactcactgaggacatatgttctcttcgttctgatgtggaaaggcttgcattctctgtcatatgggaaatgacacctgaagcagacattatttccacgagatacacaaaaagtgtcataaaatcttctgcagcattgtcttatgttgaagcacaagcgaggatggatgatagtcgattgatggatccaattactgcagacttgaggaatatgaatagtttagccaagaaaatgagattaaggcgtatagagagaggagctttgactcttgcatctgctgaagtcaaatttcaaattgacacggagactcatgacccccttgatattggaatgtaccagatccgggaggccaaccaaatggtggaggagtttatgcttgctgctaatgtttccgttgcacaacaaattcttaaaactttcccattgtgctcattattaaggcgtcatccaacaccaactagagagatgcttgaacccttgctaatgactgctgctgcagttggcttgcacttggatgtctcgtcatcaaaagcattggctgattctcttgaccatgctgtgggtgaggatccatacttcaataagttaatccgtatactggcaactaggtgtatgagtcaggcggtttatttctgcagtggggatcttagccctccagaatatcatcattatgggcttgcatctcctttgtatacccatttcacatcacctataagaagatatgcagatgtcattgtgcacaggctacttgctgcttctttaggaatatccaagttaccgtctgtatttcaagacagacttcagctcactaatatttcagacaatttaaattatcggcacaggaatgcccagtatgcagggcgagcatctgtagagctacatactctaatttatttcaggaagaggcctacagacacggaggctagaatagtgaaaataagatctaatggattttttgtgtttgttcccaaatatggcatagaaggacctgtatatctgacaaaagctgaaaagggaagtggagaatggtatgtagatgagcaacagcagaagattaaaaagatggacggtagcctttcatacagcattttgcagacagtccaaattcacatggaggttgtggagcctcagcctaaccggccaaaacttcagcttactctcatctagaggtatatgagcatttaacaacaggcatgcctctaatataactcctatttagattgccatttgcatctcagcgcttctcaaggaaggtttctcgtattggaaatcactggcatgaaaaattcatggaaggaacgaaacaaaggttgacgattttggttggagaaatttttactagatggaacagtgtatggttgatgacgtaagttttattctttttacaattatttacttctaaattgggaagtggaattatttacttgagtcaaaaagatacgcgttagcttaaatgtgccaatgtattttgagagaatatcaaaactattaaattaagaaatatgtatcatccaagagactccagagtctattcttagaactgcccactttattttttctcaccagcggtgggttacccagatggaccttttatcttgagatactatcattatacttgtacaaatactcacttcctcagagtgccgaccctgccgttgcaattagcaagtatatcctatttctgccttcatgctcttcatcgttgcaattaacaactatatcctatagttaacaatgtttcaa

SEQ ID NO: 2266 - DNA, 3482 bp, Glycine max
gccgccgctgcacgcccgcacctgcgtcctgctccgacactccggcgattgtgatcaccgccggaaaacaccgcggtcctactcccaacaccggttcctttcttaggcgctaaggtgaattttttttcccggaagaatcaactttttcttttccacgccagcatcttcaccattccaaagtagagaaagcttcgaaacgaacacactctccaagtagggttactcagcgcagagcaatctcctccgctgtcaacatgctccacaacaagtccttcgtcaagaaaaccaaaggtggcaaagtcataaagcaagtgcgggagcactacctgcgcgacgatatatactgtggcgcaccgttttgcaccgtttgcgattcttccagtgctcgcctcagtgcttcgccttccatcattctcgtcgtcgacaccaatgtcgttctcaaccagattgatttgctggagaatccggcaattgacgatgttgtggtgttgtccattgtgttggaagaggttaagaacaagaacatgtctgtttacaaccgtataagagctatctgtagcaattccatgaggaagttctttgttttttccaatgaataccacagggatacatatattaaggaaatgagtggggaaactaaaaatgataggaatgatagagctattcgagtggctactcagtggtatcagaatcatcttggtggtgcagtaaaggtgttgcttttaactaatgacaaagagaacaaaaggaaggctagtgaagagggtattttggccgaaacagttgagtcatatgtgaagtctttggaccaacctgatttacttgatctgcttgtgcggcctgcatctgaagatgtggacatggaagaggttgaagatcttagaccatccaagaggaaagtcatctactccgagcataagccgatgtcagaaattacttctggtttgcatcgtggaatatatcatcaagggaaacttcgtgttaaccgttataatccatttgaagcatatgttgggagtgagagcattggtgatgaaataattatttatgggcgctcaaacatgaatcgagcatttgatggggatattgtggcagctgaacttctgcctcaggaccagtggcaaggagtctcatctctatctatagcccatgaagaagacgaggatgaggatgaagatgttcatctagctccaaatagtgctgatgatgcacctagaactatttctcagcagggttcttctgaacaagtaaatgctgtgcccagtcgtccttctggtcgtattgttggcattataaagagaaactggcattcgtattgtggatctttggagccaatgcctatgcctgcagggagtggtggtattgcccatgccttgtttgtctccaaagatcgcagaattcccaagattcgaatccaaacccgtcaacttgagaaccttttggataagaggattattgtggcagttgattcttgggatcgtcagtctcgatatccatcaggccattatgtgcgaactataggggagataggtgatagagatactgaaagcgaggtggttttgatagaaaatgatataaatacacggccattctcttcacaagtgctggcatgcttgccaccattgccatgggtagtctcttctgaagatttgtctaatccaatcaggaaggatttgcgtcatctgcgtgtcttcagtgtggaccctccaggctgcaaggatattgatgatgcactccactgtcacgtccttccaaatggaaactttgaagttggagttcatattgctgatgtgactaattttgtttatcctggcactccccttgatgatgaggctgcacaaaggggtacgtctgtctaccttgttgagcggcggatagacatgcttcccaaacctcttacggaggacatatgttctcttcgttctgatgtggaaaggcttgcattctctgtcatatgggaaatgacacccgaagcagatattattgccacctcatacacaaaaagtgtcataaaatcttctgcggcattgtcttatgttgaagcacaggcaaggatggacgatagtcgattgatggatccgattactgcagatttgaggaatatgaatagtttagctaagaaaatgagattaaggcgtattgagagaggagctttgactcttgcatctgctgaggtcaaatttcaaattgacacggagactcatgatccacttgatattggaatgtaccagatccgggaggccaaccaaatggtggaggagtttatgcttgcagctaatgtttccgttgcacaacaaattcttaaaagttttccattgtgctcattattaaggcgtcatccaacaccaacaagagagatgcttgaacccttactacggactgctgctgcagttggcttgcacttggatgtctcgtcatcaaaagcgttggctgattctcttgaccatgctgtgggtgatgatccatacttcaataagttaatccgtatactggcaactaggtgcatgactcaggcagtttatttctgcagtggggatcttagccctccagaatatcatcattatgggcttgcagctcctttgtatacccatttcacatcacctataagaagatatgcagatgtcattgtgcacaggctacttgctgcttctttagggatatccaagttaccacctgtatttcaagacagtctccagctcactagtattgcagacaatttaaattatcggcacaggaatgcccagtatgcagggcgggcatctgtagagctacatactctaatttatttcaggaagaggcctacagacacggagggtagaatagtgaaaataagatctaatggattttttgtgtttgttcccaaatatggcatagaaggacctgtatatttgacaaaagcagaaaagggaagtggagaatggtatgtagatgagcaacagcagaagattaaaaagatggatggtagcctttcatacaacgttttgcagacagtccaaattcacatggaggttgtggagcctcagcctaaccggccaaaacttcagcttaccctcatctagaggtatatgagcattgaacaacaggcatgcctcgaatataactcctatgtagattgccatatgcatctcagcacttttcaatgaaggtttctggtattggaattggccggcatgaaaaattatcgaatgaacgaaacattgatggaagattttggttggagaaattttttgtagatggaacataagatttttggttgacaaggtaagttttagttagtccttttgcaactatttgcttttaaattgtgaagtaagacgtggaatttttatacatgtgatgctgtaagcaagcgtgaacagctcaagtaaaaaaaaatacgttagcttaaatgtgccaatattgtattttgaaagaatatcagaattgttgcattaagaaatatggaatcattcaagaggctccaccaaagtttagtttcttaa

SEQ ID NO: 2267 - DNA, 3850 bp, Glycine max
ggcatttacttcctaacaccttttgcatcacttaacacttttattacaattctcttgaactgcgtgccctctgctaccttcacagtaccgccgctacacgcccgcacctgtttcctgctccgacacttgggcgattgtgatcaccgccggcaaacaccgcggtctcactcccaacactggttcttttcttaggcgctaaggactaaaaaacaaaaaaatccagcagaatcaaccttttcttttcgttgcctctgttccaaagtatagagaaagcttcgaaacaagcacactctccaggtagggttactcagcgcagagcaatctcctccgcctccaacatgctccacaacaagtccttcgtcaagaaaacaaaaggtggcaaagtcatgaagcaagtgcgggagcactatctgcgcgatgatatatactgcggcgcaccgttttgcacagtttgcgattcttccggtgctcgcctcagtgcttctccttccaccattctcgtcgtcgacaccaatgtcgttctcaaccagattgatttgctggagaatccggcgatcgacgatgttgtggtgttgtccattgtgttggaagaggttaagaacaagaacatgtctgtttacaaccgtataagagctatctgtagcaattccatgaggaagttctttgttttttccaatgaataccacagggatacatatattaaggaaatgagtggggaaacaaaaaatgataggaatgatagagctattcgagtggctactcagtggtatcagaatcatcttggtggtgcagtaaaggttttgctgataactaatgataaagagaacaaaagaaaggctagtgaagagggcattttggctgaaacagttgagtcatatgtgaagtctttagtccgacctgatttacttgacctgcttgtgcggcctgcatctgaagatgtggacatggaagaggttgaagatcttagaccatccaagaggaaagtcatctattctgagcataagccgatgtcagaaattacttctggtttgcatcgtggaatatatcatcaagggaaacttcgtgtaaaccgttataatccatttgaagcatatgttgggagtgagagcattggtgatgaaatagttatttatgggcgctcaatcatgaatcgagcatttgatggggatattgtggcagctgaacttctgcctcaggaccagtggcaaggagtctcgtctctatctatagcccatgaagaagacgaggatgagaatgaagatgttcatctagctccaaatagtgctgatgatgcacctagagctgtttctcagcagggttcttctgaacaactaaatgctgtacccagtcgtccttgtggtcgtattgttggcattataaagagaaactggcattcgtattgtggatctttggagccaatgcctatgcctgcagggaatggtggtattgcccatgccttgtttgtctccaaagatcgcagaactcccaagattcgaatccaaacccgtcaacttgagaaccttttggataagcggattattgtggcagttgattcttgggatcgtcagtctcgatatccatcaggccattatgtgcgaactatagggaagatagatgatagagatactgaaactgaggtggttttgatagaaaatgatataaatacacggccattctcttcacaagtgctggcatgcttgccaccattgccatgggtagtctcttctgaagatttgtctaatccaatccggaaggatttgtgtcatctgtgtgtcttcagtgtggaccctccaggctgcaaggatattgatgatgcactccactgtcactctcttccaaatggaaactttgaagttggagttcatattgctgatgtgacaaattttgttcatcctggcactccccttgatgatgaggctgcacaaaggggtacatctgtctaccttgttgagcggcggatagacatgcttcccaaacctcttacagaggacatatgttctcttcgttctgatgtggaaaggcttgcattctctgtcatatgggaaatgacacctgaagccgacattatttctaccagatacacaaaaagtgtcataaaatcttctgcagcattgtcttatgttgaagcacaagcaaggatggatgatagtcgtttgatggatccaattactgctgatttgaggaatatgaatagtttagctaagaaaatgagattaaggcgtattgagagaggagctttgactcttgcatctgctgaagtcaaatttcagattgacacagagactcatgacccccttgatattggaatgtaccagatccgggaggccaatcaaatggtggaggagtttatgcttgctgctaatgtttccgttgcacaacaaattcttaatagttttccattggtctcattattaaggcgtcatccaacaccaactagagagatgcttgaacccttgttacagactgctgctgcagttggcttgcacttggatgtctcatcatcaaaagcgttggctgattctcttgaccatgctgtgggtgatgatccttacttcaataagttaatccgtatactggcaactaggtgcatgactcaggcagtttatttctgcagtggtgatcttagccctccagaatatcatcattatgggcttgcagctcctttgtatacccatttcacatcacctataagaagatatgcagatgtcattgtgcacaggctacttgctgcttctttaggaatatccaagttaccgtctgtatttcaagacagactccagctcactagtattgcagacaatttaaattatcggcacaggaatgcccagtatgctgggcgggcatctgtagagctacatactctaatttatttcaggaagaggcctacagacaccgaggctagaatagtgaaaataagatctaatggattttttgtgtttgttcccaaatatggcatagaaggacctgtatatttgacaaaagcagaaaagggaagtggagaatggtatgtagatgatcaacagcagaagattaaaaagatggacggtagcctttcatacagtgttttgcagacagtccaaattcacatggaggttgtggagcctcagccaaaccgaccaaaacttcagcttaccctcatctagagcatgaaaaaattgtcgaaggaaccaaacattgatggagatgttggctggagaatttttttgtagatggaacaaaagatttacggttgatgaggtaacttttagttagtccttttacaactatttacttttaaattgtgaagtgggacgtggaatttttatacatgtgatgctgtaagcaagtgtgaacagctcaggtaaaaaaaaaataaaattacgttagcttaaatgtgccaatattgtattttttgaaagaatatcagaactgttatgttaagaaatatggaatcattcaagaggctccacctaagtttagtttcttaaagagaattgcccagtttattttttctcaccagcgataggttaccgagtttgggtgttatattatcaatttatcatcaataattgaatctcatgtttgtcagtggcacaccgctcttaggtgtgcacgaatgatatacataagagaattatatgcagggatactgttggcgaagcgtttgagcgagcagcttcggcaaattagtgtatactgtattttattttatatacaaggttgagcatttttctttttgccaaaactgtagcaatgttgattgccctgattagattgaatcaatgttttagaaattggaatcgaaataagctgcaattcttgaaatatatgtagaaattatagtgtgcttgaaataggaataaccagcgct

SEQ ID NO: 2268 - DNA, 3941 bp, Phaseolus coccineus
aaattttcaaaaccttttggtttaacaaatctctctctcgtctccttcaactgcttaccctctgctacctccacagtgtcgccgctacccggtgccgccgcacgcctgcacctgcgtcctgcttctacacaccaccaccgattgtcaccaccgccaataagcacctctgttcctttcctaggcgctaagggaaagaattcaggagaatcaacttttcctttctcacgctagaatcttcttccttccaaagtacaaagagcgtcgatataagcacacacgcactctccaagaaagatcacctgcgaagcaatcttcttctccgccaacatgctccacaacaagtccttcgtcaagaaaaccagggccggcaaagtcatgaagcaagtgcgggagcactacctgcgtgacgacatatactgcggcgcaccgttttgcaccgtttgcgatacttcgggtgctcgcctcaacgcttccccttcaacaaccattcttgtcgtggacaccaatgtcgtgctcaatcagattgatttgctggagaatcaggcattcgataacattgtggtgttgtccattgtgttggaagaggttaagaacaagaatatggctgtttacaatcgtataagagctctctgtagcaattccactaagaagttctatgttttttccaatgagtaccacagggatacatatgttaaggaaatgagtggtgaaactaaaaatgataggaatgatagagctatccgagtggctactcagtggtatcagaatcatcttggtggtgcagtaaaggttttgcttataactaatgatagagagaacaaaaggaaggctagtgaagaaggcatttttgctgaaacagttgagtcatatgtcaagtctttagaccaacctgatctacttgatcttcttgtgcggcctgcatcagaagatgtgaacatggaagaggttgaagatcttagaccatccaagaggaaagtcatatattcagagcataagccaatgtcagaaattacttctggtttgcatcgtggaatatatcatcaagggaagcttcgcgtaaaccgttacaatccatttgaagcatatgttgggagggagagcattggtgatgaaatagttatttatgggcgctcaaatatgaatcgagcttttgatggggatgttgtggcagttgaacttctgccacaggaccagtggcaagaagtctcatctctatctatagctggtgaagaagatgagaatgaggatgaagatgtccatctagctccaaatagcgctgatgttgcacctaggactattcctcagcagggttcttctggacaagtaaatgctgtacctaatcgtccttcgggtcgtattgttggtattataaagaggaactggcattcgtattgtggatctttggagccaatgcctatgcctgcaggaagtggtggaattgcccatgccttgtttgtctccaaagatcgcagaattcccaagcttcgaatccaaacacgccaacttgagaaccttttggataagaggattattgttgcagttgattcttgggatcgtcagtctagatatccatcaggccattatgtgcgaactataggggagataggtgatagagatactgaaagtgaggtggttttgatagaaaatgatataaatacacgaccattctcttcacaagtgctggcatgcttgccaccattgccatggttggtctcttctgaagatttgtccaatccaatcaggcaggacttgcgtcatctgcttgtgttcagtgtggatcctccaggctgcaaggatattgatgatgcactccattgtcacgctcttccaaatggaaactttgaagttggagttcatattgctgatgttacaaattttgttcatcctggcactccacttgatgatgaggcttcacagaggggtacatctgtctaccttgtggagcggcgaatagacatgcttcccaaacctcttacggaggatatatgttctcttcgttctgatgtggaaaggctagcattctctgtcatttgggaaatgacacctgaagcggacattatttccaccagatatacaaaaagtgtcataaagtcctctgcagcattgtcttatgttgaagcacaagcgaggatggatgatagtcgactgagggatcccattactacagatttgaggaatatgaatagtttggctaagaaaatgagattgaggcgcattgagagaggagctttgactctagcatcggctgaagtcaaatttcaaattgacacagagactcatgaccctcttgatattggaatgtaccagatccgggaggccaaccaaatggtggaggagtttatgcttgctgctaatgtttccgttgcagaacaaattcttaaaagtttttcgttgtgctcattattaaggcgtcatccaactccaaccagagagatgcttgaacccttattacagactgctgctgcagttggcttgcacttggatgtttcatcatcaaaagcattggctgattctcttgaccatgctgtgggtgatgatccgtacttcaataagttaatccgtatactggcaactaggtgcatgagtcaggcagtttatttctgcagtggggatcttagccctccagaatatcatcattatgggcttgcagctcctttgtatacccatttcacatcacctataagaagatacgcagatgtcattgtgcacaggctacttgctgcttctttaggaatatcaaagttaccgtctgtatttcaagacagactccagctcagtagtattgcagacaatttaaattatcggcataggaatgcccagtatgcagggcgagcatctgtagagctacatactctaatttatttcaggaagaggcctacagacacggaggctagaatagtgaaaataagatctaatggcttttttgtgtttgttcccaaatatggcatagaaggacctatatatttgacaaaatccggaaagggaaatggagaatggtacgtagatgagcaacagcagaaaataaaaaggatggatggtagcctttcatacagtgttttgcagacagtccaaattcacatggaggttgtggagcctcagcctaaccgtcccaaacttcagcttactctcatctagaggtatatgatcattgaacaacaggcattactcaaatataactcatatttacgattgccatttgcttctcagcacttttaaggaaggaatttactgtggcatgaaaaagttgtggaaagaatgagacggagatgagagattttggttggagaagtttttcctagatggaactcaaggtttatatggttgatggggtggtagcttttagtttttacgactatttatttttaaattgggaagtggaatttttatacatgatgctgcaagcgtgaacactccaagtaaaaggatgtgtttagcttaaaagcgccgtaatgtatttgtagagaatatcagaactattattacattaaaaaatgtggaatcattcaagagactccggagtttagttgttgtagagaattttcccagattattttttctcaccagctataagattttgcttttgcaacattatcatcaactggatccggaactcatggttgtctctgatgtactgctattaggtgtgtgtgcacgaattattacacaatgtgatttatatgcagggatactggcagcgaagagtttatgagcaagcaactcgtttaattagggaacttgtattttatatagggctgtagcaattcttgaaatgtacgtgagaattagtttgcttgaaatactggggataaaagagatagtgaaattcatgtagtatttttacattaccttttttttactttttattttatttttctatcttttttagtttttttcttaaaccaaacatctttatgttttattcaattctcttattttatttc

SEQ ID NO: 2269 - DNA, 3186 bp, Quercus alba
ctagggatagtgtgtgaaaaaggaaatcccgactccccgtccccgagtagcaaaagcaaagagagcagtgcgcagacaagaagaagtaattacaacggcaacaaaacaaaggcagcagcaaacgtaggattgagatttggagaaatcaagaaactcttcgaactcaacacgacacagaaacatgttgcacagcaagaccttcgtcaagaaaaccagaggcggcaaagttaacaagcaagtaagagagcactatctgagagacgatatatactgtggagctcctatttgcaaactctgcgattcctcagctgctcgcttgagtccttctgcttccaccattctcgttctcggcaccaatgtcgttctcaaccagattgatttgcttgagaacccggcgattgacgatgtggtcatgctatcggtggtgctggacgaggttaagaacaagaacatgggtgtctacaatagagttagagctctctgcagcaattccttaaggagatttttcgtctttgctaatgaacaccataaggatacttttgtcaaggaaatggctaaagaaagtaaaaatgatcgaaatgatagagcaatacgggtggctgctcagtggtatcagagtcatcttggtggtgcagctcgcgttttacttataactaatgataaggagaataaaaggaaagctattgcagagggcatttctgcagagacaattgagtcatacgtgaaatcattggatcgacctgatttgcttgacctggtagtgcaaccttcatcagaagatgtcgaaatggaagaagttgaagatttgagaccgtcaaagaggaaagtcatttatacagagcataagcccatgtctgagattacttctggtttgcatcgtggaatttaccatcaaggaaagcttcgtgttaaccgttataatccatttgaagcttatgttgggagtgagagtattggtgatgaaataattatatatgggcgtacaaacatgaatagggcttttgatggtgatatagtggcagtagaacttctgccccaagaccagtggcatgaggagaagtctctatccatagcagatgaagaggatgaagaagaagatgttcatctggttccaagtagcgctgatgatgctcctagaactaccaatctagtgcaaggttctgctggagacacaaatgctgtctcatctcgtccgtccggctgtgttgttggtattataaagcggaactggcattcttattgtggatctttggagccaatgcctatgcctgcaggtagtggtggtacagcccatgccttatttgtctccaaagatcgcagaattcctaagattcgaatccatacccggcagcttgagaatcttctcgacaagagaattattgtggcagttgattcttgggatcgtctttctcgatatccttctggacactatgtacggaccataggagaaataggtgatagagatactgaaagtgaggtggtcttgatagagaatgatataaactcgagaccgttttcttctcaagttctagcatgcttgccaccattgccatggtcagtatcttctgaagatttggcaaatcctattaggcaggatttgagagatttgcgtgtctttagtgtggatcccccaggatgcaaagatattgacgatgcactacactgtacagctcttccaagtggaaattttgaagttggagttcatattgctgatgtaaccaattttgtgcaccctggctccccacttgatgatgaggcttcacaaaggggcacatctgtctaccttgttgagcgacgaattgacatgcttccaaaacctctaacggaagacatatgttctcttcggtctgacgtggaaaggctagccttttctgttatttgggaaatgacacctgaagcggatattatttctacaagatatacgaaaagtgtgataaaatcttgcgcagcattgtcttacattgaagctcaggcgaggatggatgacagtcgattgatggatccattaacaacagatttgagaaatatgaatgttttggcaaagaaaatgaggtctaggcgtattgagagaggagccttaactctagcctctgctgaagtcaaatttcaaattgacactgaaactcatgaccctctagatattggtatgtaccagattcgggaagcaaaccaaatggtggaggagtttatgcttgctgccaatgttgcagttgcagacaaaatccttaaacacttttctttgtgttcactattaaggcgccatcctagtccaaccagggagatgcttgaacctttgctgcggacagctgctgctgttggcctcaacttggatgtctcgtcatcaaaagcattggctgagtcacttgatcatgctgtgggtgatgatccatactttaataagctgatcaggatattggcaactagatgcatgacacaggcagtttatttctgtagtggggatctcagtcctccagaatatcatcactatgggcttgcagcacctctttatactcatttcacttcccctattaggagatatgcagacgtcattgtacaccgtctgctttctgcatctttagggatatacaagcttccatcaatattccaagacagaccccatctaactagtatcgctgacaatttaaattatcgacatagaaatgcccagatggcgagcagggcctcagtagagctgcatactctcatctacttcagaaaacggcccacagacacagaggccagagtagtgaagataagatccaatggctttattgtttttgtgccaaagtatggtatagaaggccccgtgtacttgacaacaagaagcgagaagggtggtggggaatggtttgtagatgagcaacagcagaagattaaaaagatggatggtagcctctcttatagtgttctgcagacggtaagaatccacatggaggttgtggagccacagcccaaccggccaaaactccagctcacccttacttagatgagtcaaatgacattttacattgtttttcaatagcaatgttttatggagctgtaatgtttggtttgaattaagggtggagtactgtagggataggaatgcacaaatactgtaatatagcttgatttagtttatattgattttttgaatcttgtgtggtataatttcagactttattaaattataaatgtaatgtcgtt

SEQ ID NO: 2270 - DNA, 3230 bp, Vitis vinifera
attaaaaagaaacacattttcttttgagtgcaaaaaaaggaaggaatgaattcggcgtagtagtggtagaagaaaagaacacagagccagtgaagtcgagagagactcaatcggagaagaaagatgctgcagagcaaatcgttcgtgaggaaaacgaagcagggaaaagtagtaaaggtggttagagagcattatcttcgagatgatatctactgcggagcgtcgatttgcaaagtgtgcgattcttcaactgctcggttgagtccgtcggcctccactattctcattctcgacactaatgtcgttctcaatcagattgatttgctggagaatccggcgattgatgacgtcgtggtgctgtctgtggtgctggaagaagttaagaacaagaatatttctgtttacaacagacttagaaccctttgcagcaactctatgaggaaattctttgttttctcaaacgaatatcacaaggatacatatgttaagcagatggctggagaaagtccaaatgatcgaaatgatagagcaattcgagtggcaactcaatggtatcagagtcatcttggtgctgcggctcgggttttgcttataacgaatgacagagaaaataagaggaaggctactgaagagggcatttctgcagagacagttgagtcatatgtgaaagcactggggcaaccaggtttgcttgacctgcttgtgcaacctgcccctgaagatgtaggcatggaggaagtggaagatctgagaccttcaaagaggaaagttatctatagtgagcataagcccatgtctgagattacttctggtttgcatcgtggaatctaccatcaaggaaaactacgggttaatcgctacaatccttttgaagcatatgttggaagtgagagcattggtgatgaaataattatctatggtcgtggaaacatgaatagggcttttgatggtgatgtagtagcagtggaacttttgcctcaagatcaatggcaagaggagaagtctttgtctatagcagatgaagaggatgaggaggaagaagatgtccatcttgttccaagcagtgctgatgatgctcctagaaatacagatctagcacagggttcagttggaggcacaaaagctgttttgtgccgtccatctgggcgtgttgttggtattataaagcggaattggcactcttattgtggatctttggagccaatgcctatgcctgcaggcaatggtggtattgcccatgctttatttgtctccaaagatcgcagaattccaaagatccggattcaaactcgacagcttgggaaccttctggacaagagaattattgtggcagttgattcatgggattgtctatcacgatatccttctggtcattatgtgcgtactataggagaaataggtgatagagatactgaaagtgaggtggtgttgatagagaatgatataaactcgagaccattttcattgcaagttttggcatgcttgccaccattaccatggtcagtgtcttctgaagacctggcaaatccatgtaggctggatttgcggcatgtgtgtgtttttagcgttgatcctccaggatgcaaagatatagacgatgcactgcattgtacaactcttccgaatggaaattttgaagtgggagttcacattgctgatgtaacaaattttgttcaccctggcactccccttgatgacgaggctgcccaaaggggcacatctgtctaccttgttgagcgcagaattgacatgcttcctaaacctttaacggaagatatatgttctcttcggtctgatgtggaaaggctagctttctctgttatttgggagatgacacctcaagcagagattatttctacaaaatatacaaaaagtatcattaaatcttgtgcagcattgtcatatattgaagctcaagctaggatggatgatagtcgcttgatggatccattaactatggatttgcgaaatatgaatgctttggcaaaggtcatgaggcttaggcgtattgagagaggagccctaactctagcttctgcagaagtcaaatttcaaattgatactgaaactcatgatcctcttgatattggaatgtaccaaattcgtgaagcaaaccaaatggttgaggagtttatgcttgctgctaatgtttcagttgcagaaaaaatcctaaagcattttccgctttgttcattattaaggcgccatcctagtccaaccagagaaatgcttgaacctttgctgcgtacagctgcagctgtgggtctcaatttggatgtttcatcatcaaaagcactggctgattcacttgatcatgctgtgggtgatgatccatacttcaataagcttattcgaatactagcgactagatgcatgacacaggcagtttacttctgtagtggggatcttagtcccccagaattccatcattatgggcttgcagcacctctctatactcatttcacctctcctataaggagatatgcagatgtcattgtacacaggctacttgctgcatctttagggttatacaaacttccgacaatattccaagacaatgcccaactcactagtactgcagacaatttgaattatcggcatagaaatgcccagatggcaggccgggcctcggtagagctgcatactctaatctatttcaggaaacggccgacagacacagaggccagaatagtgaagataagatccaatggctttattgtatttgtgcccaagtatggaatagaagggcccgtgtaccttacaccgagaggtgaaaagggaggtggtgagtgggtggtagacgagcagcagcagaaggtaaagaagatggacggtagcatttcctacagtgttctgcaaacagtaatgattcacatggaggttgtggagccccagccaaaccggcccaagctcgaacttgcccttatctgcagatgatatgtaagtaaaccagttttcaatattttatagagatgatcaatgaatagagaatgcattgtggaacagtttattctgtacaattaacatgggatgagtgctgaaatattgtaatttctatttaacttaattcttttttcaccaaggttttaataaattttgttagttattttgttttaaaatttttcctttgtttttgaagtctacatgccctgtttttcggctgctaagatgtgtacttacaaagcaattagaaaatggagtgagaattacattggacaccgatttgcttt

SEQ ID NO: 2271 - DNA, 2893 bp, Prunus persica
aagccaaaacgacgccgtcagccatacgatcatagaccaaacatgttgcagaacaagtccttcgtcaagagaaccagaggaggcaaaatcaccaaggtcgtgagagagcactatctcagacacgatatatactgcggagctccgatatgcaaagtttgcgatacatcccaggctcgcttgagccctacgccttccaccattctcattttcgataccaatgtcgttctcaatcagattgatttgcttgagaacccagcaatcgacgatgtggttgtgctttccattgtgcttgaagaggttaagaacaggaatttgtctgtttacaatagagttagagctctctgcagcaattctttaaggaaattctttgttttctccaacgaacaccacaaggatacatatgttacggaaatgagcggagagagtaaaaatgatcgaaatgatagagcaattcgggtggctgctcaatggtatcaaagtcatcttgctggttctgcccggattttacttataactaatgacaaagagaataagagaaaggctattgaagagggaatttctgcagaaacagtggagtcttatgtgaggtcattgagtcgaccagatttgcttgacctgcttgtgcagcctgcatcagaagatgtaaacatggaggaagttgaagatttgagaccatcaaagaggaaaatcatttacacagagcataagcccatgtctgagattacgtctggtttgcatcgtggtatataccatcaaggcaaacttagagtgaatcgttacaacccatttgaagcatatgttggaagtgagagcattggtgatgagattataatctatggacgtacaaacatgaatagggcttttgatggggatatagtggcagttgagcttctgcctcaggatcaatggcatgaggagaaatctctagctctagcagatgaagaggatgaggaagaagatgttcatctggttccaggaagtgctgatgatgctccttggactacagctcaaccaccaggttctgctggagtaacagagtctatctcaagccgtccatctggccgtgttgttggtattataaagcggaattggcattcttattgtggatctttggagccgatggctatgcctgcaggtagtggtggtgttgcccatgccttatttgcctcgaaagatcgtaggattcctaagattcgaatacacacacgacagcttgagaatcttctggacaagagaattgttgtggcggttgattcttgggatcgtttgtctcgttatccttctggccattatgtacgaaccataggacaaataggtgatagagatactgaaactgaggtggtcttgattgagaatgatataaatacaagaccattttcttctcaagttctggcatgcttgccaccgttaccatggtctgtgtcttctgaagatttggcaaattctattagacaggatttgcgacaattgcgtgtctttagtgtggaccctcctggatgcaaggatattgatgatgcattgcaatgtacatctcttccaaatggaaattatgaagttggagtccatattgctgatgtaacaaattttgtacactcggacactcctcttgatgatgaggcttcacaaaggggcacttcggtctacctagttgaacggcgaattgacatgcttccaaaacctttgacggaagatgtatgttctcttcgagcagatgtggagaggctagctttttctgttatatgggaaatgacacctgaagctgagattatttctacgaggtacacaaaaagtgtcatcaaatcgtgtgcagcattgtcttacattgaagctcaagcgaggatggatgatagtcggttgatggatccattaactacagatttaagaaacatgaatgctttagcaaagataatgagggaaagacgtattcagagaggagccttaactcttgcatctgctgaagtcaagtttcaaattgacaccgagactcatgatcctcttgatattggaatgtaccagattcgtgaagcaaaccagatggttgaggaatttatgcttgctgctaatgtttcagttgccgagaagatccttaaacattttcctctttgttcactattgaggcgccatcctactccaacgagagagatgcttgagcctttgttgcgtacagctgctgctgttggtctcaacttggatgtctcatcatcaaaagcactggctgattcacttgactctgcagtggctgatgatccatacttcaataagctgattcgtatattggctactagatgcatgacacaggctgtttatttctctagcggggatctcagccctccagaatatcttcattatgggcttgcagcacctctatatactcattttacttctccaataaggagatatgcagatgtcatagtgcacaggttgcttgctgcatctttagggatacagaagcttcctgctatattccaagacggaacccggctaactagcattgctgacaatttaaattatcgacatagaaatgcccagatggcaagccgggcctcagtggagctccataccctcattttcttcaggaaacggccaacggacacagaggcaagaatagtaaggataagatccaatggattttttgtatttgtgcccaagtatggaattgaagggcctgtctacttgaccccaagaggtgataaggaaggcggagagtggtttgttgacgagcagcagcagaagattagaaaaatggatggcagcatgtcatacagtgttctgcagacggtgtttattcatttggagattgtggagccccagcccaataggccgaaactccagcttacgctagtgtagccaagtaactttgccctctccccagtactctgttttcagatgagaa

SEQ ID NO: 2272 - DNA, 3276 bp, Malus domestica
atgtagaagtaagaccactcgaagccgccgctcgtatatctctctcgcggcagtcccattccagttcactcgccacttcaccagcaaccgaaaacgacgccgtcgcacgtatcagggaggccgaaacatgttgcagaacaagtcattcgtcaagagaaccagaggcggcaaaatcaccaaggtcgtgagagagcactatctccggcacgatatttactgtggagctccggtatgcaaagtttgcgatacgtccggagctcgattgagccctaccgcttccaccattctcatcttcgataccaatgtcgtccttcatcagattgatttgattgagaatccggcaatagacgatgtggttgtgctttcgattgtgttggaagaggttaaaaacaggaacttgtctgtttacaatagagttagagctctgtgcagcaattctttgaggaaatttttcgtcttttcgaacgaacaccacaaggatacttatgttacagacatgagcggagaaagcaaaaatgatcgaaatgatagagcaattcgggtagctgctcaatggtatcaaactcatcttgctggttcagctaaggttttacttataaccaatgataaagagaataagaggaaggctattgaagagggaatttctgcagagacagttgaatcatatgtgaggtcattgagtaggccagaattgctcgaccttctcgtgcagcctgcatccgaagatgtaaagatggaggacactgaagatttgagaccatcaaaaaggaaagtcatctactcagagcataagcccatgtctgaaattacttctggcttgcatcgtggcatataccatcaaggaaaacttcgagttaatcgttacaacccctttgaagcatatgttggaagtgagagcattggtgatgaaattataatatatggacgtacaaatatgaatagggcttttgatggtgatatagtggcagttgagcttctgccgcaagatcaatggcatgaggagaagtctctagctttagcagatgaagaggatgaggaagaagatgttcatctggttccaggcagtgctgatgatgctcctaggactatagctgcccaaggctctgctggagtaacagaacctgtccaaaatcgaccatctggccgtgttgttggtattataaagcggaattggcattcttattgtggatctttggagcccatggctaagcctgcgggtggtggtggtattgcccatgctttatttgtctcaaaagatcgaaggattccaaagattcgaattcaaactcgacagcttgagaatctgatggataagagaattattgtggcagttgattcatgggaccctttgtctcggtatccttctggccattatgtacgaaccataggagtaataggtgataaagatactgaaactgaggtggtcttgattgagaatgatataaatacaagaccattttcttctcaagttcttgcatgcttgccaccgctaccatggtttgtgtcttctgaagatttggcaaatcctattagacaggatttgcgacaattgcgtgtctttagtgttgatcctcctggatgcaaggatattgatgatgcattgcactgtacagctctgccaaatggaaattacgaagttggagtccatattgctgatgtaacaaattttgtacactcgggaactcctcttgatgatgaggcttcacaaagaggcacatcggtctaccttgttgaacggcgcattgacatgcttccaaaacctctgacggaagatatatgttctcttcgagctgatgtggaaaggctagctttttctgttatttgggaaatgacagctgaagctgagatcatttctacaagatacaccaaaagtgtgattaaatcatgtgcagcattatcttacattgaagctcaagcgaggatggatgatagtcggttgatggatccattaactacagatttaagaaacatgaactctttagcaaagataatgagggcaaggcgtattgagagaggagccttaactcttgcatctgctgaagtcaaatttgaaattgacacagagactcatgatcctcttgatatcggtatgtaccagattcgtgaagcaaatcaaatggtggaggagtttatgcttgccgctaatgtttcagttgctgagaaaattcttaaacattttcctctatgttcactattgaggcggcatccttctcctaccagagagatgcttgaaccattgttgcgtacagctgcagctattggtctgaacttggatgtctcatcatcaaaggcactagctgattcacttgactctgctgtgggtgatgatccgtacttcaacaagctgattcggattttggctacaagatgcatgacccaggctgtttacttctgtagtggggatcttagccctccagaatatcttcactatgggcttgcagcatctctatacactcatttcacctctcctattaggagatatgcagatgtcataacacacaggttgcttgctgcatctttggggatatacaagcttccaactatattccaagatggaccccgactcacaagcattgctgacaatttaaattatcggcataggaatgcccagatggcaagtcgggcctcagtggagctccatactgtcatttttttcaaaaagcggccgacagacacagaggcaagaatagtcagaataagatccaacggatttttcgtatttgtgcccaagtacggcatagaagggccggtgtacttgaccccaaggggtgagaaggggggcggagaatggtatgtagatgagcaacaacagaagattagaaaaatggacggtagtatttcatacagcgttctgcagacggtgtttattcacatggagattgtggaaccccagcccaacaggccaaaactccaactatcgctagtgtagaccagcaactttgcctctccccagtaccctcctttaagatgagaaaagtgtctggaatggtggcgtgagccaggagcttggctctaaccatcttgggcagcgaagatatgtcacgggacacacattgaaatattgtatagtttcatttagtacagtttgttttactgcgtgaacttaaggtgtgagtaagagttttggtaaatcgggtgtagagctgagaggttagcagcagtctgcgagttaaagacgggatgccgtcgaaacagtgctgtgttttgtgcacaaaatttgcattcaagaggtgtaattcaaactgttttttcccaaggtatcacttttatctgtta

SEQ ID NO: 2273 - DNA, 3336 bp, Eucalyptus grandis
catgctgcacaacaagtccttcgtcaagaagacgagagcaggcaaaatcaccaagaatgtgagggagcactacttgcgggacgatatctactgcggagtcccgacgtgcaaggtctgcgacgcttccgccgctcgcctcagcggctccgcctcctccccgatcctcgtcctcgacacgaacgtcgtcctcaatcagattgatttgctggagaatccggcgatcgatgatgtggtcgtgctgtccatcgtgctgcaagaggtcaggaacagaaatttggccgtctataatagaatcagagcgctctgcagcaatttggcgaagaaattctttgtcttttcgaatgagcaccacaaggatacatttgtccaggacatggctggtgaaagtaaaaatgacaggaatgatagagctatacgtgtggcggctcagtggtatcagagtcatcttggtggtgctgcccaggttctgctcataaccaatgacagggagaataaaaggaaagctacagaagagggcattccagcagagaccattgaagcgtatgtaaaatcactggaccgcaaggatctgctagatttgcttgtgcgtcctgcatcagaggatgtagtcatggaaggagttgaagatttaagaccatcaaagaggaaagttatatatactgagcacaagcccctttctgaaattacttctgggttgcatcgaggaatatatcaccaagggaagcttcgcgttaatcgatacaatcctttcgaagcatatgttggaagtgaaagtattggtgatgaaatcattatatatgggcgtggaaatatgaatcgagcttttgatggtgatatcgtggcagtggaactcctgcctcaagatcagtggcaagaggagaattctttatcattagcagatgaagaggatgaagaggaaggagttcatctggtcccaggcagtgcagatgatgctcctaggactacaaatctggtgcagggtgcttctggtccacctccatctcgcccatctggccgggttgttggtatcataaagaggaactggcattcttattgtggatcattggagcccatgcccatgccggccggagatgggggtgttgcacatgcactatttgtttctaaggacaggagaattccaaaaattcgcatccaaactcgacagcttgggaaccttctgaacaagaggattgtcgtgactgtggactcctgggaccgtctttcacgttatccttctggtcattatgttcgtacaattggagaaataggtgatagagatgctgaaagcgaggttgtattgattgagaatgacattgatgcaaggccattttcttctcaagtattggcatgtttgcctccattaccatggtcagtctcctcagaagatttggcaaatcccatcaggcaagatttacggcatttgcgtgtcttcagtgtggatcctccaggatgcaaggatattgatgatgccctgcactgtacagccctttccaatggaaattttgaagttggagttcatattgctgatgtgacaaattttttgcacccttccacaccactcgatgatgaggctgcgcaaaggggcacttctgtttaccttgttgagcgccgcattgacatgcttccaaagcctttgacagaagatatatgttcacttcgggctgatgtggagagactggctttttctgttatctgggaaatgacacctgaagcagagataatatccacaagatatacaaaaagcattattaaatcatgtgcagctctgtcttatattgaagctcagacaaggatggatgacagtcggttggcagatcccttaactacagatttgagaaatatgaatacattggcaaagattatgaggcataggcgtattgagagaggagccttaacacttgcttctgccgaggtcaaatttcaaattgacactgagactcatgaccctcttgatattggcatgtatcagattcgagaagcaaaccaaatggtggaggagttcatgcttgctgccaatgtttcagttgctgaaaaaatccttaaacactatcctctatgttctctgttgaggcggcatcctataccaacaaaagagatgctcgaacccttgctgcgtacagctgcttctgttggtcttgagttggacgtatcttcatcaaaagcactggctgattcacttgaccgtgcagtgggagaagatccatattttaacaaattgatacgaatacttgcaactagatgcatgacacaggcagtatatttctgtagtggagacttgactccgccagaataccaacattatgggctggctgccccattatatactcattttacttcacctatcaggcgatatgctgatgtcattgtgcacaggttgcttgctgcatcattaggaattgacaagcttccagccatatttcaagacagaccccagttaacgagtattgctgacaatctgaattaccgacatagaaatgctcagatggctggtagagcctcagtggagctccatacgctcatctacttcaggaagcggcccactgacactgaagctagaattgtcaagattcgatccaatggctttattgtgtttgtacctaaattcgggattgaaggacccgtatacttgacagagagaagtgagaagggaggaggggaatggtttgttgacgaacagcagcagaagataaaaaagatggatggaagcattagttatggggtcttgcagaaggtgaacattcacatggaggttgtggagcctcaaccgaatcggccaaaacttcaacttgccctggtttaggtatgttaaaatagacatgtttagtgtagcagcaacaccatgtcagctattgagtaatggagctcgtccatcaaaattatggtaaagaactttgccgatctcagcgcctccgcaaaatcagagtttgtcgggggagcaatgtaacataacatatggtgttcgcctgcatagattagattcttccttttttgcggggtgagggtgctgcaaagtacttttatagacggccattcaaactgtttgtttttattctccttttatttctctataacctgttttcatatacttttgatatgaagtgggaattttttcttctttcttttctttatttatttgttttggtttcttatgtaatttttttaatctaagttacttggacaagttgtacgagtcagaggcaatagaacgtatttacgaattttgtttttgaatcactttccctagagtgacaatgtatcgtcttcttactatgtgaatttttcttcgcaattgtgatgtttctaaagataatgaggagaggttgagcctgaacattg

SEQ ID NO: 2274 - DNA, 3418 bp, Ricinus communis
atatacaaataaaaagatatataaataaataaaaatttgtatcttcgaaagaacaaatttgtagggaaagaatttgaaaacagtcaattgaagaagagaaacccaaaccctcgtacagtgtcgtccctaaactcaatagaccgtacagttgcagagactgcaagcgcctgatgaataggttttttattcttttgagtgctattctactttagaagaataagaagtgtggacactgtaatcagctgctaaaaactcaagaaactcaattttatataaggagaaaaatgttacacagcaaaacattcaataaaaagacaagaggcggcaaagttcaaaagcttgtcagggaagtttatctgagagacgacatttattgtggagcttcattttgtaaagtatgcgatacttcagccgcgcgtttgactgcttctgcttcagcaattcttgttcttgatactaatgtcgttctcaatcagattgatttgctggagaatccagcaattgaagatgtggttgtgttatcaattgtgctacaagaggttaagaataagaatactgctgtttataatagaattcgtgccctctgtagcaatcctgctcgcaaattctttgttttctccaatgaatttcatagggatacatatgtccagataatgactggtgaaagccctaatgatcgaaatgatagagcaattagggttgctactagttggtatcagactcatcttggtgatgctgcaaaagttttgcttattacgaatgatagggagaataaaaggaaggctactgaagagggtgttgttgctgaaacaattgaagcttatgttaaatcactaggtcaaccagctttgcttgacttgcttgttcagccttcttctgaagatacagtcatggaggaggttgaagatttaagaccttcaaagaggaaggttgtttacccagagcataagcccatgtcagagatcactgctggcttgaccagcggaatatatcatcaaggaaaacttcgtgttaaccgttataatccatttgaagcatacgttggaagtgagagcattggcgaggaaatcgtcatttatggccgtggaaatatgaatagggcttttgatggtgatatagtggctgtggaacttcttccccaagaccagtggcgagaagatggttctatgtctatagcagatgaagatgacgatgatgaaggagtccatctagttccaaacagtgcagatgatgctcctcgaacaacaaatccagtatcaagttctgctagtgacacaaatcctatctccactcgtccatctggtcatgttgttggaattataaagcgcaattggcattcctattgtgggtctttggagccaatgccagtgcctgctggaagtggcggtcttgtctatgctttatttgtctctaaagatcggagagttcctaaaattcgaattcaaactcgacagctccaaaatcttctggacaaaagaatcatagtggcagttgattcttgggaccgtcaatcacggtatccttctggtcattatgtacgaagtataggagagataggtgatagagatactgaaactgaggtggtcttgatagagaatgacatagatgcaagaccattttctgctcaagttttggcatgtttgcccccgttaccatggtcggtttccgaggaggatttagccaatccgattaggacagatctgcggcatttgcttgtcttcagtgttgacccgccaggatgcaaggatattgatgatgcattacattgtacgatgcttccacatggaaattttgaagttggagttcacattgctgatgtaacgaacttcgttcacccgagtaccccacttgacgatgaggctacacaaagaggcacatccgtttaccttgttgagcgtcgtattgacatgcttccaaaacctctaacagaagatatatgttctcttcgagctgatgtggagaggctggctttttctgtcatttgggaaatgacccctcaagcagagatcattactacaagatacgcaaaaagtgtaataaagtcatgtgcagcattatcttacatcgaagctcaggcaagaatggatgacagccgattgatggatcctgtaactaaagatttaagaaatatgaacgctttggctaagataatgaggcagagaagaattgagagaggagcactaactcttgcttcagctgaagtcaagtttcagatagataccgagactcatgaccctcttgacattggtatgtatcagattcgggaagcgaaccaaatggttgaagagtttatgcttgctgctaatgtttcagtagctgaacaaatccttaaacaatttccaggctgttcactcttaagacgtcatcctactccaactaaagatatgcttgaacctttgctgcaaacagctgcttctgttggtctgaccctggatgtctcatcatcaaaagcactagctgattccctcgaccgtgctgtaagtgatgatccatacttcaacaagttgatccgtataatggcaacaagatgtatgacacaggcagtctacttttgtagtggggatctcagccctctagagtttcatcattatggtctggcagcacctttgtatactcatttcacatcacctattagaagatatgctgatgtcattgtccacaggttgcttgctgcatccttagggatatacaaacttccaacaattttcagagacagaccccagctaactagtattgctgacaatttgaactaccgtcatagaaatgctcagatggcaagcagaggctctgtagagctgcatactctcatatactttagaaaacggcccacagacacggaggccagaatagtgaagataaggtccaatggctttatagtgtttgtgcctaagtacggtatagaagggccagtgtacttgaccccaaggggtgagaaaggcggtggagaatggtttgtggatgagcagcaacaaaaaatcaagaagatggatggtagcctttcttatggtattttgcaggcagtgagaattcacttggaggttgtggagccccagcccaatcgtccgaaactccagcttacgcttctgtaaattgtgtggtacttgggaggaattgttacctgattccttgaaacaatgtctagttttttgcacaaagaagagaaaggaaatacaatatctagtttgaaactgtggaggataggataagctttgctgggggagtaaaattttgtaatgtagcatcttttatttgtttttaaccaaaaaataatcttttttaataattttttagagtttattgtaatatctttctgcttataatttatgaagttgcttttttgttttggacgttgtctttggagaatgatgtctcatgaactatacggagaacgactcgataaagagttgttaataagggc

SEQ ID NO: 2275 - DNA, 3137 bp, Beta vulgaris
acaaactgtattttcaagcgcccaatgcagcggcgcaagagttaaaccctataaaccttgcaacttgcaattaaattatttcctcaacaagctaattacttcaaattatttgctgttctttgaacaatttgattcaattcattgtaataagcggaacaaattcgcgctcaaaaatgctgcaaagcaaatcctttgtcaagaaaaccaagggaggcaaagttgtcaaggttgttcgagaacactatttaagagatgatatctactgtggagcttcaatttgtaaaatttgtgattcttcagttgctcgtttattctctgatgcttccactctacttattctcgatactaatgttgttctaaatcagattgatttacttgagaatccagcaattgatgaagtggtggtgttgtcagtggtgttggatgaggttaagaataagaatctgtctgtttacaacaggcttagagcgctttgcggcaattctcaaaggaagttttttgttttttcaaatgagcatcataaggagacctatgtcaaaggtatgattggtgaaagtccaaatgatcgaaatgatagagcaattcgtgtggcaactcaatggtatcagaaacatctaggctctgcagtacgagtcttactggttaccaatgatagggagaacaaaaggaaagcaaatgaggaaggcatacttgctgagacagttgagtcatatgtcaaatcacttggtcaaccagcattgctcgatctggttgcgcaacctgcatctgaggacatggtgatggatggtgttgaagacttgagaccttccaagaggaaagtcatttacagtgagcataaaccaatgtctgagatcactgctggtttacaccgtggcatttaccatcaaggaaaacttcgtgttaaccgttataatccatttgaagcatatgttggaagtgaaagtattggggatgagatagtcatacatggacgaacaaacatgaacagagctttcgatggtgatatagtggctgtggaacttttgcctcaagatcagtggcatggagagaagtctagaatagcagatgaagaggatgaggaagatgaaaatgttcgactagctccaaatagtgctgatgatgcacccagaaatacaaatgtccaaggctccagtgcagatgatactcctggtcgtccatctggacttgttgtgggtgtcataaagcgtaactggcactcttattgtggatctctagaaccaatgtctttgcctgctggtagtggtggcactgtccatgctttatttgtttcaaaggatcgaaggatacctaagattcgtattcaaactcgacagcttgggaaccttttggataagagaattattgtggctgttgactcttgggatcgtttatctcgctatccctctggtcactatgtccaaaccattggagtaattggtgatagggaaactgaaactgaggtggtactaatagagaatgatataaactctcgaccattttcctctcaagtgttggcttgtttgccaccattaccatggtcagtgtctcctgaacatctatctgatcccaacagagaggatctaagaaatttgcgagtttttagcgttgatcctccaggttgccgggacattgatgatgcgctccattgtatacctctcccaaatggaaactttgcagtgggagtccatatagctgatgtgactaattttgtccattctggaactcctcttgatgacgaggcttcacaaagagggacatcggtgtatcttgtggagcggcgaattgacatgcttccgaaacctttgacggaagatatctgctccctcagatcagatgtggaaaggctggccttttctgttatttgggaaatgacgccacaagcagatattatatcttctaggttcacaaaaagtgtcatcaagtcatgtgcagcaatgtcatacgttgaagctcaagcgaggatggacgatagtcgtctggtcgatccgctaacaaccgatcttagaaatatgaatactttagcaaagataatgaggcaacggcgtatagagagaggagccttgacacttgcttctgcagaggttaagttccagattgatactgaaactcatgatcctcttgatattggaatgtaccaaatacgagaagctaaccaaatggtcgaggagtttatgcttgctgccaatgtttcagttgcaggcaaaatactgaaacattttccatttgttcattattaaggcgtcacccttctccaacacgagagatgcttgagcctctgctacgcactgctgctgccattggtcttgatttggatgtctcatcatctaaggcacttgctgattcacttgatcgggctgtgggttctgatccttatttcaacaagctgatccggattctagcaacaagatgtatgacacaggcagtatatttctgcagtggagatctcagtcctccggagtatcttcattatggtcttgctgctcccttgtacactcattttacttctcctatcaggagatatgcagatgtagtagtacacaggttattggctgcatccatagggatatccaagcttccagcaatatttcaggataggcctcaacttactagtattgctgacaatttgaattatcgacatagaaatgcccaaatggctggccgggcttcagttgagcttcacactctaatatactttagaaaacggcccactgatgcagaggcccgaatagtgaagatacgatccaatggttttattgtatttgtgcccaagtatggtattgaggggcccgtgtatttaactgcaagaggtgacaagggaaatggagactgggtggtagacgagcagcgtcagctggttaaaaaggcagatgagagcgttagctacaatgttttgcagatggtgaagattcatctggaggtggtagaaccgcagccaaataggcctaaacttcaacttactcttacagaataattggcaattctcattttactttgttcattgcgaggcacaaaagctatccgtaccattgatgttccttttagaagtaatttgttagctttcctcctgtaaaactgagttggttgaagtaacatttatcgtgaagtatatatcaatgagacttggtaagatttgatcc

SEQ ID NO: 2276 - DNA, 3017 bp, Citrullus lanatus
aataatagttgaagctgccgttagaagacatgttgcacaacaaatcatttgttaaaaagacgaagtcggggaaggtgatgaagcaagtgagagaacactatcttcgagatgatatatattgtgggacttcaatttgcaaaaaatgtgattcttctgttgctcgattgggcgcttctacatcgccaattctagttcttgacaccaatgttgttcttactcagattgatttgcttgagaatcctgctattgatgatgtggttatgctatcagttgtgctggacgaggttaagaacaagaacttgtctgtttacaatagagttagagctctctgcagcaatcctttgcggagattctttgttttctctaatgagcaccacaaggatacatatattaaggagatgagtggagaaagtaaaaatgatcgaaatgatagagcaattcgagtggctgctcagtggtatcagaatcatcttggtggtgctactcgcattctactcataaccaacgacagagagaataggagaaaggctattgaagagggaatttgtgcagagacaattgaatcatatgttagatctttgggtcaaactcatttacttgacctgttagtccaaagtgcaaatgaagatgcaaatatggaagaagttgaagatttgaggccatcgaagagaaaggttctttactctgagcataaacccatgtcagaaattacttctggtttgcatcgtggtatatatcatcaaggaaagctccgtgttaatcgatacaatccgtttgaagcatatgtgggaagtgagagtattggtgatgaaattatcatttatgggcgtaccaacatgaaccgggctttcgatggtgatgttgtggcagttgaacttctgtctcgagatcagtggcatgaagagaagtctctgactatggtagatgaagaagatgatgaggaagaagatgttcatcttgttcctggtagtgctgatgatgccccaagagctgcatctgtcctacagggctctagtggagattcttcttctagttcaccacgtccagctggacgtgtcattggtatcataaagcgtaactggcattcttattgtggttctttggatccaatgcctatgcctgccggaagtggtggcgtcgcctatgctctatttgtttccaaagatcgtcggattcctaaaattagaatccaaactcgtcagcttgagaatcttttggacaagagaattattgtagcagttgattcttgggaccgtctatctagatatccttcaggacattatgtgcgatctataggagaaataggagatcgagatacagaaagtgaggtggtcttaattgaaaatgatataaactccaggccattttcttcacaagttatggcatgcttgccaccattaccatggtcagtgtcttctgttgatgtggcaaaccccattcgacaggatctgcggcatttaaatgtttttagtgtagaccctccaggttgcaaagatatcgatgatgcacttcactgtacagctcttccaaatggaaattttgaagttggagttcatattgctgatgtaacaaattttgttcatccgggcactgcattggatgacgaggctgcacaaaggggcacatcagtctaccttgttgagcggaggatcgatatgcttccaaaaccgttaacagaagaaatatgttctcttcgagctgatgtggaaagactggcattttcagtaatttgggaaatgacacctgaagccgatatcatttctactagatacaccaaaagcatcattaaatcgagtgctgcattatcatatgttgaagctcaagcgaggatggatgacagtcgattgatggatccaataactagagatttgagaaatatgaatgctttagcaaagaaaatgaggttgagacgaattgagagaggagctttgactcttgcttctgctgaagtcaaatttcaaattgacaccgagacacatgaccctcttgatattggtatgtaccaaattcgagaagctaaccaaatggttgaggagtttatgcttgcggcaaatgtttcagtagcagaaaaaattcttaagcattttccgctttgttcgttattaaggcgccatcctacaccaactaaagagatgcttgaacctttgattcgcacagctgtagctgttggtcttgacttggatgtctcatcatccaaagctctggctgattctcttgatcgtgccttgggtgatgatccgtacttcaataagctgatcagaattttagctactagatgtatgacacaggcagtttacttctatagtggagacctcagtcctccagaatatcaacattatggacttgcagctcctctgtatacccatttcacctctcctattcgacgatatgcagatgtcatcgtgcacagattgctcgctgcgtctttgggaatattcaaacttccaacactattccttgaccgaccgaaactcacttcaatcgctgataacttaaattaccgacacagaaatgcccaaatggctggccgggcttcagtggagcttcataccctaatttacttcaaaaaacggcctacggacacagaggccagaatagtgaagataagatcaaatggttttatagtatttgttcccaaattcggtattgaaggaccggtatacttgtcgggaaaaggtgagaagcaaagtggagaatggtttgtggatgagcaagaacagaagatcaagaagttggatggaagcattacatacaacattctacaagcggtgagaattcacatggaggttgtggagccccaaccaaatagaccaaagctccaacttactcttctttaaacttaatttttcttggctttgcctctaagaacacttttgtatgagtaaaaggtaggaaagtagaatttttttagggagtgggtttttgtagtaaaagctcatgttgtgagtgagagtattggtggaacaatgtatatttacttttattcaaaatattttttacacatatttcttcaaatt

SEQ ID NO: 2277 - DNA, 2989 bp, Manihot esculenta
tatagtagaaaagaaacccttccccgctcgcagcccgtactgtggcagagaaacgcagcagctcttagtggtgttacattgcagaagtaggcatcgcttagctacaagaggaggaagaagaagaagaagaagatcattatatagctgcgccaatcattttctgctcgacatgttgcacagtaaaaccttcagtaagaagactcgaggaggcaaagttcaaaagctcgtaagagaagtatatctaagagatgacatttattgtggagcttcattttgtaaagtatgcgatacctctgctgctcgcttcactgcttctgcttcaactatcctcgttcttgacactaatgttgttctcaatcagattgatttgcttgagaatcccgctattgaagacgtggttgtgttatcagttgtactgcaagaggttaagaacaagaatactgctgtttataatagaattcgtgccctctgcagcaatcctgctaggaaattttttgttttctccaatgaattccacagggatacatatgttcagaacatgactggagaaagccccaacgatcggaatgatagagcaattagggttgctaccagatggtatcagagtcatcttggagatgcagtcaaggttctacttatcactaatgatagggagaataagaagaaggctactgaagagggagtttctgcagagacgattgagtcttatgtgaaatcattgggtcaaccagctttgcttgacctccttgctcagcctgcttctgaagatataatcatggaggaagttgaagatttgagaccttcaaagaggaaggttgtttatcccgagcataagcccatgtccgagattactgctggtttgaccagcggaatatatcatcagggaaaactccgtgttaatcgttataatccatttgaagcatatgttggaagtgagagcatcggtgatgaaatagtcgtttatgggcgtggaaatatgaatagggctttcgatggcgatatagtggcagtggaaattcttccccaagaccagtggcgtgaggatgaatctttgtctatagcagatgaagatgatgataatgaagaagttcatctagttccaagcagtgcagatgatgcccctagaactacaaactcagtatcaggttctgctagcgacacaaatcctatctccggtcgtccatgtggtcgtgttattggcatcattaagcgtaattggcattcttattgtggatctttggagccaatgcctatgccagcaggaagtggtggtcttgtctatgctctatttgtctccaaagatcgaagaattcctaagattcgaatccaaacccgacagcttgaaaatcttctggacaaaagaattattgtggcggttgattcttgggaccgtcagtcacggtatccttctggtcattatgtacgaagtataggagagataggtgatagagatactgaaactgaggtcgtcttgatagagaatgatatagatgcaagaccattttctgctcaagttttggcatgcttgccaccattaccatggtcagtttctgaacaagatttggtgaatcctattaggacagacctacggcatttgcgtgtctttagtgttgatcctccaggatgcaaggatattgatgatgcactacactgtatgatgcttccaaatggaaattttgaagttggagtccatattgctgatgtgacaaactttgttcatccgggcactccgcttgatgatgaggctactcaaagaggcacatctgtgtaccttgttgagcgtcgtattgacatgcttccaaaaccactaacagaagatatatgctctcttcgagctgacgtggaaaggctagcgttttctgtaatttgggaaatgaccccggaggcggagattatttctacaagatacataaaaagtgtcatcaaatcttgtgcagcattatcttacgttgaagcacaggctaggatggatgacagccgattgatggatccagtaactaaagatttgagaaatatgaacactttggcaaagacaatgaggcagaggagaattgagagaggcgcactaacccttgcatctgctgaagtcaagttccagattgatacggaaactcatgatcctcttgacattggtatgtatcagattcgagaagcaaaccaaatggttgaggagtttatgcttgctgctaatgtttctgtagccgaacaaattcttaaacattttccagggtgttcactattaaggcgtcatcctactccaaccaaggatatgcttgaacctttgctgcgtactgctgcttctgttggtctgaacttagatatctcatcatcaaaagcactagcagattcacttgaccatgctgtgagtgatgatccgtatttcaacaaacttatccgtataatggcaacgagatgtatgacacaggcagtgtatttttgtagtggggatctcagccccccagagtttcatcattatggtcttgcagcacctctatatactcatttcacatcacctattagaagatatgctgatgtcattgttcataggttgcttgctgcgtctttagagatatacaaacttccaacaatattcagagacagaccgcagcaaactagtattgctgacaacttaaattaccggcataggaatgctcagatggcaagtcgaggctctgtagagcttcatactctcatatacttcagaaaaaggcccatagacacagaggccagaatagtgaagataaggtccaacggcttcatagtatttgtgcccaagtatggtatagaaggaccagtgtacttgacaccaaggggcgagaaaggaggtggggaatggtttgtggatgagcagcaacaaaaaatcaagaagatggatgggagtctttcttatggtattttgcaggcagttaaaattcacttggaggttgtggagcctcagcctaaccggcctaaactccaacttacgcttctataaattgtgtgtagcttg

SEQ ID NO: 2278 - DNA, 3155 bp, Aquilegia formosa
agagagagagagagagagagaacacgtttgtttaagcgcggcaaagcaaagaaagatgttgcagagcaaatccttcgttcgaaaaacaaaacaaggcaaagttcttaaggttgtaagagaacactatttaagagatgatatttattgcggagcttcgatttgtaaagtttgcgatactaaagtagctcgattaagctcttcagcatcaactattcttgttctcgacactaatgttgttcttaatcagattgatttgcttgagaatccagcaattgatgatgttgttgtgctttctgttgtattggatgaagtgaagaacaagaatctttctgtttataatagacttagagctctttgtagtaacactctacgcaaatttttcgtcttttcaaatgaacatcacaaggatacatatgtcaaggctatggttggggaaagtcctaatgatagaaatgatagagcaattcgggtggcaactaattggtatcaacgccatcttggtggcggcacgagggtattacttattacaaatgacaaggagaataagagaaaagccactgatgaaggcatttttgcggaaacagttgagacgtacgtcaaatcacttggccagcccaatttgcttgatcttgttgtgcatccaacatctgaagatgtgggcatggaagatgttgaagaccttagaccatccaagaggaaggtcatttatattgagcacaagcccatgtcagagattactgctggtttgcatcgtggaatataccaccaaggaaaacttcgcgtcaatcgttataatcctttcgaggcctatgttggaagtgaaagtattggtgatgaaataataatccagggtcgaggtaacatgaatagggcttttgatggtgatgtggtggcagtggagctcttgcctaaagaacaatggcatgaagggaagtctctgtctatagcagatgatgacttttcatttatagaggatgaggaggaagaagatgttcatttagttcccaacagtgccgatgatgctcctagaaatcgggacaccattcaagattcttccagcactgtgaatcctgtttcatgtcgtccctctggtcgtgttgttggtattattaaacgtaattggcaatcttattgtggttccttagagccaatgcccatgccagcaggtaatggtggcattgctcatgctttatttgtctctaaagatcgcagaattcctaagattcggattcaaactcgacagctggggaatcttttggacaagagaatcattgttactgttgattcttgggactgtttgtctcgatatccttctggtcattatgtaagaactataggagaaattggtgacagagacactgaaactaaggcaatcttaatcgagaatgacataaactctcgacctttttctacacaagttttggcatgcttgccacctttaccgtggtcagtatctactgaagatttgatgaatcccaacagacaggatctgcgacaattgcgtgtttttagcgtggatcctccaggctgcagggatattgatgatgccctccactgcacagctcttccagatggaaattttgaagttggagttcatattgctgacgtgaccaacttcgttcattctggcactccccttgatgatgaagcttcacaaaggggcacttcagtctatcttgttgaacgccgcatcgacatgcttcctaaaccactaacagaagatatctgttctcttcgttctgatgtggagaggttggccttttctgtaatttgggtaatgacccctgaagcagagattatatctacaagatatacgaaaagtgtcatcaagtcttctgctgtaatgtcttatgttgaagctcaagctaggatggatgacagccgtctgatggatccattgactactgacttgcgtaatttgaacacattagcaaagattatgaggcagaggcgtattgacaggggagctttaacacttgcttcagcagaagtcaaatttcagatcgacacggaaactcacgatcctcttgatatcggtatgtatcaaatcagagaggccaatcaaatgattgaggagtttatgttagctgctaatgtttcggttgcagaaaaaatattaaagcatttttcaatgtgttctctattgagacgccatcccagtcctactaaagagatgcttgaacctttactgcggacagctgctgctattggtctggatttggatgtttcatcctcaaaagctctggctgattcacttgatcgtgctgtgggtgatgatccatacttcaataagctgatccgtattttggcgactagatgtatgcctcaggcagtttatttctgtagtggagatctcacccctccagaattccaccattatggtcttgcgtccccactgtatactcacttcacatctcctataaggagatatgcagatgtcatcgttcacagactgcttgctgcagctttaggaatttacaagcttccaacaatatttcaagacagaccccagctgaccagtatagctgacaatttgaattataggcatcgaaatgcccaaatggctagctgggcctcagttgagttgcatacacttattttcttcaggaaacggccaaccgacacagaagcaagaatagtgaagataagagccaatggttttatcgtttttgtgcccaagtatggtattgagggacctgtgtacttgacgcccaaaggagaaaagggaggggattgggtggtggatgaagaacatcaaaaggtcaagaagatggatggaagcatcagttacagtgttctgcagatggtgcaaattcacatggaggttgtggaaccccagccgaaccggccaaagctccagctcacccttatgtagaagatatgtgattcattccctcccttacattttaaggaaacataaaacatatctatggagaatgtcacttggaaaggtgaatttcagcaatacttcctgttatctcgtaagatgggaaggtttctcgtagtcgatcaactagtagccagtaggaataggggtgtgagagatatgcgtagatggtgcccattaggtgttctatggatatgtagcgaggatttcgttattgtcaatttctgtaattttcgtttcaatcaatgaaattttctttcttttgttc

SEQ ID NO: 2279 - DNA, 3323 bp, Citrus clementina
actattcgtttgaagaaagtaaagcagaaggggcaaaacaaaaaaaggcgctgttcctcgcctctcaagcgtcttcacatcagaggctcacagttacagtggcggcagcgacgcattataaataaataaattaattaattaaaaaaataagaaaaggaagaaaggttctgcaaactactgaaggctgaggcacatcaggcatcttaattggattcagaggagaggcaaacatgttaaagagcaaatcatacagtaggaagaccaaaagtaataaaattaaaaaggaagtaagagaagtctatctccgagatgacatttggtgcggtgctgcttcttgctcaacctgcgactcctccgccgctcgcttgtccgcttccacgattcttgtcgtcgacactaacgtcgtccttaatcagattgatttgctggagaatcccgcgattgatgacgtggtggtgctgtctgtggtgttggatgaagttaagaacaagaacttatcggtttacaatagaattagagctctttgcagtaattctttgagaaatttctatgttttctcaaatacatttcacaaggatacacatgtagataagatggataaagaaagtcctaatgatttgaatgatagagcaattcgggtggcaactcagtggtaccagaagcatcttggtgatgcaacaaaggttttacttgtgactaatgatagggaaaatatgaggaaggctactgaacaaggcatattcgctgagacaattgagtcgtatgtgaagtcattgggtcaacccaatttgcttgacctgcttgtccatcctgcatctgaagatgtaaacatggaagatgttgaagatttgagaccctctaagaggaaagttatttatccagagcacaagcccatgtcagagattacttctgggttgcgtcgtggaatataccatcagggaaaattgcgagttaaccgttacaacccatttgaagcatatgttggaagtgaaagtattggtgatgaaataatcatctatggacgtacaaacatgaatagggcttttgattgtgacatagttgctgtggaacttctaccccaagaacagtggcatgaagagaagtctttatttatagcagcagaggaagatgatgaagatgaggatgatgttcatctggctccaagtagtgctgatgatgctcctagaactgcaagtgtcgctgctgctgctgctggtgaaaattctgctccaagtcgtccgtcaggccgtgttgtcggtattataaagcgaaactggcattcttattgtggatcattggagccaatgcccatgcctgccggtagtggtagtgttgcccatgcattatttgtccccaaagaccgaagaattcctaagattcggattcaaactcgacagcttgggaatcttctggacaagagaataattgtggcagttgattcttgggactgccaatcacgttatccttttggccattatgtacaggtcataggagaaataggtgacagagatactgaaagtgagatggtcctcatagataatgatattgacgctagaccattttccactcaagttttggcatgcttgccgccattgccatggtcggtttcttctgaagatttggccaatcctataaggcttgatttacgagatctgcgtgtctttagtgtggatcctcctgggtgcaaggatattgatgatgcattacattgtacagctctttccagtggaaattttgaagttggagttcatattgctgatgtcacaaattttgttcatcctgggactccacttgatgatgaggccgcaaaaaggggcacatctgtctacctcgttgagcgccgaattgacatgcttcctaaacctctaacagaaggcaagtttatatatatgttcactgcgggctgatgtagaaagaatggccttctctgttatttgggaattgacacctgaagctgaaattatttcaacaagatatacaaaaagtgttatcaaatcatgtgcagcattatcttatgttgaagcgcaggctaggatggatgatagtcgattgatggatccgttaactacagatttgagaaatatgaattctttggcaaagaaaatgaggcagagacgcattgaaagaggagctttaactcttgcttctgctgaagtcaaatttcaaattgatacagagactcatgaccctcttgatatcggaatgtaccagattcgagaagcaaaccaaatggttgaggagtttatgcttgcagctaatgtttcagtggcggaacaaatccttagacaattccctctttgttcacttttaaggcgtcatccttctccaacaaaagagatgctcgaacctttgctgcgtactgccgctgctgttggtctcaacttagatgtctcatcatcgaaagcactggctgattcacttgatcgtgctgtgggtgatgatccatattttaataagctgattcggatattggctactagatgcatgacacaggcggtttatttctgtagcggggacctcactcctccagaatttcatcattatgggcttgcagcacctctatatactcatttcacctctcctataagaagatatgcagatgttgttgtacacaggttgctttctgcatctttaggtatttacaatctcccatcagtattccaagatagaccccaacttactagcatagccgataatctgaattatcggcacaggaatgcccagatggcaagtcggggttcagtggagcttcatactctcatctacttcagaaaacggcccacggacacagaggctagaatagtgaagatcagatccaacggttttattgtctttgtgcccaagtttggcatagaaggacctgtgtacttgacaccaagaggtcagaagggaagcggggattggtatgtagacgagcagcagcagaagattgtaaagatggatggaaatctttcttttagtgttttacagactgtgaacattcacatggaggttgtggaacctcaaccaaaccggccgaaactccaactcaccctcatttagaagttttggtgcgccatttcatttttctgtttgtagacaaattagttaattaactaacaaagcaatggttgtgtggttctgttttgctgaactagatctgtgttgttgcatccattatgtttagtgtaccaaattgaggataggatgttgtttgataggcagagatgcaaagaatattgtatcataattttttttttttttgaaaaaaaaaacttaaattggttttgttttgactatttattcttcggtttaagttaaatataattttattagaatattgc

SEQ ID NO: 2280 - DNA, 2997 bp, Cucumis sativus
acatgttgcataacaagtcgtttgttaaaaagacgaagtctgggaaggtgatgaagcaagtgagagaacactatcttcgagatgatatatattgtggggcttcgatttgcaaaaaatgtgattcttcagttgctcgcttgggtgcttctacatcgccaattctagttctcgacaccaatgttgttcttactcagattgatttgcttgagaatcctgctattgatgacgtggttatgctatcagttgtgctggatgaggttaagaacaagaacctatctgtttacaacagagttagagctctctgcagcaatcccctgcggagattctttgttttctctaacgagcaccacaaggatacatatattaaggacatgagtggagaaagtaaaaatgatcgaaatgatagagccattcgagttgctgctcaatggtatcagaatcatcttggtggtgctactcgtgttctactcataaccaatgacagagagaataggagaaaggctattgaagagggaattggtgcagagacaattgaatcttatgttagatcattggggcaaactcatttacttgatctgttagtgcaaagtgcaaatacagatgcaaataaggaggatgttgaagatttgaggccatcgaagagaaaggttctttactccgagcataaacccatgtcagaaattacttctggtttgcatcgtggtatatatcatcaaggaaagctccgtgttaatcgatacaacccatttgaagcatatgttggaagtgagagtattggtgatgaaattattatttatgggcgtaccaacatgaacagggcttttgatggtgatgttgtggcagttgaacttctgtctcgagatcagtggcatgaagagaagtctctgactatagcagacgatgaagatgatgaggaagaagatgttcatcttgttcctggtagtgctgatgatgctccaagagctgcatctgtactacagggctctagtggagattcttcttctagttcaccacgcccagctggacgtgttattggtatcataaagcgtaactggcattcttattgtggttctttggatccaatgcctatgcctgctggaagtggtggcatcgcttatgctctatttgtttccaaagatcgtcggattcctaaaattagaatccagactcgtcagcttgagaatcttttagacaagagaattattgtagcagttgattcttgggaccgtctttctagatatccttcaggacattatgtgcgatctataggagaaataggtgatcgagatacagaaagtgaggtggtcttaattgaaaacgatataaactccaggccattttcttcacaagttatgacatgcttgcctccgttaccatggtcagtgtctcctgttgatattgcaaaccctattcgacaggatttgcggcatttaaatgttttcagtgtggaccctccaggttgcaaagatattgatgatgcacttcactgtactgctctttcaaatggaaattttgaagttggagtccatattgctgatgtaacaaattttgttcatccgggcactgcattggatgacgaggctgcacaaaggggcacatcagtctaccttgttgagcggagaatagatatgcttccgaaaccattaacagaagatatatgttctcttcgagctgatgtggaaagactggcattttcagtaatttgggaaatgacacctgaagccgatattgtttctactagctacaccaaaagcatcattaagtcgagtgctgcattatcttatgttgaagctcaggcaaggatggatgacagtcgattgatggatccaataactagagacttgagaaatatgaatgctttagcaaagaaaatgaggttgagacgaattgagagaggagctttgactcttgcttctgctgaagtcaaatttcaaattgacactgagacgcatgatcctcttgatattggtatgtatcaaattcgagaagctaaccaaatggttgaggagtttatgcttgcagcaaatgtttcggtagcagaaaagattcttaaacatttcccgctgtgttcattattaaggcgccatcctactcctactaaagagatgctcgaacctttgatccgcacagctgtagctgttggtcttgatttggatgtctcatcatccaaagctttggctgattctcttgatcgtgcattgggtgatgatccatacttcaataagctgatcagaatactagctactagatgtatgacacaggcagtttacttctatagtggagacctcagtcctccagaatatcaacattatgggcttgcagctcgtctgtatacccatttcacctctcctattcgacgatacgcagatgtcattgtgcacagattgcttgctgcatctttaggaatattcaaactcccaacattattccttgacagaccgaaactcactacaatcgcagataacttaaattatcgacacagaaatgcccaaatggctggccgggcttcagtggagcttcatactctaatttacttcaaaaaacggcctacggacacggaggccagaatagtgaagataagatcaaatggttttattgtatttgttcctaaatttggtatcgaaggaccggtttacttgacaggtaaaagcgagaagcagagtggagaatggtttgtggatgaacaagaacaaaagatcaagaagttagatggaagcatcacatacaacattctacaagcggtgagaattcacatggaggttgtggagccccaaccaaatagaccaaagctccagcttactcttctttaagcttatttttctatttttttggctttgcctctaggaaacacaaacacttttgtaagagtaaaaggtaggaaaatagaatcctttttagaaagttgggaatagtgtagcaaaatttcactcatgttagaagtttggaacaatgtaaattttcctttatttaaatatttatcacacatttcttcaagtt

SEQ ID NO: 2281 - DNA, 3115 bp, Valeriana officinalis
ccgccattagagcccgagaaagctaaggtcacactgtgtgtgctgctgaatcacaaccgaatatatacaaatcacagaactctcataatttcgaaatcaaaccttcggtgtattattgtgcaaattcatacccccaaaaccagttgccaccagcagagagcttcgtactggaatcgcaaaaatgttacagagcaaatcatttgtccggaaaactaagcaagggaaagtagtcaaggtcgtacgagaacactatcttagagatgatatatactgtggagcttccttttgtaaagtttgtgatacttcaactgcacgtttgagctcttctgcttccacaattctcgttattgacactaatgttgtcctcaatcagattgatttgcttgagaatccagcaattgatgaagttgtggtactatcagttgttttggaagaagttaaacacaagaatgttgctgtgtataatagacttagggctctctgcagtagttcttcgaggaagttcttcgttttttctaatgaataccacaaggatacatatgtgaaagccatggctggcgagactccaaatgaccgaaatgatagagctattcgggtagcagctcaatggtatcaaaatcatcttggcaatgcattccgggtcttactaatcacgaatgaccgggaaaataaaagaaaggcaagcgaagagggtatttctgctgaaacagttgaatcatatgtgagatcgctaggtcaacctgcattgcttgacctacttgttcaacctccctctgaagacactcgaatggaagatgctgacgattcaagaccatcaaagagaaaagttatatataatgagcataagcctatgtcagagatcacttcagggttgcttcgtggaatatttcatcaaggcaaacttcgcgttaaccgttataatccattcgaagcatatgttgggagtgagagcattggcgacgaaattataatctatggccgtggtaacatgaacagagcttttgatggtgatgtcgttgctgtagaactgttacctcaagatcaatggcatgatgaaaaatccttatctatagctgagcaagaggacgaggaggacgacgatgttcatttagctccgagcagtgcagatgatgctccagtgaaaggatctaatggagatatgagtaatgtgcctcctcgtccatctgggcgtattgttgggatcatcaaaaggaactggaaatcgtattgtggatcattggatccaatgccgatgccagctggcaatggtggtgttgctcacgctctatttgtttctaaagaccgaagaatccccaagattcggattcaaactcgacaactggggaatcttctggacaaaagaataatcgtttcagttgattcttgggattgcgcatctcgatatccatccggtcattacgtaaggacaataggagatataggtgacagagataccgaaagtgaggtggtgttgatagagaatgacatagatgcacggccgtttacttctcaagttcttgcttgcttgcctccgttaccttggaatgtttctgcagaagatttggccaatcctattagacaagatttgcgtcatttacgtgtcttcagtgttgacccaccaggatgcaaggacattgatgatgcattgcactgtacactctctccgaatgggaactttgaagttggagtccatatcgctgatgttacgaactttgttcaccctggaaccccactggatgacgaggcaacacagaggggtacttctgtatatcttgttgaacgccgtattgacatgctcccaaaacctctaacagaagatatatgttcacttcgggctgatgttgagaggctggctttctcagttatttgggaaatgacacccgaagctgagattatttctacacgatacacaaaaagtgtgattaaatcatgtgcagcactttcttatgttgaagctcaagcgaggatggatgacagccgcctaatggatccagtaactaccgatttgcgtaacatgaacgcattagcaaagaaaatgaggcaaagacgtattgacagaggtgcattaactcttgcctctgcagaagtcaaatttcaaatcgataccgaaactcacgacccactcgatattgggatgtaccaaattagagaagcaaaccaaatggtcgaggagtttatgcttgctgctaatatatcagttgctgaaaaaatcctacaaacattttccactatgctctttgttaaggcggcatccaagtccaacaagaaatgcttgacctttacttcgtacagcagtcgctgttggcgtcagtcttgatttgtcatcatccaaggcactggctgattctcttgatcgtgctgtgggggaggatccatacttcaataagttgataagaatattggctaccagatgcatgtcacaggcagtttacttttgtagtggggatctaagtcccccggagtactatcattacgggcttgcagctcttctttacacgcatttcacgtctcctattaggagatacgcagatgtttttgtacacagattgctcgctgcatctctagggatatacaagcttccactcatattccaagacagaccccaacttactagcgtcgccgataatttgaattatcggcatagaaatgctcagatggcaagcagggcttcggttgaacttcatacagttatttatttcaggaataggcccacagataccgaggcaagaatagtgaaactaagatccaatggatttatcgtctttgttcccaagtatggtattgaaggaccggtatatctaacagcaagaggagaaaaaggaggagattgggtagtagacgagcaacaacaaaaggttaaaaaaatcgacggtacaatttcttacggcgttcttcagtcagtaaaaatccacatggaagttaccgaaccgcaacccaaccgccctaaacttcaacttactctcatctaatcactgtaagtcaattttttgctagatttatttcatgtgcaagacagcaaaactgattttgtttttgaaatagtcaaagaaaacagcattaaataccatacccagatagattttggctggctaaaatatatcctagtcagaatttg

SEQ ID NO: 2282 - DNA, 3028 bp, Helianthus annuus
ggggaacaaaacaattaaaagaagccagaggatttgaacagcttcaacaaggtgaatatcataaaccccataaaccgccgccattggagctcaaacccaccatccttcttcgtttctcatacccctaaatcactaaattagccccaaaatcatgttacaaagcaaatcattcgttcgaaaaacgaaacagggcaaagttgttaaagtggtcagagaacattatcttagagatgatatatactgtggagcttcgttttgcaaagtttgtgatacgaaaggcgctcgctttacctcccctgaatgtacaatccttgttcttgatactaatgttgttctgaatcagatcgatttactcgagaattcagcaattgatgatgtggtggtgctttctgtggtgttggatgaggtcaagaacaagaatcttgcagtttacaaccgactcagggccttatgtagcaatactttaagaagattctttgttttttccaacgaacaccacaaggacacatatgtgaaggctatggcaggcgagagtccaaacgatcgcaatgacagagctattagagttgcagcccagtggtaccagaaccatcttggtggtcccacaagaatcttgatggtcacaaatgatagggaaaataaaagaaaggccactgaagagggaatatctgcagatacagtggagtcatacgtgaaatcacttggtcaaccagcccttcttgatctgcttgttcaacctaactcatccgaggatatggaaatcgaagatttgaggccttcaaagaagaaagctatatatactgagcataagcccatgtcagagatcacatctggaatacgatgtggaatataccatcagggcaaacttcgtgttaaccgttataatcctttcgaagcatatgttggaagcgagagtatcggtgatgaaataataatatccgggcgtggaaatatgaatagagcttttgatggcgacgtagttgcggttgaacttttgcctcaagatcaatggcaaaatgaagcgtctcttcacatagctgaagaagatgatgaagatgacggtgtccacctggcaccgagcagcgctgatgtggctccaagaatcaccaatcccgcacaaggatcttctgagaatgcgaataatcctccttctcgtccttctgggcgcgttgttggcattataaagaggaactggcatgcttattgtggatctttggagccaatgcctatgccagctggaaacgctggtatagctcatgctttatttgtctctaaggatcgaagatttcccaagatacgaatccaaactcgccagctcgggaatcttctcgataaaagaattatcgttgctgttgacacttgggattgccaatctagatacccttccggtcattatgttcgcacaataggagatatcggagaccgtgaaactgaaacagaggttgtgctaatagaaaatgatattgatgcaagaccattttcttcacaagtcttggcatgcctgccccccttaccttggtcggtttcgtcagaagatttgtcaaatcctataagacaggacttgcgtcatttacgcatatttagtgtggacccgccagggtgcaaggatattgatgatgcattgcactgtaccccacttcctaacgggaactttgaagttggagttcatattgctgatgtcacaaattttgttcaccctgggacaccccttgatagtgaagctacacaaagaggaacttctacctaccttgttgaacgtcgtattgacatgcttcctaaacctcttacggaagatatatgttctcttcgggctgatgtggagagacttgccttttctgttatttgggaaatgactcctgaagcacatgttatatctaccagatatacgaagagtgtgatcaagtcatgtgccgctttgtcttatgttgaagctcaagcaaggatggatgatagccgcctgatggatccagtaactgcggatttacgaaatatgaatgctttagcaaagataatgaggcaaaggcgtatagaaagaggggccataactcttgcttcggcagaagtcaaattccaagttgacactgagactcatgatcctcttgatattggcatgtatcaaatccgagaagcaaaccaaatggttgaagagtttatgcttgctgctaatgtttcagttgctgaacaaattcttaagaagttccctcagtgttcattattaaggcggcatcctagtccaaccaaagaaatgcttgaacctttgttacgcactgctgctgctgttggtcttgatttagatgtgtcatcatcgaaagcacttgctgactcgcttgaccgtgctgtgggtgatgatccatactttaacaagttgatccgtattctagcaacaagatgcatgacacaggctgtttacttctgtagtggcgatcttagccctccagagtttcaccattatgggcttgctgcacctctgtatacacattttacctcaccaattagaagatacgcagatgtgatagtgcacaggttgcttgctgcatctttagatatatacaagcttccgccaatattccaggaccgaccacaacttactagcattgctgacaatctaaattatcggcataggaatgctcagatggcaagtcgctcctccatagaactccatactattatatttttcagaaaaaggcctactgacactgaagccagaattgtgaaaataagagcgaatgggttcattgttttcgtgccaaagtatggtattgaaggtccagtgcacctgacaatgagaggtgcaaaaggagggggagaatgggtggtggatgagcagcaacagatgattaagaaggtcgacgggtcgatttcttacggtgttcttcagcctgtaaagattcatatggaggtcgttgaaccccaacccaaccgacctaaacttcagctcactctcatttaaaatgtaagattttctactgatgtcattttagatatatttaaaagaccatggtttattctttttatatacaaccttttt

SEQ ID NO: 2283 - DNA, 2986 bp, Helianthus annuus
aacaaggtgaatatcataaaccccataaaccgccgccattggagctcaaacccaccatccttcttcgtttctcatacccctaaatcactaaattagccccaaaatcatgttacaaagcaaatcattcgttcgaaaaacgaaacagggcaaagttgttaaagtggtcagagaacattatcttagagatgatatatactgtggagcttcgttttgcaaagtttgtgatacgaaaggcgctcgctttacctcccctgaatgtacaatccttgttcttgatactaatgttgttctgaatcagatcgatttactcgagaattcagcaattgatgatgtggtggtgctttctgtggtgttggatgaggtcaagaacaagaatcttgcagtttacaaccgactcagggccttatgtagtaatactttaagaagattctttgttttttccaacgaacaccacaaggacacatatgtgaaggctatggcaggcgagagtccaaacgatcgcaatgacagagctattagagttgcagcccagtggtaccagaaccatcttggtggtcccacaagaatcttgatggtcacaaatgatagggaaaataaaagaaaggccactgaagagggaatatctgcagatacagtggagtcatacgtgaaatcacttggtcaaccagcccttcttgatctgcttgttcaacctaactcatccgaggatatggaaatcgaagatttgaggccttcaaagaagaaagctatatatactgagcataagcccatgtcagagatcacatctggaatacgatgtggaatataccatcagggcaaacttcgtgttaaccgttataatcctttcgaagcatatgttggaagcgagagtatcggtgatgaaataataatatccgggcgtggaaatatgaatagagcttttgatggcgacgtagttgcggttgaacttttgcctcaagatcaatggcaaaatgaagcgtctcttcacatagctgaagaagatgatgaagaagatgatggtgtccacctggcaccgagcagcgctgatgtggctcccagaatcgccaatcccgcacaaggatcttctgagaatgcgaataatcctccttctcgtccttctgggcgcgttgttggcattataaagaggaactggcatgcttattgtggatctttggagccaatgcctatgccagctggaaacgctggtatagctcatgctttatttgtctctaaggatcgaagatttcccaagatacgaatccaaactcgccagctcgggaatcttctcgataaaagaattatcgttgctgttgacacttgggattgccaatctagatacccttccggtcattatgttcgcacaataggagatatcggagaccgtgaaactgaaacagaggttgtgcttatagaaaatgatattgatgcaagaccattttcttcacaagtcttggcatgcctgccccccttaccttggtcggtttcgtcagaagatttgtcaaatcctataagacaggacttgcgtcatttacgcatatttagtgtggacccgccagggtgcaaggatattgatgatgcattgcactgtaccccacttcctaacgggaactttgaagttggagttcatattgctgatgtcacaaattttgttcaccctgggacaccccttgatagtgaagctacacaaagaggaacttctacctaccttgttgaacgtcgtattgacatgcttcctaaacctcttacggaagatatatgttctcttcgggctgatgtggagagacttgccttttctggtatttgggaaatgactcctgaagcacatgttatatctaccagatatacgaagagtgtgatcaagtcatgtgccgctttgtcttatgttgaagctcaagcaaggatggatgatagccgcctgatggatccagtaactgcggatttacgaaatatgaatgctttagcaaagataatgaggcaaaggcgtatagaaagaggggccatcactcttgcttcggcagaagtcaaattccaagttgacactgagactcatgatcctcttgatattggcatgtatcaaatccgagaagcaaaccaaatggttgaagagtttatgcttgcagctaatgtttcagttgctgaacaaattcttaagaagttccctcagtgttcattattaaggcggcatcctagtccaaccaaagaaatgcttgaacctttgttacgctctgctgctgctgttggtcttgatttagatgtgtcatcatcgaaagcacttgctgactcgcttgaccgtgctgtgggtgatgatccatactttaacaagttgatccgtattctagcaacaagatgcatgacacaggctgtttacttctgtagtggcgatcttagccctccagagtttcaccattacgggcttgctgcacctctgtatacacattttacctcaccaattagaagatacgcagatgtcatagtgcacaggttgcttgctgcatctttagatatatacaagcttccgccaatattccaggaccgaccacaacttactagcattgctgacaatctaaattatcggcataggaatgctcagatggcaagtcgctcctccatagaactccatactattatatttttcagaaaaaggcctactgacactgaagccagaattgtgaaaataagagcgaatgggttcattgttttcgtgccaaagtatggtattgaaggtccagtgcacctgacaatgagaggtgcaaaaggagggggagaatgggtggtggatgagcagcaacagatgattaagaaggtcgacgggtcgatttcttacggtgttcttcagcctgtaaagattcatatggaggtcgttgaaccccaacccaaccgacctaaacttcagctcactctcatttaaaatgtaagattttctactgatgtcattttagatatatttaaaagaccatggtttattctttttatatacaaccttttt

SEQ ID NO: 2284 - DNA, 3090 bp, Eutrema halophilum
aggtttaagggatttaaaaaaaaaagcttccgacgactgagttctttcaccggcgaaattttctcagcgagagagaggttaaagaagatgttgcagagcaaagttttcaataagaaaacaagaggagggcgaattcaaaagcaagtgagagaggtttatctacgagatgacatatactgtggagctttttcttgcaagtcttgcgatacttcagctgctcgcttgtcttctcctaagattattgttgtggacaccaacgtcgttcttcaccaaattgatctgttggagaatcaggccatagacagtgttgttgttctgtctgttgtcctggacgaggttaagaacaggaatagatctgtttacaataggatcagagctctatgcagcaatccagcgagacaattctatgttttctctaatcatgtccacaaggacacttatgtgcaggccatggagagagagactgccaatgaccacaacgatagagctattcgggtcgctacgctatggtaccagaagcatctaggggattcatctcaggtgttgcttgtaactaatgacagggaaaataaacggaaggccactgaggagggaatatctgcagagacaattgaggcttatgtaaaatcaattggacaacctgaattgctggatctgcttgcgcaaccaaccactgaagacgtaaccatggaagatgcagatgattccagaccttcaaagaggaagcttgtatacctagagcataagcccatgtctgagattactgctggcctacaccgtggaatatatcatcaaggaaaactccgtgtcaatcgtttcaatccttttgaagcttatgttggaagcgagagcattggcgaggagataattatctatgggcgcagtaacatgaacagggctttcgatggtgatattgttgctgtagaactcttgcctcgcgatcaatggcaagaggagaaggcattatctatagctgaagaagatgaggaagaggacgatactgttcatttggctcccaacactgctgacgatgctcctagaacctcaaatttgccccaagaaacttctggggataaaaatgctatccctgctcgtccttcaggccgtgtagtcggtattatccgtagaaattggcattcgtattgtggatctcttgaaccaatgtcactacctgctggtagtggtggaacggcgcatgctttatttgtttctaaagatcgcagaattcccaagattcgcattaatactcgacagcttcagaaccttttggatatgaggatagtagtggcagttgattcttgggaccgtcaatctcgatatccttctggccattatgtccgaccaatcgggaaaataggtgacagggaaactgaaacagaggttgtcttgatagagaacgatgttgactactcgccattcacttctcaagttctggcatgcttgccacccttaccctggtctgtatctcctgaagatgtatccaatcctgttaggcaagatttacgacatttgcttgtctttagtgtggatcctcctggttgcaaggatattgatgatgcattgcattgtacatcacttccaaacgggaactttgagcttggagtccacattgcggatgtaacaaattttgttcaccctggtactcctttggatgatgaggcatcaaaaagaggcacatctgtctaccttgttgagcgccgtattgacatgcttcccaagcctctaacagaagatatttgctcgcttagagctgatgtggaaaggcttgcattctcggttatttgggaaatgaaccctgaagctgagattatttcaacgagatttacaaagagcataatcaagtcttctgcagcattgtcctatgttgaagctcaggctcggatggatgacagccgattgacggactcggtgactacagatcttaggaacatgaatactttggcaaagataatgaggcaaaggcgtattgataggggagccttaactcttgcttctgccgaagttaaatttcagattgataccgagactcatgatcctcttgacattggcatgtatcagattcgagaagcaaaccaaatggttgaagaattcatgcttgctgcaaatgtttcagtcgctgaacaaatacttaaacatttcccttcttgctcactattaaggcgtcatcccactccaacaagagaaatgcttgaaccgctgttgcgtactgctgcagctattgggcttaacttggatgtttcttcatctaaagctctggctgattcactggaccgagctgtgggtgaggatccatatttcaataagcttatcaggatattggcaactaggtgcatgacacaggccgtgtacttttgtagtggggatctcactcctccagaataccttcattatgggcttgcagcacctttatatactcattttacgtcccctatccggagatatgctgatgtctttgtgcacagattacttgccgcgtcattaggaatatacaagcttccaacggtgtttcaagacagacctcaacttactagtgttgctgataatttgaactatcggcataggaatgcccagatggcaagtcgagcttcagtagagctgcacacactcatctacttcagaaaccgacccacggatgcagaggcgagagttgtgaagataagatcaaacggttttatagtattcgtcccaaagtatggaatcgaaggccctgtttatttaacagcaaaaggtgagaaaggagccggtgactggtacgtagacgaggagaagcagaagattgttaagatggatggaagtttatcttatagtgtcttgcaaacagtgaagattcacatggaggtagttgagcctcagcctaatcgaccgaaactccaactcactcttttataaaactctttaaagtctctcacttttcacagtttcacttatatgtcaaagagttcgtgtgctattctacatttgttttgtttactttacgcatgtttactagttggtgatctgcgtttcgagctgaattttgtattattatttactaatatggttaatcactgttaagtcacattcatatataaagcataatagacttaatca

SEQ ID NO: 2285 - DNA, 3065 bp, Elaeis guineensis
gccgataccacgagagaggggaaaagaaaccacttcgtcgagatgttgcaaagcaaatccttcgtcaagaagaccaagcaagggcgagtggtcaaggtcgtgagggagcattacctgagggacgatatctactgcggcgcgctgtcgtgcaaggtctgcaacacgtccgctgcgcgcctgagctcgtccgcttgcactattcttattgtcgacaccaatgttgtactgaatcagatcgatttgctcgagaatccggcaatagaagatgtggtggtgctgtcggtggtgttggaagaggtcaggaacaagaaccttgctgtctacaatagggttaaagcgctctgcaccaattccctgaggaaattttttgtattctccaatgagcaccacagagatacatatgttaaagagatggttggagaaagcccaaatgaccgaaatgacagagcaattcgagtggctgcacgttggtatcaaagtcatttgggtggaagcatacaggttttacttattaccaatgacaaagagaataagagaaaagccattgaggagggtctttctgcagagacagttgaatcatatgtaaaatcactcggacaaccaaatttgcttgacttggttgctcttccaacctctgaagatgttggtatggcagaggttgaggatctgagaccatctaagagaaaagttatctacagtgagcacaaacctatgtcagaaattacttctggtctgcatcgtgggatataccatcaaggaaaacttcgggttaatagatacaatccttttgaggcttatgtggggagcgagagcattggtgatgaaatggttgtacatggccgggcaaacatgaatagggcttttgatggagacatagttgctgtggaggtcttgcctcaagaccagtggcatgaagagaagtcctcgatcattgctgatgatgaagatgatgaggaagaagatgtccacttggttccaagtagtgctgacgatgctccacggaatacaaatctagtacagcctgctgctgcatctgcagcttctacttctagtcgtccagctgggcgtgttgttggcattataaagcgcaattggcactcttattgtggatctttggagccaatgccaatgcctgcgggtaatggtggtatagcccatgctttatttgtttccaaagatcgcagaattccgaagattcggattcagactagacagcttgggaatcttctggataaaaggattgttgttgctgttgattcttgggattgtttgtctcgatatccatcaggacactatgtgcggaccataggagagattggtgatcgggatactgaaagtgaggtgttgttgattgagaatgacataaattcaagacctttttctgcacaagttcttgcttgcttaccgccattaccatggacattatcttctgaagatttggctaatcctaagagacaggatttgcggcatgtaagggtctttagcgtggaccctcctggatgcaaggatattgatgatgcattacattgcacatctcttccaaatggaaattttgaagtgggagttcatattgctgatgttacaaattttgttcttcctggtactcctcttgatgatgaggctgcacagaggggtacatccgtttatcttgttgagcggcggattgacatgcttcccaagcctcttactgaagacatatgttctcttcgttctgatgtggaaaggctggcattttctgtcatctgggaaatgacacctgaagcagaaattatatctacaagatacaccaagagtgtaataaaatcctgtgctgcattatcttatgtagaagctcaagccaggatggatgatagccgtttgatggatccattaaccactgatctgagaaatttgaactcattagcaaaggttatgagacaccaacgtattgaaagaggagctcttactcttgcttccgcagaagtcaaattccaaattgatactgaaactcatgatcctctagatattggcatgtatcaaattcgagaggcaaatcaaatgattgaggagtttatgctcgctgccaatgtttcagttgcagaaaagattttgaaacattttcctttgtgctccttgttaaggcgccatcctatcccaaccaaagagatgcttgaaccattattgcgcacagctgctgctgttggcctggatttggatgtttcatcttcaaaagcacttgctgattcacttgatcatgcggtgggtgatgatccatacttcaataagctgatcaggattctagctactagatgcatgactcaggcagtctacttctgtagtggagatttaagcccctctgaatatcaccattatggacttgcagcagctctttatactcatttcacctctcctatacgcagatatgcagatgtcattgttcacagattgttagctgcagctctaggaattgccaagcttccaccaatttttatggatggtccgcaacttacaagcatcgctgacaatttgaattaccgtcaccgaaatgcccagatggcaagccgagcctcagttgagctccacacactaatatatttcagaaaacggccaaccgacacagaagccaggatagtgaagataaagtccaatggttttatagttttcattcccaagtttggtatagaggggccggtatacttgatgccaaggggagagaaaggaggtgattgggtggtagatgaggtgcatcaaagagtgacgaggacagggacgaacatcagttatggtatcttgaacaccgtcaggattcacatggaagtggtggaacctcagccgagcagacccaagcttgaactcacacttatatagggatacatgtaacgttactcctctcgcttgtgttctagcatttattttttatttttaagtttataggcaacgctatttgttttcctttatttattttatcaggttattgtaagattttgattttataagaaaggatatgtaccataatattagcgaaatatagtctagttgctgtcaatgttcagatttatgctcattgaatcatgctgcactttact

SEQ ID NO: 2286 - DNA, 3065 bp, Arabidopsis lyrata
ttttaagactttaaaaaagcttcccgtctccgttctgacgactgaaaacttcttcaccggcgaactcgaaatttttccagcaagaaattgaagatgttgcagagcaaagttttcaataagaaaaccagaggaggaagaatccaaaagcaagtaagagaggtttatctaagagatgacatatactgtggagctttttcttgcaagtcttgtgattcttcagctgctcgtttgtcttcccctaagattcttgttgttgataccaacgtcgttcttcaccaaattgatttgttggaaaatcaagctatagacagtgttgttgttctgtctgtggtgctggatgaggttaagaacaggaatagatctgtttacaacagaattagagctctctgcagcaatccaaccagacagttctatgttttttccaatcatgtccacaaggatacttatgtgcaggccatggagaaagagagtgccaatgaccacaacgatagagctattcgcgtcgctacgctatggtaccagaagcatctaggggatacatctcaggtgttacttgtaactaatgacagggaaaataaaaggaaggccactgaagagggaatatctgcagagacaattgaggcttatgttaaatcaattggacaacctgaattgctggatctgcttgcccaaccaaccaatgaagacgtaactatggaagatgcagatgattctagaccttcgaagaggaaacttatataccaagagcataagcccatgtctgagattactgctggcttacaccgtggaatatatcatcaaggaaaactccgtgtcaatcgtttcaatcctttcgaagcgtatgttggaagtgagagcattggcgaagaaataattatctatgggcgcagcaacatgaacagggctttcgatggtgatattgttgcggtcgaactcttgcctcgcgatcaatggcaagaggaaaaggcattatctatagctgaagaagatgatgaagaggacgatactgttcatttggctcccaacagtgctgatgatgctcctagaacctcaaatttatcccaggaaacttctggggataaaaatgctacccctgctcgtccatcgggtcgtgtagtcggtgttatccgtagaaattggcactcctattgtggatctcttgaaccaatgtcactaccggctggtagtggtggaacggcgcatgctttatttgtctctaaagatcgcagaattcccaagattcgcattaatactcgacagctgcagaaccttttggatatgaggatagtagtggcagttgattcttgggaccgtcaatctcgatatccttctggtcattatgtacgaccaatcggcaaaataggtgacagggaaactgaaacagaggttgtattgatagagaatgatgttgactactcgccattctcttctcaagttctggcatgcttgccacccttaccctggtctgtatctcctgaagacgtatccaatcctattaggcaagacttacgacatttgcttgtctttagtgtggaccctccgggttgcaaggatattgatgatgcactacactgtacatcgcttccaaacgggaactttgaacttggagtccacattgctgatgtaacaaattttgttcaccctggtactcctttggatgatgaggcatcaaaaagaggcacatctgtctaccttgttgagcgtcgtattgacatgcttcccaagcctttaactgaagatatttgctcgcttagagctgatgtggaaaggcttgcattctcggttatttgggaaatgagccctgacgctgagattatctcaacgagattcacaaagagtataatcaagtcttctgcagcattgtcttatgttgaagctcaggctcggatggatgacagccgattgacagactccctgactacagatctgaggaacatgaatactttggcaaagataatgaggcaaaggcgtatcgataggggagccttaactcttgcttctgctgaagtcaaatttcagattgacaccgagacgcatgatcctctcgacattggcatgtatcagattcgtgaagcaaatcaaatggttgaggaattcatgcttgctgcaaatgtttcagtggctggacaaatccttaaactattcccttcttgttcactattaaggcgtcatcctactccaacaagagaaatgcttgaaccactgctgcgtactgctgctgctattggattgaccttagatgtctcttcatctaaagctttggctgattcactggaccgagctgtgggtgaggatccatatttcaacaagctgatcaggatattggcaactaggtgcatgacacaggctgtgtacttctgtagtggggatctcactcctccagaatatcatcattatgggcttgctgcacccctgtatactcattttacatcccctatccggagatatgccgatgtctttgtgcacaggttacttgccgcttcacttggaatatacaagcttccaacagtgttccaagatagacctcaacttactagtgttgctgataatttgaactatcggcataggaatgcccagatggcaagtcgagcttcagtagagcttcacactctcatctacttcagaaaccgacccacagatgcagaggcgagagttgtgaagataagatccaatggttttatagtatttgtcccgaagtatggaatcgaaggccctgtttacttaactggaaagggagagaaaggagctggtgattggtatgtagatgaggagaagcagaagattgttaagatggatggaagtttatcttacagcgtcttgcaaacagtgaagattcacatggaggtagtagagcctcagcctaatcgaccgaaactccaactctctctcttgtaaaactcttcaaccttgtagtttcactttcacttgtgcaccgatgtcaagagttcaggtggttttatgtttgttttcctctttgcgttcattgtcgaagtcaaagacattgtatcatcatttcattatctatagatggatgcgagttttgggaggtgcatcacttttgatcc

SEQ ID NO: 2287 - DNA, 3096 bp, Brassica rapa
ttaaaagcttcggtctccgttccaacgactgaaatctctcaccggcgaaacaattactcgagcaagaggttgaagaagaagatgttgcagagcaaggttttcaataagaagaccagaggaggtcgtattcaaaagcaagtgagagaggtttatctacgagatgacatatactgtggagccttttcctgcaagtcttgcgatacttcagctgctcgtctgtcctcccctaagattattgttgtcgataccaacgtcgttcttcaccaaattgatttgttggagaatcaggcaatagacaatgttgttgttctctctgtggtgctggacgaggttaagaacaggaacaaatctgtttacaacagaatcagaactctctgcagcaatcctgtcaagcaattctatgttttctccaatcatgtccacaaggatacttatgtgcaggccatggagagagagactgccaatgaccacaatgatagagctattcgtgtcgctacgctatggtaccagaagcatctaggggatacatctcaggtgttacttgtcactaatgacagagagaataaacggaaagccattgaagagggaatatctgcagagacaattgaggcttatgtaaaatcaattgggcaacctgaattgctggacctgcttgctcaaccaaccggtgaagacgtcactatggaagacgcggatgattccagaccttccaagaggaaacttgtatacctagagcataaacccatgtctgaaattactgctggcttgcaccgtggaatatatcatcaagggaaactgcgtgtcaaccgtttcaatccctttgaagcttatgttggaagcgagagcattggggaagagattattatctatgggcgcagcaacatgaacagggctttcgatggtgatattgttgctgtagagctcttgcctcgtgatcaatggcaaggggagaaggcgttgtctatagctgaagaagatgaggaggaagaggatgatactgttcatttggctcccaacagtgctgatgatgctcctagaacctcaaatttagcccaagtaacttctggtgataaaaatgctaaccctgctcgtccttcaggtcgtgtagttggtgttatccgtagaaattggcactcctattgtggatctcttgaaccaatgtccctacctgctggaagtggtggaacggcgcatgctttattcgtctctaaagatcgaagaattcccaagattcgcattaacactcgtcagcttgagaaccttttggatatgaggatagtagtggcagttgattcatgggaccgccaatctcggtatccttctggccattatgtacgaccaatcggcaaaataggtgacagggagactgagacagaggttgtcttgatagagaacgatgttgactactcgccattctcttctcaagttctggcatgcttgccacccttaccttggtctgtatctgctgaagacgtctccagtcctgttaggcaagacttacgacatttgcttgtatttagtgtggaccctccgggctgcaaggatattgatgatgcattgcactgtacatcgcttccaaacgggaactttgaacttggagtccacattgcggatgtaacaaactttgtacaccctggtactcctttggatgatgaggcatcaaaaagaggcacatctgtctaccttgtcgaccgccgcattgacatgcttcccaagcctttaactgaagatatttgctcgcttagagctgatgtggaaagacttgcattctcggttatttgggaaatgagccctggagctgaaattatctcaacgagatttacaaagagcataatcaagtcttctgcagcattgtcctatgttgaagctcaggctcggatggatgacagccgattgacagaccccgtgactactgatctgaggaacatgaatgctttggcaaagataatgaggcaaaggcgtatcgataggggagccttaactcttgcgtctgcagaagttaaatttcagattgatactgagactcatgatcctcttgacattggcatgtatcagatccgggaagcaaaccaaatggttgaggaattcatgcttgctgcaaatgtttcagtcgctgaacaaattcttaaactattcccttcttgttcactattgaggcgtcatcctaccccaacaagagaaatgcttgaaccgctgttgcgtactgctgcagctattggacttagcttagatgtctcttcatctaaagctttggctgattcactggaccgagctgtgggtgaggatccatatttcaataagctgatcaggatattggcaactaggtgcatgacacaggctgtgtacttctgcagtggggatctcagtcctccagagtatctccattatggacttgcagcacccttatatactcattttacatctcctatccgaagatatgctgatgtctttgtgcacagattacttgccgcgtcattaggaatatacaagcttccaacggtgttccaagatagacctcaacttactagcgttgctgataatttgaactatcggcataggaatgcccagatggcaagtcgagcttcagtagagctgcacaccctcatatacttcaaaaaccgacccacagatgcagaggcaagagttgtgaagataagatccaatggttttatagtattcgtcccaaagtatggaatcgaaggccctgtttacttaacagccaaaggtgagaaaggagttggtgactggtacgtagatgaggagaagcagaagattgttaagatggatggaagtttatcttacagtgtcttgcaaactgtgaggattcacatggaggtagtggagcctcagcctaaccgacccaaactcgaactcacccttttgtaaaactcttcaaccatttaagtctcactttcactacttttatataagtctggaccaattgtcaagagttcgtgtgacatttacatttgtattgtttactttatgcctattttattttgctctctgtgtttcattgtcaaagtcaaagacattgtatcattatcatcatatcattatctattaatggatgccagttttgttgagatacacttc

SEQ ID NO: 2288 - DNA, 3242 bp, Populus trichocarpa
aaaaagttggtcctagtaccctgaacttgctccgaaccaaaactcttgctcgtccgccataagccagaaccctgctaatacccagaaaccagcaaaacacgcccacacagaagccctaaacctcactccataaaaccaactaatagagaaaaacggacacttagtttgtctatttgaaccatgttacacagtaaaacttttaacaagaaaaccagaggtggaagaattcaaaagcttgtaagagaagtgtatttgagagatgatatttactgtggagctttgttttgcaaatcttgtgaagataaatcgaaagctcggctgaccgctactgcgtctactattctcattcttgacactaatgttgttcttaatcagattgatttgcttgagaatccggctgtagaagatgtggttttgctatctgtggttttacaagaggtgaagaataaaaattcggctgtttatggaagaattaggaatcttattgatagtcctgctaggagattcgttgttttctctaatgaattccacagggatacttatgtgcagatcatggcaggagaaagtccgaatgatagaaacgacagagccattagggttgctgcaaggtggtatcagagtcatcttggtgaagcggtgaaggttctacttattactaatgatagagaaaataagaggaaggctactgaagagggtgtttctgctgagacaattgaatcatatgtgaaatcattgggtcaaccagctttacttgacttgcttgttcagccagcttctgaagatgtaatcatggaagaagtcgaagatatgagaccttcaaagaggaaagttgtttatcctgagcataagcccatgtcagagattacttctggtttgaccaaaggaatataccatcaaggaaaacttcgtgtgaaccgttacaatccatttgaagcatatgttggaagtgagagcattggtgatgaaatagtcatttatgggcgtggaaatatgaatagggcttttgatggtgatgttgtggcagtggaacttcttccacaagaccaatggcacgaggagaaatcgttatctatagtagatgaagaggatgaagaagaagatgttcatctagtcccaggtagttcagatgatgctcccaggacttcaattccagtatcaagttcaacttttgacacaaatcctgtctcatctcgcccatctggtcttgttgttggtattataaagcggaattggcattcttactgtggatctttagagcccatgccaatgcctgcaggaagtggtggtcttgtatatgctttatttgtctccaaagaccgtagaattcctaagattcggattcaaactcggcagcttgacaatcttttggacaaaagaattattgtagcagttgattcctgggaccgtcaatcacgacatccttctggccattatatacgcagtataggacagataggcgatagagataccgaaactgagttggtcttgatagagaatgatattgatgcaagaccgttttctgcccaagttttggcatgcttgccaccactaccatggtcggtttcctctaaagatttgaacgaatcaaatagagttgacttacgacatttgtgtgtctttagtgttgatcctccaggatgcaaggatattgatgatgcactacactgtactatgcttccaactggaaattttgaagttggagtccacattgctgatgtaacgaattttgttcaccctggcaccccacttgatgatgaggctacacaaaggggtacatctgtctaccttgttgagcgtcgtatagacatgcttccaaaacctttaacagaagatatatgttctcttcgagctgatgtggaaaggctagccttttctgttatttgggaaatgacccctgaagcagagattatttctacaaaatacacaaaaagtgtcatcaaatcacgtgcagcattatcttatgttgaagctcaggctaggatggatgatagtcgattagttgatccagtaactaaagatttgagaaatatgaatgctctggcaaagataatgaggcagaggcgaattcatagaggagcactaacacttgcttctgctgaagtcaaatttcagattgataccgagacgcatgatcctcttgatattggtatgtatcagattcgagaagcaaaccaaatggttgaggagtttatgcttgctgcaaatgtttctgtagctgaaaaaattcttaaagaatttccggagtgttcactattgaggcgtcatcctactccgacaaaagagatgcttggacctttgcttcgtacagctgctgctgttggtttgaacttggatgtcacatcttcaaaagcactagccgattcacttgaccgtgctgtgggtgacgatccatactttaacaagctgatccgtataatggcaactagatgtatgacacaggcagtatatttctgtagtggagaactcagccctccagaatttcttcattatgggcttgcagcacctctttatactcatttcacatcacctatcaggagatattctgacgtgattgtacataggttgcttgctgcatccataggaatatacaaacttccaactatattccgagacaggccccagctcactagtattgctgataatttgaattatcggcataggaatgctcagatggcaagccgaggctcagtagagctccatactctcatatacttcagaaaccggccgacagacacagaggccagaatagtaaagatgagatcaaatggttttattgtatttgttcccaagtttggtatagaagggccagtatacctgacaatgagaggtgataaagggggtggggaatggtttgtagatgagcagcagcagaagattaggaagatggatggtagtgtttcatacagtatcctgcaggcggtgaaaattcacttggaggttttagaaccgaaaccaaatcggccaaaactccaactaaccctcctctaaattttataagacataattatgggagccattccaatgctgaatgtttagcttgtttatgccaggatagggtgtcttggtgcccagagggagtgcatgattttgtaatgtcagaaaatcgttttgttttatgcttgtattcttttgaaatatttaactcaggatttgctcttgggacctttctttaagagggcatttagcttagcagatgacttgagagactaaaaatgattaaatcgaaattgtcaattcttttc

SEQ ID NO: 2289 - DNA, 3021 bp, Mimulus guttatus
catgctgcaaagcaagtcattcgtcaagaaaacgaagcaagggagagttgtcaaggttgtgagagaacactatttgagagatgatatttactgcggtgcccctttatgcaaggtctgcgatgttgccgcatcgcgtctcagctcaactgcctctactattctcgtagtcgataccaatgttgttcttcatcagattgatttgctggaaaatccagccatagatgatgttgtggtgctatcagtggtactggaagaggtaaagaacaaaaatctcggtgtatataatagacttagggcgctttgcagcaactcccagaggaggttctttgtcttttctaatgaataccacaaggatacatatgtgaagattgagactggtgaaagtcccaatgataggaatgacagagcaattcgggtggcggcacaatggtatcagaatcaccttggtagtgcagtccgcgttttacttattacaaatgaccgagacaacaaaaagaaggccgttacagatgggattcttgcagagacagtcgagtcgtatgtgaaatcgcttggacaaccagcattgcttgacctgattgttcagcctccatctgatgatgttactatggaggatgcagaagatctaaggccctcaaagaggaaaacaatatatcccgagcataagcccatgtcagaaattacttctggtttgcatcgtggaatttaccaccaaggcaagcttcgggttaatcgctacaacccgtttgaagcatatgttgggagtgaaagtattggtgatgaaattattgtttatgggcgtacaaacatgaatagggcttttgatggtgatatagtggctgtggaacttttgcctcaagatcgctggcaagaagagaaatcgcttgccatagcaaatgatgaggatgaagaggaagatgatgttcatttagctccaagcagtgctgatgatgctcctcgagttccaagttcggctggggacaagaatgctatgccaactcgcccatctggtcgtgttatcggcattataaaacggaactggcactcttattgtggatctttggacccgatgcctatgcctgcgggcgagggtggtattgcacatgctctgtttgtctccaaagatcggaggattcctaagattcggatgcaaacccggcagcttggaaatctactggacaaaagaatcatcgttgctgttgattcatgggatcgattatctcgacatccttctggacattatgttagaactataggagaaataggcgacagagatactgaaagtgaggtggtgctgatagagaatgatattgatgccagaccattttcctctcaagttttggcatgtttgccaccgttgccttggtctgtatctgctgaagatatatcaaatcccattaggcaggatttgcgtcatttacgtgtcttcagcgtggatcctccaggttgcaaggacattgatgatgcattgcattgtatgcttcttccaagtggacattttgaagtgggagttcatattgccgacgtcacaaattttgttcaccctggaacccccttggatgacgaggctgcaacaaggggtacctctgtctaccttgtggagaggcgtattgacatgcttccaaaacctctgacagaagatgtttgttcattgcgttcagatgtagagagactgaccttttctgttatatgggaaatgactcctgaagcagagattatttctacaaggtacacgaaggccattatcaaatcatgtgctgcgctatcttatgtcgaagctcaggcgaggatggatgatagtcgcttgatggacccattaactacagatttgcggaatatgaatgtgttagcaaagataatgaggcaaaaacgcattgaaagaggagccttaactcttgcttctgctgaagttaaattccaaattgatactgaaactcacgatcctcttgacatcggtatgtatcaaattcgagaagcaaaccagatgattgaggagtttatgcttgctgccaatatatctgtagctaaaaaaattctggaacattttcctccgacttctctgttaagacggcatccaagcccaactaaagagatgcttgaacctttaattcaaacagctgctgccgttggtctctgtttggatgtgacatcttctaaagcactggctgactcacttgatcgtgctgtgggcgaagacccatacttcaataagctgattcgcattctggcaacaaggtgcatgacacaggcagtgtacttctgcagtggagatctgagccctccagagttttgtcattatggtcttgccgctcctgtgtatacacatttcacttctcctataagaagatatgcagatgtcattgttcaccgtctgctagctgcatccttggggatatgcaggctcccggatatattccaagaaagacctcggcttactagtattgctgacaatctgaattatcggcacaagaatgcccagatggctagccgggcctcagttgagctccatacactcatttatttcaggaataggcccactgacactgaggcgagaatactgaaaataagatcgaatgggttcattgtttttgtgccaaaatatggaatagaaggaccagtacacttgatggcgagaggacagaaggaaggaggaaaatggatagttgatgagcagcagcaaaagattaaaaagattgacggtcaggattcttacggcgttcttcagacggtcaggatccacatggaggtggttgagccacagccaaataggcccaagctccagcttacccttatctagtaaacctcctccaatacttataattatttttttctttaaattatctaggccaagtcgtagttgtttatgcagttaaaaaaacgaataggtgaaaagaccatgtcgactttagctagctctgttctctacttattgcgtctccacagacgctgcattttgagcaatcaaattatgtactcagttggtttacattgttacatggttaatatatttggaaaagacta

SEQ ID NO: 2290 - DNA, 3023 bp, Brassica napus
tcggtctccgttccaacgactgaaatctctcaccggcgaaacaagtattcgagcaagaggttgaagaagaagaagaagatgttgcagagcaaggttttcaataagaagaccagaggaggtcgtattcaaaagcaagtgagagaagtgtatctacgagatgacatatactgtggagccttttcctgcaagtcttgcgatacttcagctgctcgtttgtcttcccctaagattattgttgtcgataccaacgtcgttcttcaccaaattgatttgttggagaatcaggcaatagacaatgttgttgttctctctgtggtgctggatgaggttaagaacaggaacaaatctgtttacaatagaatcagaagtctctgcagcaatccagccaagcaattctatgttttctccaatcatgtccacaaggatacttatgtgcaggccatggagagagagactgccaatgaccacaatgatagagctattcgtgtcgctacattatggtaccagaagcatctaggggatacatctcaggtgttgcttgtcactaatgacagagagaataaacggaaagccattgaagagggaatatctgcagagacaattgaggcttatgtaaaatcaattgggcaacctgaattgttggacctgcttgcccaaccagccggtgaagacgtcactatggaagatgcagatgattccagaccttccaagaggaaacttgtatacctagagcataaacccatgtctgagattactgctggtttgcaccgtggaatataccatcaagggaaactccgtgtcaatcgtttcaatccttttgaagcttatgttggaagcgagagcattggagaagagattattatctatgggcgcagcaatatgaacagggctttcgatggtgatattgtcgcggtagaactcttgcctcgtgatcagtggcaagaggagaaggcgttatctatagctgaagaagatgaggaggaagatgacgatactgttcatttggctcccaacagtgctgatgatgctcctagaacctcaaatttagcccaagtaacttctggtgataaaaatgctaaccctgctcgtccttcaggtcgtgtagttggtgttatccgtagaaattggcactcatattgtggatctcttgaaccaatgtccctgcctgctggaagtggtggaacggcgcatgctttattcgtctctaaagatcgaagaatccccaagattcgcattaacactcgtcagcttgagaaccttttggatatgaggatagtagtggcagttgattcttgggaccgtcaatctcggtatccttctggccattatgtacgaccaattggcaaaataggtgacagggaaactgaaacagaggttgtcttgatagagaacgatgttgactactcgccattctcttctcaaattctggcatgcttgccacccttaccttggtctgtatctgctgaagacgtctctagtcctgttaggcaagacttgcgacatttgcttgtatttagtgtggaccctccgggttgcaaggatattgatgatgcattgcactgtacatcgcttccaaacgggaactttgaacttggagtccacattgcggatgtaacaaactttgtacaccctggtactcctttggatgatgaagcatcaaaaagaggcacatctgtctaccttgttgaccgccgtattgacatgcttcccaagcctttaactgaagatatttgctcgcttagagctgatgtggaaagacttgcattctcggttatttgggaaatgagccctggagctgaaattatctcaacgagatttacaaagagcataatcaagtcttctgcagcattgtcctatgttgaagctcaggctcggatggatgacagccgattgacggaccccgtgactactgatctgaggaacatgaatgctttagcaaagataatgaggcaaagacgtatcgataggggagccttaactcttgcgtctgcagaagttaaatttcagattgatactgagactcatgatcctcttgacattggtatgtatcagattcgggaagcaaaccaaatggttgaggaattcatgcttgctgcaaatgtttcagtcgctgaacaaattcttaaactattcccttcgtgttcactattaaggcgtcatcctactccaacaagagaaatgcttgaaccgctgctgcgtactgctgcagctattgggcttagcttagatgtctcttcatctaaagctttggctgattcactggaccgagctgtgggtgaggatccatatttcaataagctgatcaggatattggctactaggtgcatgacacaggctgtgtacttctgtagtggggatctcagtcctccagaatatcttcattatggacttgcagcacctttatatactcattttacatctcctattcgaagatatgctgatgtctttgtgcacagattacttgccgcgtcattaggaatatacaagcttccaacggtgttccaagacagacctcaacttactagcgttgctgataatttgaactatcggcataggaatgcccagatggcaagtcgagcttcagtagagctgcacaccctcatatacttcaaaaaccgacccacagatgcagaggcaagagttgtgaagataagatccaatggttttatagtattcgtcccaaagtatggaatcgaaggccctgtttacttaacagcaaaaggtgagaaaggagttggtgactggtacgtagatgaggagaagcagaagattgttaagatggatggaagtttatcttacagtgtcttgcaaactgtgaggattcacatggaggtagtggagcctcagcctaaccgaccaaactcgaactcacccttttgtaaaactcttcaaccatttaagtctcgctttcactacttttatatagtctggaccaattgtcaagagcttgtgtggtatttacatttgttttgtgtactttatgcctattttattttgctctgtgtttcattgtcaaagtcaaa

SEQ ID NO: 2291 - DNA, 2044 bp, Trigonella foenum-graecum
ttcattttgaagttatcaccaatcttcaatggcgaagatgaatccattattcatcctcgccttcttctccatttcttctctcttcttctccaccgtcagatctgattcgtcagataaacgttacaaagaaggagatcttgttcctctcttcgctaacaaagttggtccttttcataatccaagtgagacgtatcggtattttgatctgccattttgtataccagatcatttgaaagagaagaaggaagcactaggtgaagtgttgaatggggatcggttggttagtgctccttatcagcttgagttccaaaaggacaaggactctgtgccagtttgcaagaagacacttacaaaagaagaagtggggaattttcggtccgctgttcgtaaagactactactttcagatgtattatgatgatttgcctatttggggtttcatagggaaggttgataaggaagggaaagaccctagtgattatagatactacctttacaagcacatccattttgatatattttataacaaggatcgagttattgagatcaatgtgcgaacagatccaaatgcccttgtggatgttacagaggataatgaagttgatgtggagtttttctatactgtgaaatggaaagagactaacactcccttcgagaagcggatggacaagtactctcagtcgtcctccctaccccatcatttggaaatccattggttctcgattatcaattcgtgtgtcacagtcctcctcttgaccggttttcttgcaactattttgatgcgggtccttaagaacgactttgtcaagtatgcacatgatgaggagactgcagaggaccaggaagagaccggctggaaatacatccacggtgatgtttttaggtttcccaagtttaagtctgtttttgcagctgctcttggatctggtacccaactgtttacccttacggtgttcatattcatattggctcttgttggtgtattttatccttacaaccgaggggctctattcactgcacttgttgtcatatatgcactcacttcaggaattgctggctatactgctacctcattctattgtcaactggaaggaacaaactgggttcgaaatctgctattgactggatgccttttctgtggacctctgtttcttacgttttgctttttgaacactgttgcaattgtctacaatgctactgctgctctcccgttcggcacaattgtcgttatagttctcatatggacacttgttacatctcctctacttgttttgggaggtattgctgggaaaaacagcaaggctgaattccaagctcccgtccgcacaactaaatatcccagggagattccccctttgccatggtaccggggaacaattcctcagatggcaatggcaggatttttgcctttcagtgctatatacattgaactttattatatatttgctagtgtttggggtcacagaatttacacaatctacagtattctgtttattgtcttcatcattctcttgattgtcactgctttcattactgtggcattgacatacttccagcttgctgctgaagatcatgaatggtggtggagatcattcctatgcggtggttcaactggattatttatctatgcctattgtctgtattactaccatgcacgctccgatatgtcaggattcatgcagacctcatttttctttggatacatggcctgcatatgctatggtttcttcttgatgcttggaactgttggattccgtgcatcattgttctttgttcgtcacatataccgatccattaagtgcgagtaggcattttgtcatctcttattgtcttcatttcataggcattctgtagaaaagttatagtaattttgcagttctgtgtactataagggaagctgggttggatgggtttgtagcttccaaagcaacttgttagatcacaaagagaactttttggagataacgtctgtactaccatatctttaactaaattcttgaaatacttaatttttttggtctatttgaacgcaattcttgtcggtt

SEQ ID NO: 2292 - DNA, 2232 bp, Aquilegia formosa
aatcaaatctccttgtagaaaagagaaaataagacgaagaagaaagacgaaacgaagacgaagttgaaagagagaaaatggcgaagaagaagaacactctcttgttctcgatttccattctgatctcattcttagcaatccatgttagatctgacggctcagatcatcgttacaagctcggtgaaccagttcctttgtatgctaacaaagtcggaccatttcacaaccctagtgaaacatataggtactttgatctaccattctgtttaccagctcatttgaaagagaagaaagaagctttaggtgaagtattaaatggagatcgacttgtaagtgcaccttacaaacttgattttcttgctgaaaaggattctgaagttgtttgtaagaagaaacttacaactgaagaagtaattcaatttagaaaagctgttactaaagattattactttcaaatgtattacgatgatctaccaatttggggatttattggaaaagttgataaagaaggcaaatctgatcctagtgaatataagtattatctatataagcatattcactttgatattaattacaataaggatcgagttattgagattaatgtgagaactgatccgaattcgttagtggatcttactgaagataagccagttgaagctgaatttatgtacactgtcaagtggaaggaaactaccattccttttgagaaaagaatggagaagtattctcagtcttcttcgatgccacatcatttggagatccattggttctcaattatcaactcttgtgtcactgttcttttgctgacgggatttcttgccacaattctcatgcgagttcttaagaatgattttgtcaagtatgcacacgatgaggaagctgctgatgatcaggaagagactgggtggaaatacatccatggtgatgtattcaggtacccaaagagcaagtctttgtttgcagcggcccttggttctggcactcagctgtttactcttacaatcttcatttttgtcctcgcattagttggggtgttttatccttacaaccggggagctctttttaccgcactggttgtcatatatgcacttacatccgggatcgcaggctatactgcaacttctttctattgtcagcttgaaggatccaactgggtgaggaatctgttgctcacgggatgccttttctgtggacctctgtttctgactttctgctttcttaatacggttgcaattgcgtacagtgcaaccgcagcactgccatttggaacaattgtggtgattgtcctcatatggacattagtaacctcgcctttgctagttttgggtgggattgctgggaagaacagcaagtctgagtttcaagctcccgttcgcaccacaaagtaccccagagagattccacccttgccttggtaccgcgggactcttccacagatggcaatggcagggttcttacctttcagtgctatttacatcgaactttactacatatttgccagtgtttggggacatagaatttacaccatatacagcatcctgtttattgtcttcattatccttttaatcgtcactgctttcatcactgtggcattgacatattttcaacttgctgccgaagaccatgagtggtggtggaggtcattcctatgtggcggatcaactggtttatttatttatggctactgcttatattactattatgcacgatcagatatgtctggcttcatgcaaacctcgttcttttttgggtacatggcatgtatctgctacggtttctttcttatgcttggttccgttggtttccgtgcttctttgcttttcgttcgtcacatatacagatccatcaaatgcgagtaatgagaatcagtagcctgctctcgagttattaggtacgtttcttcgttttgttctataggcgctcggttgcagagatcatatgattaaggtagtgggaagcacctcatgtcaggagcagaaacaaagattcagtggtggccatatgctcgctctcggaaggcttgaattttgtggtgcttttagtaggggagtgttgggtatcaagaactttacttgaggttgactggtgtctgtaatctgagaacacaatgcacaatgcatgctgaaaaaaaaaatatttgtaccattttgtgtagttgaactccttggaagactgatatatctctacttgaaatttacctttttggatcaatatggatcacttcatcagttc

SEQ ID NO: 2293 - DNA, 2148 bp, Gossypium hirsutum
cacatcttcctttttctctcattattatcctacccaaatgagaaactttggcaactctccggcctttgtaatcctcggagtttttatcctctcttgtgtttcccatgttagatccgacgcctccgaccaccgttacaaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtcagtgctccttataaactgaattttaaagaggaaaaagattcttccgttgtttgtaagaagaaactttcaaaggatgaggttgtctttttccgaaaggcggtcgaaaaagattattatttccaaatgtactatgatgatttgcctatctggggttttattggcaaagttgataaggaaggaaaagctgatcccagtgagtacaagtattacctttacaagcatatccagtttgatgtactttataacaaggatcgtgttattgagatcagcgcaaggatggatccacatttgctcgtggacttgactgaggataaggaagttgatgctgagtttatgtacactgtgaaatggaaggaaactgatactccttttgagaagaggatggagagatattccatgtcttcttctttgccgcatcatttagagattcattggttttcaattatcaactcttgtgtgacggttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaacagaggagctctatttactgccctggtggtaatatatgcccttacgtcagggattgcaggctacgtagcaacttctttctactgtcagcttgaagggacaaactgggttaggaatctgttattgactggctgccttttctgtgggcccttgtttcttacattctgcttccttaacacagttgccattgcatacagtgcaactgcagcactgccttttggaactattgtagtaatagtcctcatatggacactcgtgacatctccattgcttgttctgggtggtattgctggcaaaaatagcagggctgagttccaagctccttgccgcaccacgaagtatcctcgagaaattccaccattgccttggtacaggagtgccattcctcagatggcaatggctggatttcttccatttagtgctatttacattgaactttactacatattcgccagtgtctggggccacaggatctatactatatacagcatcttgtttattgtattcataatccttctgattgtcacagcttttataactgtggctttgacatatttccaacttgctgctgaagatcatgaatggtggtggaggtctttcctctgtggtggatcaactggtctctttatctatgcctactgcttgtattattactatgcacgatcagatatgtctggttttatgcaaacctcgttcttctttggttacatggcgtgcatctgctacggattcttcctcatgctggggacagtgggtttccgtgcctcgctattctttgtgcgtcacatatacaggtctatcaagtgcgagtagaggttttagttgtcccttgccatttcccagcaattctgtcagagaaaaaaatctatggtaatgtcaattaacaaatgaggcatgctttgactatgcttaatggagatctacgaaatcattgtgtttattaatattttgactgtacgtaaagatgttgacagatttgtgtaggttgctgttactttaatacctctttggctcttttcaaccaaccaaagatctttcctgtccctttacttgatgcagaaatccagttttctttaacaatctagtttattattattattattatttgggatcaataaataggttaattattctgttca

SEQ ID NO: 2294 - DNA, 2069 bp, Gossypium hirsutum
ttttctctcattattatcctacccaaatgagaaactttggcaactctccggcctttgtaatcctcggagtttttatcctctcttgtgtttcccatgttagatccgacgcctccgaccaccgttacaaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtcagtgctccttataaactgaattttaaagaggaaaaagattcttccgttgtttgtaagaagaaactttcaaaggatgaggttgtctttttccgaaaggcggtcgaaaaagattattatttccaaatgtactatgatgatttgcctatctggggttttattggcaaagttgataaggaaggaaaagctgatcccagtgagtacaagtattacctttacaagcatatccagtttgatgtactttataacaaggatcgtgttattgagatcagcgcaaggatggatccacatttgctcgtggacttgactgaggataaggaagttgatgctgagtttatgtacactgtgaaatggaaggaaactgatactccttttgagaagaggatggagagatattccatgtcttcttctttgccgcatcatttagagattcattggttttcaattatcaactcttgtgtgacggttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaacagaggagctctatttactgccctggtggtaatatatgcccttacgtcagggattgcaggctacgtagcaacttctttctactgtcagcttgaagggacaaactgggttaggaatctgttattgactggctgccttttctgtgggcccttgtttcttacattctgcttccttaacacagttgccattgcatacagtgcaactgcagcactgccttttggaactattgtagtaatagtcctcatatggacactcgtgacatctccattgcttgttctgggtggtattgctggcaaaaatagcagggctgagttccaagctccttgccgcaccacgaagtatcctcgagaaattccaccattgccttggtacaggagtgccattcctcagatggcaatggctggatttcttccatttagtgctatttacattgaactttactacatattcgccagtgtctggggccacaggatctatactatatacagcatcttgtttattgtattcataatccttctgattgtcacagcttttataactgtggctttgacatatttccaacttgctgctgaagatcatgaatggtggtggaggtctttcctctgtggtggatcaactggtctctttatctatgcctactgcttgtattattactatgcacgatcagatatgtctggttttatgcaaacctcgttcttctttggttacatggcgtgcatctgctacggattcttcctcatgctggggacagtgggtttccgtgcctcgctattctttgtgcgtcacatatacaggtctatcaagtgcgagtagaggttttagttgtcccttgccatttcccagcaattctgtcagagaaaaaaatctatggtaatgtcaattaacaaatgaggcatgctttgactatgcttaatggagatctacgaaatcattgtgtttattaatattttgactgtacgtaaagatgttgacagatttgtgtaggttgctgttactttaatacctctttggctcttttcaaccaaccaaagatctttcctgtccctttacttgatgcagaaatccagtttt

SEQ ID NO: 2295 - DNA, 2354 bp, Gossypium raimondii
agaggaaatgctatatatctccgtatatgatatgtgatgtgatatacccacttcttgtttctctctctctctctctttttctcatcatatatatattgcattgcagaatttcacaaatcctatcacacgtcttcctttttctctcattattatcctacccaaaatgagaaactttggcaactctccggcctttgtaatcctcggagtttttatcctctcttgtgtttcccatgttagatccgacgcctccgaccaccgttacaaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtcagtgctccttataaactgaattttaaagaggaaaaagattcttccgttgtttgtaagaagaaactttcaaaggatgaggttgtctttttccgaaaggcggtcgaaaaagattattatttccaaatgtactatgatgatttgcctatctggggttttattggtaaagttgataaggaaggaaaagctgatcccagtgagtacaagtattacctttacaagcatatccagtttgatgtactttataacaaggatcgtgttattgagatcagcgcaaggatggatccacatttgctcgtggacttgactgaggataaggaagttgatgctgagtttatgtacactgtgaaatggaaggaaactgatactccttttgagaagaggatggagagatattccatgtcttcttctttgccgcatcatttagagattcattggttttcaattatcaactcttgtgtgacggttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaaccgaggagctctatttactgccctggtggtaatatatgccctcacgtcagggattgcaggctacgtagcaacttctttctactgtcagcttgaagggacaaactgggttaggaatctgttattgactggctgccttttctgtgggcccttgtttcttacattctgcttccttaacacagttgccattgcatacagtgcaactgcagcactgccttttggaactattgtagtaatagtcctcatatggacactcgtgacatctccattgcttgttctgggtggtattgctggcaaaaatagcagggccgagttccaagctccttgccgcaccacgaagtatcctcgagaaattccaccattgccttggtacaggagtgccattcctcagatggcaatggctggatttcttccatttagtgctatttacattgaactttactacatattcgccagtgtttggggccacaggatctatactatatacagcatcttgtttattgtattcataatccttctgattgtcacagcttttataactgtggctttgacatatttccaacttgctgctgaagatcatgaatggtggtggaggtctttcctctgtggtggatcaactggtctctttatctatgcctactgcttgtattattactatgcacgatcagatatgtctggttttatgcaaacctcgttcttctttggttacatggcatgcatctgctacggattcttcctcttgctggggacagtgggtttccgtgcctcgctattctttgtgcgtcacatatacaggtctatcaagtgtgagtaggggttttagttgtcccttgccctttcccagcaattctgtcagagaaaaaaatctatggtttttgttagaaaattaactggaagattgaatgtcaagtaacaaatgaggcatgctttgactatgcttaatggagatctacgaaatcattgtgtttattaatattttgactgtacgtaaagatgttgacagatttgtgtaggttgctgttactttaatacctctttggctcttttcaaccaaccaaagatctttcctgtccctttacttgatgcagaaatccagttttctttaacagtctagtttattattattattattatttgggatcaataaataggttaattattctgttcactttcaatggactaaaaaaagctctataagcagatttaagatgatgttaaat

SEQ ID NO: 2296 - DNA, 2155 bp, Gossypium hirsutum
catcgtatatatattgcattgcagaatttcactaatcctttcacacgtcttcctttttctctcattattatccgacctaaaatgagaaactttggcaactctccggcgtttgtaatcctcggagtttttatcctctcttgtgtttcccatgttagatccgacgcctccgaccaccgttacgaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtgagtgctccttataaactgaattttagagaggaaaaagattcttccgttgtttgtaagaagaaactttctaaggatgaggttgtctttttccgaaaggcggttgaaaaagattattatttccaaatgtactatgatgatttgcctatctggggttttattggtaaagttgataaggaaggaaaagctgatcccagtgagtacaagtattacctttacaagcatatccagtttgatgtactctataacaaggaccgtgttattgagatcagcgcaaggatggatccacatttgctcgtggacttgactgaggataaggaagttgatgctgagtttatgtacactgtgaaatggaaggaaaccggtactcctttcgagaagaggatggagagatattccatgtcttcttctttgccgcatcatttagagattcattggttttcaattatcaactcttgtgtgacagttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaaccgaggagctctatttactgccctggtggtaatatacgccctcacgtcagggattgcaggctacgtagcaacttctttctactgtcagcttgaagggacaaactgggttaggaatctgttattgactggctgccttttctgtgggcccttgtttcttacgttctgcttccttaacacggttgccattgcatacagtgcaactgcagcactgccttttggaactattgtagtaatagtcctcatatggacactcgtgacatctccattgcttgttctgggtggtattgctggcaaaaatagcagggccgagttccaagctccttgccgcaccacgaagtatcctcgagaaattccaccattgccttggtacaggagtgccattcctcagatggcaatggctggatttcttccatttagtgctatttacattgaactttactacatattcgccagtgtttggggccacaggatctatactatatacagcatcttgtttattgtattcataatccttctgattgtcacagcttttataactgtggctttgacatatttccaacttgctgctgaagatcatgaatggtggtggaggtctttcctctgtggtggatcaactggtctctttatctatgcctactgcttgtattattactatgcacgatcagatatgtctggttttatgcaaacctcgttcttctttggttacatggcatgcatctgctacggattcttcctcttgctggggacagtgggtttccgtgcctcgctattctttgtgcgtcacatatacaggtctatcaagtgtgagtaggggttttagttgtcccttgccctttcccagcaattctgttagagaaaaaaatctatggtttttgttagaaaattaactggaagattgaatgtcaagtaacaaatgaggcatgctttgactatgcttaatggatatctacgaaatcattgtgtttattaatatttggactgtacgtaaagatgttgacagatttgtgtaggttgctgttactttaatacctctttggctcttttcaaccaaccaaagatctttcctgtccctttacgtgatgcagaaatccagttttctt

SEQ ID NO: 2297 - DNA, 2181 bp, Manihot esculenta
gtaatggtaaataacgccattgccttcagctcttcttctcttattagatcccctcttctcttacttccagaagaacgaagaggagagaagcttaactaacagccatggacaatccctttgccactctccttctcttcctcttcgcggttgttgtcgcctcttctgtaacccacgtcagatcggactcctccgaccaccgctacaaggagggcgactctgttcctctatacgccaacaaggttggcccttttcaaaaccccagtgaaacatatcgctatttcgatctgcccttctgcgttccagatcatgtcaaagagaaaaaggaggctcttggtgaggtgttgaatggagatcgtctagtcagtgctccttacaaactaaacttcagagatgagaaaacctcatcacttgtttgtaagaagacactttcaaaggaggaagttgcaaagttcagatctgcaatagataaagactattacttccaaatgtattatgatgatctgcccatctggggcttcataggaaaggttgacaaggaaggcaagactgacccgagtgaatacaaatacttcctttacaaacatatccagttcgatgttctttacaataaggatcgtgtgattgaagtgagtgtgcggatggatcccaattcactcttggatctgacagaggacaaggaagttgaaacagagttcttttatactgtgaagtggaaggaaacagatactccctttgagaagagaatggaaaagtactcactatcttcttcattgccacatcacttggaaatccattggttctccattataaactcatgtgtgacagttctccttctgactggttttcttgctaccattctcatgcgggttttgaagaatgattttgtgaagtatgcacaagatgaagaagcagctgatgatcaggaagagactggatggaagtacattcatggtgatgtatttagatatccaaagtacaaatctttgtttgctgcagcccttgggtctggcagtcagctgttcactctcactgtatttatttttattcttgcattggttggtgtattttatccatacaatcgaggagctctatttactgcacttgtggtcatatatgcacttacgtctggaattgctggatatacagcaacctctttctattgtcagctggaaggaaataactgggtgaggaatcttttgctgacaggatgccttttctgtgggcccttattcctcacattctgcttccttaacactgttgccattgtctatagtgcaaccgcagcgttgcctttcggcactattgtggtaatagttcttatatggacactagtaacatcacctttacttgttttgggtggtattgctgggaaaaatagcaaggctgaatttcaagccccttgccgcaccactaaatatcctcgggagatcccacaattgccttggtacaggagtagtcttcctcaaatggcaatggcaggtttcctgccttttagtgctatttacattgagctatactacatttttgcaagtgtttggggacacaggatttataccatttacagcatcctttttattgtcttcattattcttctgattgtcactgctttcataactgtggctttgacgtactttcaacttgctgctgaagatcatgagtggtggtggaggtcttttctctgtggtggatcgaccgggctgtttatctatgcttattgcttgtactactactatgcaagatctgatatgtctggcttcatgcagacctctttcttctttgggtacatggcttgcatatgctatggcttctttctcatgcttgggacagtgggattccgtgcctccttgttctttgtacgtcatatataccggtctattaagtgtgagtagaatgggtcttttctctttttttggtttccatgaactctgtcagagaaacatctatgattttgttcaaagttaggttggagactgtattggatatcaaaagttcgaaaagttaaaaaggcaggccctttccctggttatgcatttcttttacgggaaggggtttgttttctgaggtctctgttatgcattggcttaggctgtaggaaccttccaaggaaatatgtggtttagtcaacattttgggtatatgtaattgtcagacatacaaaatgaaaaatatttgttctgttgc

SEQ ID NO: 2298 - DNA, 3866 bp, Gossypium hirsutum
atatatattgcattgcagaatttcactaatcctttcacacgtcttcctttttctctcattattatccgacctaaaatgagaaactttggcaactctccggcgtttgtaatcctcggagtttttatcctctcttgtgtttcccatgttagatccgacgcctccgaccaccgttacgaagaaggtgaccctgtccctctctacgccaacaaggtcggccctttccacaaccccagtgaaacctatcgctactttgatctgcccttctgttctccagatcatgtaaaggagaagaaagaagcattaggtgaggtattgaatggagatcgactcgtgagtgctccttataaactgaattttagagaggaaaaagattcttccgttgtttgtaagaagaaactttctaaggatgaggttgtctttttccgaaaggcggttgaaaaagattattatttccaaatgtactatgatgatttgcctatctggggttttattggtaaagttgataaggaaggaaaagctgatcccagtgagtacaagtattacctttacaagcatatccagtttgatgtactctataacaaggaccgtgttattgagatcagcgcaaggatggatccacatttgctcgtggacttgactgaggataaggaagttgatgctgagtttatgtacactgtgaaatggaaggaaaccggtactcctttcgagaagaggatggagagatattccatgtcttcttctttgccgcatcatttagagattcattggttttcaattatcaactcttgtgtgacagttctccttttgactggtttccttgcaacaattctcatgcgggtcttgaagaatgatttcattaagtacggtcaagatgaagaagcagctgatgatcaagaagagactggatggaagtatattcatggagacgtattccgtttcccaaagtacaaatctctctttgctgctgctctcggatctggaacacagctgttcactttaacggtcttcatttttatgcttgcactggttggtgtcttttatccatacaaccgaggagctctatttactgccctggtggtaatatacgccctcacgtcagggattgcaggctacgtagcaacttctttctactgtcagcttgaagggacaaactgggttaggaatctgttattgactggctgccttttctgtgggcccttgtttcttacgttctgcttccttaacacggttgccattgcatacagtgcaactgcagcactgccttttggaactattgtagtaatagtcctcatatggacactcgtgacatctccattgcttgttctgggtggtattgctggcaaaaatagcagggccgagttccaagctccttgccgcaccacgaagtatcctcgagaaattccaccattgccttggtacaggagtgccattcctcagatggcaatggctggatttcttccatttagtgctatttacattgaactttactacatattcgccagtgtttggggccacaggatctatactatatacagcatcttgtttattgtattcataatccttctgattgtcacagcttttataactgtggctttgacatatttccaacttgctgctgaagatcatgaatggtggtggaggtctttcctctgtggtggatcaactggtctctttatctatgcctactgcttgtattattactatgcacgatcagatatgtctggttttatgcaaacctcgttcttctttggttacatggcatgcatctgctacggattcttcctcttgctggggacagtgggtttccgtgcctcgctattctttgtgcgtcacatatacaggtctatcaagtgtgagtaggggttttagttgtcccttgccctttcccagcaattctgtcagagaaaaaaatctatggtttttgttagaaaattaactggaagattgaatgtcaagtaacaaatgaggcatgctttgactatgcttaatggatatctacgaaatcattgtgtttattaatatttggactgtacgtaaagatgttgacagatttgtgtaggttgctgttactttaatacctctttggctcttttcaaccaaccaaagatctttcctgtccctttacgtgatgcagaaatccagttttctttaaaaaagaaaaaccaaattggatggcattgtgtgtttacaataattaattttaccagccaatccaaatatatatatatttatctgatttatgaacttccgtttgatttcggcggcggcgtaaatcagtggcggcgagtgtggttgaatggttggtgtagaggagcggctgcggtggtgttgaggccgtgggatggaggtgaaaccgccactgacggtggtggacattggtaacactttgtgaagagcccgaatgtgtcgatctggtctataaaatttaccatgctcgcccatccaccgaatccgaacccaacgattaggacccacaccacaatgaacacgtttatggtgaatgtccccaaccatcttccaaagtacttgggtggttggtccacagcattctctctagcagtggctgatctgaaggtgaaaatgtgagccaatgcagggatgatatagacagtgaagctaacgagaagagatcccacagtagagttgataggtccaaagaatgggaaaattatagccaagaaccaaatgggaatcaccactggcaatcttactgctgctcttttgcataggctcttacattcatgcatcccaatggctttctcccatacaaaatacaatggcgtgcatgcaaatccaaatgttatgaactggtggatgagcattaaaatgacagccatgtccctgaatgtagttcttgggagaagggaaaaagcatttgagtgatcgagaagcatgtccccaaatgcccaataaacagctgccgctgaaggaagtgtcagtgtcattacatacagtgtggctatcaagtatatagctttaaacctctgtggcttccacattgcatgcatgatctccacagtgacagcatgtcccccaaatgtatagagaatgttggtggccccagtgaagtatagcactagcttggttggaccagtatgttgcaccccttcaacctggccatggaggagggaagcaatggtgaggtaccaagcagtgtaagtggtcattaaaagaccaaggaaagaccagattctataattgtgaaatgaaggaataaagacagtggtagcacaacatgctccaaagatgtaagtccatgtcctcttgtctagattgtcatttatgtaatatatattgcttgcacaagctatgagttgaatgacagatccaaagagaagaaaagtgcaattgaatgccaaacccacatttctccaatgttttccaaggagaccatcaagaacttcaaaccactgaatgacatggttcctgaaatcaaccttctctctttctttccttgttctatattctacatacaatatgctaatgatataagctgtccaactacccaacaaaccataaaacaactgcaataagataccagacaacatccccaactgtgaaaatgaatatggcaatgtaagcaacacttgagccacctgattagaagcacagctgaaccaggcatcatatacagaaccaccatgccagaagagcttagagaatttgcttttcatgccctttgatttgccttcagttttcataatttctacatagtccccaacaatcgcagtctcttcttcccctactttttcactttccatggttgataaagctctggttttctatcactggttcctacaagttaagttctttgatttgaaaaaaatgaaaaactggggttgtgttggttcaatgtaagaagatga

SEQ ID NO: 2299 - DNA, 2087 bp, Chelidonium majus
tgatctcgtctttgttaattcaagtaagatctgatggttctgatcatcgttacaaacctaatgatccagtccctctctatgctaacaaggttggcccctttcacaaccccagcgaaacctaccgattctttgatctacctttctgttctccatctcatgtaactgagaaaaaagagctcttggtgaagtattgaatggtgatcgtttggttagtgcaccttacaaactagatttcttagttgagaaggattctgaagttgtttgtaaaaagaaattaacggcagaagatgtcaaacagtttcgtaatgctgttatcaaagattattactttcagatgtactatgatgatcttccgatctggggtttcattggaaaagttgagaaggatggtaaaactgatcctagtgattacaaatactatctttataaacacattaactttgaaatcctttacaataaggatagggttatcgaaattaatgttcgaacggatccaaatgctttggtggatctcactgaggataagcctgttgatgctgagttcatgtacactgtgaaatggaaagagacaactactccttttgagaagaggatggataaatattcgcagtcttcgtcgttgccacatcatttggagattcattggttctcaattattaactcatgtgttaccgttcttcttctaactgggtttcttgccacgattcttatgcgggttctcaagaatgattttgtcaagtatgcgcatgacgaggaggcagctgatgaccaagaagagactggatggaagtacatccatggtgatgtgtttaggtacccgaaggggaagtctttgtttgctgcagctcttggttctggtacccagttgtttgcgcttacgatcttcatttttgtacttgctcttgttggggtattttatccatacaaccgaggtgctctcttcactgctctcgttgtcatatacgctcttacatctgggattgcaggctatacagctacctctttctattgtcaacttgaaggaacaaactgggttaggaatctattattgacaggatgcttgttctgtggtcctcttttcctgacattttgtttcctcaacaccgtcgcaattgcctacagtgccacagctgcacttccttttggcactattgtggtcatagttctcatatggactctagtaacatcacctttacttgtattgggtgggattgctgggaaaaacagtaagtccgagttccaagctccggtccgcaccacaaagtatcccagagagattccaccattgccttggtaccgcggcactgttccacagatggcgatggcagggtttttgccattcagtgctatttacattgaactttactacatatttgccagtgtgtggggtcacagaatttacaccatatacagcattctctttattgtcttcatcatcctcttgattgtcactgctttcattactgtggcattgacatacttccaacttgccgctgaagatcatgaatggtggtggaggtctttcctatgtggagggtcgactgggttatttatctatggttattgcttgtactactactacgcaagatcagatatgtctgggttcatgcaaacctcgttcttcttcggttacatggcttgcatctgttacgggttctttctcatgcttggtaccgttggtttccgtgcatctttgctctttgtccgtcacatataccgatctatcaagtgtgagtagagtaggtcagttgaaagatctctgctcataaagtcatcttcaggtgtcttttctcttctttcttttttttttctctcgtttttataggtcctttttatagagaaaggttatatgatttttgttaaacgtagtttggagagtccctttgatcttagaagcagaagaagaagcaagggttttgaatcgaggcaatgttgtcaaagaaagtagaatatgtttgtgccactgcctcgtagccatgtttaattgatgtgggtgggtctgtaatctgagaaagacaagcctgggggggttcctccttgagaagaatcttttgtatcattctgtgtaactgcactcactggaaaac

SEQ ID NO: 2300 - DNA, 2108 bp, Gossypium hirsutum
taagtactaatcctttcattctgtttttcgacactccaaattttcagatttcctttccttttctcaccggaaaatgaaaaacatgggcgactttccgacgtttctagtcgtcggacttttgatcttcagttgtctttcctatgttagatccgacgcttccgatcaccgttacaaggacggtgacgctgtacctctttacgccaataaggttggcccctttcacaaccccagtgaaacctatcgctacttcgatctacccttctgttctccagatcatgtaacggagaagagagaagctttaggtgaggttttgaatggagatcgactcgtgagtgctccttataaattgaattttaaagaggaaaaagattcttctgttgtttgtaagaagcagctttcaaaagatgaggttgcctttttccgaaaggctgtcgacaaggactattatttccaaatgtactatgatgatttgccaatctggggttttatcggaaaagttgataaggaaggaaaaactgatccgagcgagtacaaatatttccttttcaagcatatccagttcgatgtcctttataacaaggaccgtgttattgaggttaatgcaaggatggatcctcactcgcttgtggacttgactgaggataaggaagttgatgctgagttcatgtattccgtgaaatggaaggaaactgatactccttttgagaaaaggatggacaagtactcaatgtcttcttctttgccacatcatttggagattcattggttttcgattatcaactcttgcgtcacagttctccttttgactggtttccttgcaacgattctcctgcgggttttgaagaatgatttcatcaagtatggtcaagatgaagaagcagctgatgaccaagaagaaactggatggaaatatattcacggagatgtattccggttcccaaagtacaaatctttgtttgctgctgctcttggatctggaactcagctgtttactttaacggttttcatttttatgcttgcattggttggtgtcttttatccgtacaatcgaggagctctattcactgcccttgtggtcatatatgcacttacatcaggaattgcaggatatactgcaacttctttctattgtcagcttgaaggaaacaactgggttaggaatctcttattgactggctgtcttttctgtggtccgttgtttctcacattctgcttccttaacacggttgctattgtatacagtgcaactgctgcactgccttttggaactattgtagtaatagtccttatatggacactagtgacatctccattgcttgttctgggtggaattgctggcaaaaatagcaaggctgagttccaagctccttgccgcaccacaaagtatcctcgagagattccaccattgccatggtacaggagtgccattcctcagatggcaatggctggatttcttccttttagtgccatctacattgagctttactacatattcgccagcgtttggggccacaggatctatactatatacagcatcttgtttattgtcttcatcatccttctgattgtcactgcttttataactgtggctttgacatacttccaactcgctgctgaagatcatgaatggtggtggaggtctttcctctgtggtggatcaaccggtatctttatctacgcctactgcttgtattattactacgctcgatcagacatgtctggatttatgcaaacctcgttcttctttggttatatggcctgcatctgctacggattcttcctcatgctcgggacagttggtttccgtgcctcgctactctttgtccgtcacatatacaggtctatcaaatgcgagtgacaggttatttttcatttccttccattctgtcatagaaaatattctatgatttttgttagatatttagcaggaattggagaagtgccttaaattgtcagctagcaaattgttgatgcatatgggtggcagagggccttggattaagttttaggcatcatctatttattaatatttgggttctatataaacaccatgagacagatttgtttaggatgctgttatttttatacttttatcatataaaattgat

SEQ ID NO: 2301 - DNA, 2331 bp, Gossypium raimondii
aaatgccgaaactgtcgtttacatctaacacaaaaatagaaaaaaagttatttcgctttaaaataatataaataaataattgtttttatttttattttttaatttcaccgctactaagaactaatccttttcattctggtttttcgacactccaaattttcagatttcctttcctttctcaccggaaaatgaaaaacatgggcgactttccgacgtttctagtcgtcgcacttttgatcttcagttgtctttcctatgttagatccgacgcttccgatcaccgttacaaggacggtgacgctgtacctctttacgccaataaggttggcccctttcacaaccccagtgaaacctatcgctacttcgatctacccttctgttctccagatcatgtaacggagaagagagaagctttaggtgaggttttgaatggagatcgactcgtgagtgctccttataaattgaattttaaagaggaaaaagattcttctgttgtttgtaagaagcagctttcaaaagatgaggttgcctttttccgaaaggctgttgacaaggactattatttccaaatgtactatgatgatttgccaatctggggttttatcggaaaagttgataaggaaggaaaaactgatccgagcgagtacaaatatttccttttcaagcatatccagttcgatgtcctttataacaaggaccgtgttattgaggttaatgcaaggatggatcctcactcgcttgtggacttgaccgaggataaggaagttgatgctgagttcatgtattccgcgaaatggaaggaaactgaaactccttttgagaaaaggatggacaagtactcaatgtcttcttctttgccacatcatttggagattcattggttttcgattatcaactcttgcgtcacagttctccttttgactggtttccttgcaacgattctcctgcgggttttgaagaatgatttcatcaagtatggtcaagatgaagaagcagctgatgaccaagaagaaactggatggaaatatattcacggagatgtattccggttcccaaagtacaaatctttgtttgctgctgctcttggatctggaactcagctgtttactttaacggttttcatttttatgcttgcattggttggtgtcttttatccgtacaatcgaggagctctattcactgcccttgtggtcatatatgcacttacatcaggaattgcaggatatactgcaacttctttctattgtcagcttgaaggaaacaactgggttaggaatctcttattgactggctgtcttttctgtggtccgttgtttctcacattctgcttccttaacacggttgctattgtatacagtgcaactgctgcactgccttttggaactattgtagtaatagtccttatatggacactagtgacatctccattgcttgttctgggtggaattgctggcaaaaatagcaaggctgagttccaagctccttgccgcaccacaaagtatcctcgagagattccaccattgccatggtacaggagtgccattcctcagatggcaatggctggatttcttccttttagtgccatctacattgagctttactacatattcgccagcgtttggggccacaggatctatactatatacagcatcttgtttattgtcttcatcatccttctgattgtcactgcttttataactgtggctttgacatacttccaactcgctgctgaagatcatgaatggtggtggaggtctttcctctgtggtggatcaaccggtatctttatctacgcctactgcttgtattattactacgctcgatcagacatgtctggatttatgcaaacctcgttcttctttggttatatggcctgcatctgctacggattcttcctcatgctcgggacagttggtttccgtgcctcgctactctttgtccgtcacatatacaggtctatcaaatgcgagtgacaggttatttttcatttccttccattctgtcatagaaaatattctatgatttttgttagatatttagcaggaattggagaagtgccttaaattgtcagctagcaaatagttgatgcatatgggtggcagagggccttggattaagttttaggcatcatctatttattaatatttgggttctatataaacaccatgagacagatttgtttaggatgctgttatttttatacttttatcatataaaattgatccttttttttttcttgatgattcaaaatctagttttcttttttatcaactactttaattttactgtaaaataattattatttccctacagtttatgtaaaaaagagaa

SEQ ID NO: 2302 - DNA, 1800 bp, Manihot esculenta
aaccatattctgcaaccaacatgaatgagcttttaatcttcctcattttcgcggttttgattgcttcctctgtgacccatgtgagctctgacgcctccgatcaccgctacaaggaaggcgaccatgttcccctctatgccaataaagttggcccctttcacaaccccagtgaaacatatcgctatttcgatctgcctttctgtgtaccagatcacgtcaaagagaaaaaagaagctcttggtgaggtgttgaatggagaccggctggtcagtgctctttacaaactcaacttcagagatgagaagacatcagcagttgtttgtaagaagacgcttacaaaggaagaagttgctcggttcagatctgcaattgacaaagactattactttcaaatgtactatgatgatctgcccatctggggtttcataggaaaggttgacaaagaaggcaaggctgatccgagtgagtacaaatacttgctttacaagcatattcaatttgatgttctgtacaataaggaccgtgtgattgaagttagtgtccggatggatccacattcgctgctggatctgactgaggaaaaggaagttgatgcggagttcctttatactgtgaagtggaaggaaacagatactccctttgagaagagaatggagaagtactcattgtcttcttcattgccgcatcacttggaaattcattggttctctattataaactcgtgtgtgacagttcttctattaaccggttttctggcaacaattctcatgcgggtcttgaaaaatgatttcgtgaagtatgcacaagatgaggaagcagctgatgatcaggaagagactggatggaagtacatccacggtgatgtctttagatacccaaaatacaaatcattatttgctgcagcccttgggtctgggacccagctatttactctcactgtgttcatttttgttcttgcacttgttggtgtattttatccatataaccgaggagctctatttactgcactggtagtcatatatgcactaacatctggaattgccggatatacagcaagctctttctattgccagctggaaggaaataattgggtgaggaatcttttgttgacaggatgccttttctgtgggcctctattcatcacattctgcttccttaacactgtagccattgtttacagtgctactgcagcattgccttttggcactattgtagtaatagtcctcatatggacattagtaacatccccgttgcttgtcttgggtggcattgctgggaaaaacagcaaggctgagtttcaagctccttgccgtaccacaaaatatcctcgagagatcccacaattgccttggtacaggagtgctcttcctcagatggcaatggctggttttctgccttttagtgccatttacattgagctttactacatttttgcaagtgtttggggccacaggatttatactatttacagcatcctgtttattgttttcattattcttctgattgtcactgcattcataactgtggcattgacatacttccaacttgctgctgaagatcatgaatggtggtggagatcttttctctgtggtggttcaactggtctgtttatctatgcttattgcttgtactactaccatgcgcgctctgatatgtctggcttcatgcaaacctctttcttctttgggtacatggcctgcatatgctatggcttctttctcatgctcgggacagtgggtttccgtgcctcgctgttctttattcgtcacatatacaggtcgattaagtgcgagtagtatt

SEQ ID NO: 2303 - DNA, 2114 bp, Gossypium hirsutum
taagtactaatcctttcattctgtttttcgacactccaaattttcagatttcctttccttttctcaccggaaaatgaaaaacatgggcgactttccgacgtttctagtcgtcggacttttgatcttcagttgtctttcctatgttagatccgacgcttccgatcaccgttacaaggacggtgacgctgtacctctttacgccaataaggttggcccctttcacaaccccagtgaaacctatcgctacttcgatctacccttctgttctccagatcatgtaacggagaagagagaagctttaggtgaggttttgaatggagatcgactcgtgagtgctccttataaattgaattttaaagaggaaaaagattcttctgttgtttgtaagaagcagctttcaaaagatgaggttgcctttttccgaaaggctgtcgacaaggactattatttccaaatgtactatgatgatttgccaatctggggttttatcggaaaagttgataaggaaggaaaaactgatccgagcgagtacaaatatttccttttcaagcatatccagttcgatgtcctttataacaaggaccgtgttattgaggttaatgcaaggatggatcctcactcgcttgtggacttgactgaggataaggaagttgatgctgagttcatgtattccgcgaaatggaaggaaactgaaactccttttgagaaaaggatggacaagtactcaatgtcttcttctttgccacatcatttggagattcattggttttcgattatcaactcttgcgtcacagttctccttttgactggtttccttgcaacgattctcctgcgggttttgaagaatgatttcatcaagtatggtcaagatgaagaagcagctgatgaccaagaagaaactggatggaaatatattcacggagatgtattccggttcccaaagtacaaatctttgtttgctgctgctcttggatctggaactcagctgtttactttaaccgttttcatttttatgcttgcattggttggtgtcttttatccgtacaatcgaggagctctattcactgcccttgtggtcatatatgcacttacatcaggaattgcaggatatactgcaacttctttctattgtcagcttgaaggaaacaactgggttaggaatctcttattgactggctgtcttttctgtggcccgttgtttctcacattctgcttccttaacacggttgctattgtatacagtgcaactgctgcactgccttttggaactattgtagtaatagtccttatatggacactagtgacatctccattgcttgttctgggtggaattgctggcaaaaatagcaaggctgagttccaagctccttgccgcaccacaaagtatcctcgagagattccaccattgccatggtacaggagtgccattcctcagatggcaatggctggatttcttccttttagtgccatctacattgagctttactacatattcgccagcgtttggggccacaggatctatactatatacagcatcttgtttattgtcttcatcatccttctgattgtcactgcttttataactgtggctttgacatacttccaactcgctgctgaagatcatgaatggtggtggaggtctttcctctgtggtggatcaaccggtatctttatctacgcctactgcttgtattattactacgctcgatcagacatgtctggatttatgcaaacctcgttcttctttggttatatggcctgcatctgctacggattcttcctcatgctcgggacagttggtttccgtgcctcgctactctttgtccgtcacatatacaggtctatcaaatgcgagtgacaggttatttttcatttccttccattctgtcatagaaaatattctatgatttttgttagatatttagcaggaattggagaagtgccttaaattgtcagctagcaaattgttgatgcatgtgggtggcagagggccttggattaagttttaggcatcatctgtttattaatatttgggttctatataaacaccatgagacagatttgtttaggatgctgttatttttatacttttatcatataaaattgatcctttt

SEQ ID NO: 2304 - DNA, 2161 bp, Glycine max
gtagtgaataaattgcttgcttgttgtccttgtctgtttctttttctttatctatctgatctgaatgcgaagaacgaacgagagtgcagcgccagcggcaatgggaaggagcactttggctttggttctcgcgattctgatctctttgcagggaaccccccacgttagatccgatgcctccgatcatcgttacaaggacggagactccgttcctctttacgccaacaaagtcggtccctttcacaaccccagtgaaacgtatcggtactttgacctgccattctgtgtaacaggtcatgagaaagataagactgaagccctcggtgaggtgttaaatggcgatcgccttgttagtgctccttatgaacttagtttcaagaaggagaaagactctaaggttgtatgcaagaggaagctcacaaaggagcaagttgctcagttccgagaagcagttaagaaggactattatttccagatgtactatgatgacttgccgatctggggatttattgggacggttgacaaggaagggaaaactgaccctagtgagtacaagtattttctttacaagcacattcagttcgatattcattacaacaaagatcgagtcattgaaatcagtgcccggatggaccctcattctgtggtggacctgactgaggataaagatgtagatgttgagttcgtgtacactgcaaaatggaaggaaacagagactccttttgagaagagaatggataaatactcccagtcttcttctttgccacatcacttggagattcactggttctcaatcataaattcctgtgtaacagttcttcttttgactggttttctggcaaccattctcatgcgtgtattgaagaatgactttatgaagtatgctcaagatgaggaagctgctgatgatcaagaggagacaggatggaagtacattcatggggatgttttccggtttccaaagttcaagtctttcttttcagcagcccttggttctggtactcaattattcacacttacaatcttcatttttatgcttgcactggttggtgtgttttatccatataaccgaggcgctttatttactgcactggtggtcatatatgctctcacatctggcatcgctggctacactgctacttccttctatattcaacttgaagggactaattgggttaggaacttattgctgacaggatgcctcttttgtggccccctattccttatgttctgtttccttaacacagttgcgattgcttatagtgcaactgctgccctgccatttggcacaattgtggtgattgtcctaatatggacattggtaacttcaccattgcttgtgttgggtggtattgctggtaaaaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgccagtgtatggggccacagaatttatacgatctacagcatactcttcattgtcttcattattctgttgattgtcactgctttcatcactgtggctttgacatacttccaacttgctgctgaggatcatgaatggtggtggaggtctttcctttgtggtggatcaactggcttgttcatctacggctattgcttgtattactactatgcacgatcagatatgtctggttttatgcaaacttcgttcttctttggttacatggcctgtatctgctatggcttcttcctcatgctcggtagcgtaggattccgtgcctccctgctctttgttcgtcacatataccggtccatcaagtgtgagtagctggggtttgaaggtgttggtaaagttcatattatttctgttaggagaagagaaaagggtctgttattatttttttcttttgctgtcataaggtaggttatatagtgtgtacctggaaactagagaagcttagactctattcatgaattggtgtcatgctatctctataactgcacaggcttgcacttgaggaagtttttggaaccatgggatttaactttgattactgtagtcactgaaatttatttgaagtagcttgtactaattaattgtcttctctgc

SEQ ID NO: 2305 - DNA, 2329 bp, Citrus sinensis
ggggaataatgaatcagcccacgagttttaaatttccatcacgaaatctgaaattcgcattgtacaattgcgaaccaaacgcagcctaagcagctcgattttctatctataatcgcattttctatttgctctttctgccttaacaaacactcttgacatacatcttaacaaacacttttgtttcttaataatcactcttactcagatctttgagtcattttatttataaatccatgtgcgattgaaaattgcactcctcgttctccttcctcaggaaaataaaagaaaaaattccaaaaacaatgagcgattcctcttttcgaattcttattatcggggttttgatcgcctgtagcttgacccatgtgagatctgacgcctctgatcaccgctacaaggtcggtgacgtcgtccctctctacgccaacaaggttggccctttccacaaccctagtgaaacttatcgatattttgatctaccattctgctccccagatggaataataaaagagaaaagggaagcacttggtgaggtgttgaatggggaccgacttgttagtgctccttataaactcaacttcagagacgagaaagactctgctgttgcgtgtagaaagaagttgtccgagcaagatgttgctcagttccgaagtgcagtggaaaaggacttctatttccaaatgtactatgatgacttacccatctgggggttcattggcaaagttgacaaggaaggaaagactcatccgagcgagtataagtatttcctttacaagcatatccagtttgacattctttataacaaagaccgtgttattgagatcagtgctcgaatggatcctcattctttggtggacttgacagaggataaggaggttgatgtggagttcatgtacagtgtgaaatggaaggaaactgacaccccttttgagaagaggatggagaagtactcactctcttcttcgttgccacatcatttggaaattcattggttttcaattataaattcttgtgtgacggttttgcttttgactggttttcttgccacgattctcatgcgagttctgaagaatgattttgtgaagtatgcccaagatgaggaagctgctgatgaccaggaagagacaggatggaagtacatccatggtgatgtgttccggttccccaaatacaaatctctgtttgctgcagcccttggttctggcagccagttgtttactctcactgtatttatttttatgcttgcgctagtgggtgtattttatccatacaaccgaggagctctatttacggcactggtggtcatatatgcactcacttctgggattgcgggatatacagctgcctctttctactgtcagctagaaggaacaaactgggtgaggaatctgttgctgactggatgccttttctgtggtcctctgtttctgacattctgcttcctgaacaccgttgccattgcttacaatgcgacagcagcactgccatttggcacaattgtggtgatagtcctcatatggacattagtcacatcacctctacttgtgttgggaggtattgctggtaaaaacagcaaggcagagttccaagctccttgtcgtacgactaagtaccctcgagagatcccaccactaccttggtataggagtgctattcctcagatggcaatggcaggtttcctgccatttagtgccatctacattgagctttactatatttttgccagtgtttggggccacaggatttacacaatatacagcatcctctttattgtctttatcattctgttgattgttactgctttcataactgtggctttgacttacttccaacttgctgctgaagatcatgaatggtggtggaggtcttttctttgtggtggatctactggtgttttcatctatgcctactgcttgtactactactatgcacgatcagatatgtcaggttttatgcagacctcatttttctttgggtacatggcttgcgtctgttatggcttcttccttatgctgggcacagtgggtttccgtgcttcactgctctttgttcgacatatatacaggtcaatcaagtgtgagtaagggcttgttctttttgattctaatgtgatgcaatttctttaatttttcacagggtttaggagttatcttgttgctagtttgttcatgtttttattaggggaccttgttgttttttttccctcttatttgctgtttagagctatacttgtaacttgcctataaataggccccctgtttttatttgatgtaagtagacttgatatttacaaagagatatgttgttctttttacttcctatccctccc

SEQ ID NO: 2306 - DNA, 2303 bp, Citrus clementina
aataatgaatcagcccacgagttttaaatttccatcacgaaatctgaaattcgcattgtacaattgcgaaccaaacgcagcctaagcagctcgattttctatctataatcgcattttctatttgctctttctgccttaacaaacactcttgacatacatcttaacaaacacttttgtttcttaataatcactcttactcagatctttgagtcattttatttataaatccatgtgcgattgaaaattgcactcctcgttctccttcctcaggaaaataaaagaaaaaattccaaaaacaatgagcgattcctcttttcgaattcttattatcggggttttgatcgcctgtagcttgacccatgtgagatctgacgcctctgatcaccgctacaaggtcggtgacgtcgtccctctctacgccaacaaggttggccctttccacaaccctagtgaaacttatcgatattttgatctaccattctgctccccagatggaataataaaagagaaaagggaagcacttggtgaggtgttgaatggggaccgacttgttagtgctccttataaactcaacttcagagacgagaaagactctgctgttgcgtgtagaaagaagttgtccgagcaagatgttgctcagttccgaagtgcagtggaaaaggacttctatttccaaatgtactatgatgacttacccatctgggggttcattggcaaagttgacaaggaaggaaagactcatccgaacgagtataagtatttcctttacaagcatatccagtttgacattctttataacaaagaccgtgttattgagatcagtgctcgaatggatcctcattctttggtggacttgacagaggataaggaggttgatgtggagttcatgtacagtgtgaaatggaaggaaactgacaccccttttgagaagaggatggagaagtactcactctcttcttcgttgccacatcatttggaaattcattggttttcaattataaattcatgtgtaacggttttgcttttgactggttttcttgccacgattctcatgcgagttctgaagaatgattttgtgaagtatgcccaagatgaggaagctgctgatgaccaggaagagacaggatggaagtacatccatggtgatgtgttccggttccccaaatacaaatctttgtttgctgcagcccttggttctggcagccagttgtttactctcactgtatttatttttatgctagcgctagtgggtgtattttatccatacaaccgaggagctctatttacagcactggtggtcatatatgcactcacttctgggattgcgggatacacagctgcttctttctactgtcagctagaaggaacaaactgggtgaggaatctgttgctgactggatgccttttctgtggtcctctgtttctgacattctgcttcctgaacactgttgccattgcttacaatgcgacagcagcactgccatttggcacaattgtggtgatagtcctcatatggacattagtcacatcacctctacttgtgttgggaggtattgctggtaaaaacagcaaggcagagttccaagctccttgtcgtacgaccaagtaccctcgagagatcccaccactaccttggtataggagtgctattcctcagatggcaatggcaggtttcctgccatttagtgccatctacattgagctttactatatttttgccagtgtttggggccacaggatttacacaatatacagcatcctctttattgtctttatcattctgttgattgttactgctttcataactgtggctttgacttacttccaacttgctgctgaagatcatgaatggtggtggaggtcatttctttgtggtggatctactggtgctttcatctatgcgtactgcttgtactactactatgcacgatcagatatgtcaggttttatgcagacctcatttttctttgggtacatggcttgcatctgttatggcttcttccttatgctgggcacagtgggtttccgtgcttcactgctctttgttcgacatatatacaggtcaatcaagtgtgagtaagggcttgttcttttcggtccattaatagtgctcacagggtttaggagttatcttgttgctagtttgttcatgtttttattaggggaccttgtgttttttttccctcttattttctgtttagagctatacttgtaacttgcctataaataggccctctgtttttatttgatgtagtagacttgatatttacaaagagatatgttgttctttttacttcctatcc

SEQ ID NO: 2307 - DNA, 2181 bp, Glycine max
atactgaataaatttcttgcttattgtccttgtctgtttctttttctttatccatctgatctgaatgcgaagaacgaacgagagtgcagcggcaatgggtagaagcactttggctttggttctcgcgattctgatctcttttcagggaacccacgttagatccgatgcctccgatcaccgttacaaggatggagactccgtccctctttacgccaacaaagttggtccctttcacaaccccagtgaaacgtatcggtactttgacctgccattctgtgtaacaggtcatgagaaagaaaagactgaagccctcggtgaggtgttgaatggcgatcgccttgttagtgctccttacgaacttagtttcaagaaggagaaagactctaaggttgtatgcaagagaaagctcacaaaggagcaagttgctcagttccgagaagcagttaagaaggactattatttccagatgtattatgatgatttgccgatctggggatttattgggacgattgacaaggaagggaaaactgaccctagtgagtacaagtattttctttacaagcacattcagtttgatattctgtacaacaaagatcgtgtgattgaaatcagtgcccgaatggatcctcattctgtggtggacctgactgaggataaagatgttgatgttgagttcatgtacactgcaaaatggaaggaaacagatacatcttttgagaagagaatggataaatactctcagtcttcttctttgccacatcacttggagattcactggttctcaatcataaactcctgtgtaacagttcttcttttgactggttttctggcaaccattctcatgcgtgtattgaagaatgactttatgaagtatgctcaagatgaggaagctgctgatgatcaagaggagacaggatggaaatacattcatggtgatgttttccggtttccaaagcacaagtctttcttttcagcagcccttggttctggtactcagttattcacacttacaatcttcatttttatgcttgcactggttggtgtgttttatccatataaccgaggtgctttatttactgcactggtggtcatatatgctctcacatctggcattgctggctacactgctacttccttctatattcaacttgaagggactaattgggttaggaacttattgctgacaggatgcctcttttgtggccccctattccttatgttctgtttccttaacaccgttgccattgcttatagtgcaactgctgccctgccatttggcacaattgtggtgatagtcctaatatggacattggtaacttcaccattgcttgtgttgggtggtattgcaggtaagaatagcaaaactgagttccaagcacctgtccgcactacaaaatatccccgagagattccacctctgccttggtacaggagtaccattccccagatggcaatggcaggatttcttccttttagtgccatctacatagagctgtactacatttttgctagtgtatggggccaccgaatttataccatctacagcatactcttcattgtcttcattattctgttgattgtcactgctttcatcactgtggctttgacgtacttccaacttgctgctgaggatcatgaatggtggtggaggtctttcctttgtggtggatcaactggcttgttcatctacggctattgcttgtattactactatgcacgatcagatatgtctggttttatgcaaacttcgttcttcttcggttacatggcctgcatctgctatggcttcttcctcatgcttggtagtgtaggtttccgtgcctctctgctctttgttcgtcacatatacaggtccatcaagtgcgagtagatgggagttgaacgtgttggtaaagttcatattatttctgttaggaaaagagaaaagggtctgttaattttttttcttttgctgtcataaggtaggatatatagtgtgtacctggaaactagagaagcttagactccattcatgaattggtgtcgtgctatctctataacagcacagggcttgcacttgaggaagtttttggaaccatgggatttaatctttgattactgtagtcactgaaatttatttgaagtagcttgtactaattaatttgtcttctctgaaaatggccatttaatatgattatactg

SEQ ID NO: 2308 - DNA, 2194 bp, Citrus clementina
aaagaagaaaaaaaaattactcagatctccggggcctcgcttaatagatatatatataacctgcacgacctccagctccctctaagaggcctgtgtctggttcattgtcacttgaaacttgcacttgtcttcacgttctcagaaaattagtcaaacaatgagcgattcccctatcacacttcttgttgttggggttctgatcgcctgttgcttgacccatgtgagatctgattcttccgatcaccgcttcaaggtcggtgaccctgtccctctatacgccaataaggttggccctttccacaaccccagtgaaacttatcgatattttgatctaccattctgctccccagatgcaataataaaagagaaaagggaagcacttggtgaggtgttgaatggggaccgacttgttagtgctccttataaactcaacttcagagacgagaaggactctgctcttgcgtgtagaaagaagttgtccgagcaagatgttgctcagttccgaagtgcagtggaaaaagacttctatttccaaatgtactatgatgacttacccatctgggggttcattggtaaagttgacaaggaaggaaagactcatccgagcgagtataagtatttcctttacaagcatatccagtttgacattctttataacaaagaccgtgttattgagatcagtgctcgaatggatcctcattctttggtggacttgacagaggataaggaggttgatgtggagttcatgtacagtgtgaaatggaaggaaactgacaccccttttgagaagaggatggagaagtactcactctcttcttcgttgccacatcatttggaaattcattggttttcaattataaattcttgtgtgacggttttgcttttgactggttttcttgccacgattctcatgcgagttctgaagaatgattttgtgaagtatgcccaagatgaggaagctgctgatgaccaggaagagacaggatggaagtacatccatggtgatgtgttccggttccccaaatacaaatctctgtttgctgcagcccttggttctggcagccagttgtttactctcactgtatttatttttatgcttgcgctagtgggtgtattttatccatacaaccgaggagctctatttacggcactggtggtcatatatgcactcacttctgggattgcgggatatacagctgcctctttctactgtcagctagaaggaacaaactgggtgaggaatctgttgctgactggatgccttttctgtggtcctctgtttctgacattctgcttcctgaacaccgttgccattgcttacaatgcgacagcagcactgccatttggcacaattgtggtgatagtcctcatatggacattagtcacatcacctctacttgtgttgggaggtattgctggtaaaaacagcaaggcagagttccaagctccttgtcgtacgactaagtaccctcgagagatcccaccactaccttggtataggagtgctattccacagatggcaatggcaggtttcctgccatttagtgccatctacattgagctttactatatttttgccagtgtttggggccacaggatttacacaatatacagcatcctctttattgtctttatcattctgttgattgttactgctttcataactgtggctttgacttacttccaacttgctgctgaagatcatgaatggtggtggaggtcttttctttgtggtggatctactggtgttttcatctatgcctactgcctgtactactactatgcacgatcagatatgtcaggttttatgcagacctcatttttctttgggtacatggcttgcgtctgttatggcttcttccttatgctgggcacagtgggtttccgtgcttcactgctctttgttcgacatatatacaagtcaatcaagtgtgagtaagggtttgttcaaatattttgattctaatgtgatgcaatttctttaatttttcacagggtttaggagttatcttgttgctagtttgttcatgtttttattaagggaccttgttttttcccccctcttatttgctgttttgggctatacttgtaacttgcttataaataggccccctgtttttatttgatgtagaaggcttgatatttacgaagagatatgttgttctttttacttcctatccctccctcaattttc

SEQ ID NO: 2309 - DNA, 2193 bp, Trigonella foenum-graecum
atttgtctctttatttcttgaattgattctttcttcttattattatctatctgattgagaagaagagagaaagatacgaaatgggaaggagtgtcgtgtggatccacctgctgctactgatctctcttctcgctgctactcacgtcagatccgatgcctccaatcaccgttacagcgacggcgatcccgttcctctttacgccaataaagtcggtccctttcacaaccccagtgaaacctatcgataccttgacctaccattctgtgtaacaggtcatgagaaagaaaaaactgaagcgcttggcgaggtgttgaatggagaccgccttgttagtgctccttatgaacttaagtttaggaaggagaaagactctaaggttgtgtgcaagaagactctcacaagggagcaagttaatcagttccgtgaggcagttaaaaaggactattatttccaaatgtattatgatgacttgccaatctggggatttattggaactgttgacaaagaaggaaaaactgaccctagcgagtataagtattttctttacaagcacattcagtttgatgttctgtacaacaaagaccgtgtcattgaaatcagtgcccgtatggatcctcattctgttgtggacctcactgatgacaaagaagttgatgttgagtttatgtatactgtgaaatggaaggaaactgatattccttttgagaagagaatggaaaaatactctcagtcttcttctcttccacatcacttggagattcactggttttctatcataaactcctgtgtaacagttcttcttttgactggtttcctggcaaccattctcatgcgtgtcttgaagaatgattttatgaaatatgctcaagacgaggaagctgctgatgatcaagaggagacaggatggaaatacatccatggtgatgttttccggtttcctaagtacaagtccatatttgcagcagcccttggttctggcactcagttattcactctcacgatcttcatttttatgcttgcactggtcggtgtattctacccctacaaccgaggagctttatttactgcactcgtggtcatatatgctctcacatctggcattgctggatatattgctacttccttctatattcaacttgaagggactaattgggttagaaacttattgctgacaggatgcctcttttgtggccctcttttccttatgttctgcttccttaacacagttgcaattgcatatagtgcaactgctgcccttccgtttggcacaatttgtgtgatagtcctaatatggacgctggtgacttcgccattacttgtgttgggtggcattgctggtaaaaatagcaaaacagagttccaagcacctgtccgcactacaaaatatccccgagaaattccacctctgccttggtacaggagcaccattccccagatggcaatggcaggatttctccctttcagtgccatctacatagagctgtactacatttttgctagtgtctggggccacaggatttataccatctacagcatactcttcatcgtctttattattctgttgattgtcactgctttcatcaccgtggctttgacatactttcaacttgctgcggaagatcacgaatggtggtggaggtcctttctttgtggtggatcaactggcttattcatctatggctactgcttgtattattactatgcaagatcagatatgtctggttttatgcaaacttcgttcttcttcggttacatggcctgcatctgctatggcttctttctcatgcttggtagcgtaggtttccgtgcctccttgctctttgtccgccacatatacaggtccatcaagtgtgagtagttgtggttgaacgttttggtaagtttatattatttctgttaggtaatgagaaaaggtctatgaatttctttttctttctgtcataaggtaggttatatagtgtaccagataacaagagaaactctgtctcctctgaattagtgtcacggtatatctctgttttttaatttgcacaggcttgacacttgaggaagatttttgaaccatgggtttaaatgttttattactgtagttactgaaatttatttgaagtagattgtactaattaatatttctgtctttttatgatgactatgtatgattaatttgcctttcaatataatcttatggtttc

SEQ ID NO: 2310 - DNA, 2308 bp, Cajanus cajan
gtagtgaataaattgctttgcttgttgtctgtgtttgttatctgatctgatcgtgaggaaagaaagtgcagcaatgggaagaagaagaagcacgttggctttggttctcgcgattctgatctctcttcacggaacccacgtcagatccgatgcctccgatcaccgttacaaagaaggagaccccgttccgttctacgccaacaaagttggcccctttcacaaccccagtgaaacgtaccggttctttgacctcccattctgtgtaacaggtcatgagagagaaaagactgaagcccttggtgaggtgttgaatggcgatcgccttgttagtgctccttatgagcttaatttcaggacggagaaagactctaatcttgtatgtaagaggaagctcacaaaggagcaagttgctcagttccgagaagctgttaagaaggactattatttccaaatgtattatgatgacttgccaatctggggatttattgggactgttgacaaggagggcaaaactgaccctagtgagtacaagtattttctttacaagcacattcagttcgatattctgtacaacaaagatcgagtgattgaaatcagtgcgcggatggatcctcattctgtggtggacctgactgaggataaagatgttgatgttgagtttttgtacactgcaaaatggaaggaaacagatactccttttgagaagagaatggagaagtactctcagtcttcttctttgccacatcatttggagattcactggttctcaatcataaactcctgtgtaacagttcttcttttgactggtttcctggcaaccattctcatgcgtgtattgaagaatgactttatgaaatatgctcaagatgaggaagctgctgatgatcaagaggagacaggatggaagtacattcatggtgatgttttccggtttccaaaatacaagtctttgtttgcagcatcccttggttctggtactcagttattcactcttacaatcttcatttttatgcttgcgctggttggtgtattttatccatacaaccgaggagctttatttactgcactggtggtcatatatgctctcacatctggcatcgctggctacactgctacttccttctatattcaacttgaagggtctaattgggttagaaacttactactgacaggatgcctcttttgtggtcctcttttccttatgttttgcttccttaacacagttgcaattgtttatagtgcaactgctgctctgccatttggcacaattttggtgatactcctaatatggacattggtaacttcaccattgcttgtgttgggcggtattgcaggtaaaaatagcaaagctgagttccaagcacctgtccgcactacaaaatatccacgagagattccacctctaccctggtacaggagtaccattccccagatggcaatggcaggatttctcccatttagtgccatctacatagagctgtactacatttttgctagtgtatggggtcacagaatttatactatctacagcatactcttcattgtctttattattctgttgattgtcactgctttcatcactgtggctttgacatactttcaacttgccgcggaggatcatgaatggtggtggaggtcttttctctgtggtggatcaactggtttgttcatctatggctactgcttgtattactactacgcacgatcagatatgtctggtttcatgcaaacttcgttcttctttggttacatgttatgcatctgctatggcttctttctcatgcttggtagcgtaggtttccgtgcctccctgctctttgttcgtcacatatacaggtccatcaagtgtgagtagaaggtggctgaacgtgttggtaaagtttatattatttctgttaggtgaagagaaaagggtctactattttttttttcttctttttctgtcataaggtaggttatatagtgtacctgggaactagagaagcttagactcctttcatgaattggtgtcatgctatctctttaactgcacaggcttgcacttgagggagttttttggaaccatgggatttaatctttgattactgtagtcactgaaatttatttgatgtagcttgtattaaatttaatttgtctgctctgaaaatgaccatttaatatgattatactgacctcgccaatggtttataatggtgtgggaatttattctaatcgccaaatacatgtctagctatgccagatgaaagatggtttgaacaagaacatggttttcaacactttacaaatataaaattaaaagtggcataaa

SEQ ID NO: 2311 - DNA, 1979 bp, Brassica napus
gctgcggaattaataaagcgcaaactcagatctcactgatttgaagagaaaaaacgcaatgaagatgctgctcctcttactcggagctctagtcctctccagcgtcggctatgtcagatccgacgcctccgaccaccgctacaaggaaggagacatcgttcctttatacgccaacaaggtcggcccattccacaatccaagtgagacgtatcgttactttgatcttcccttctgtgttccagagggtgtgaaagagaagaaggaagcctttggagaggttctgaacggcgatcgtctcgttagcgctccatacaagctcaacttcagagacgaaaaggactccgaagtctactgcaagaagaagctgagcaaagaagaggtcaaaaagttccggcaagccgttgagaaagactactacttccagatgtactacgacgatctccccatctgggggttcattggcaaagtcgacaaggagatcaaatctgatccgagcgagtacaagtacttcctctacaagcacatcgagtttgagattctgtacaacaatgaccgtgtgattgagatcagtgctaggatggatccacactcgcttgttgatcttactgaggataaagaagtggatgctgagtttatgtatacggtgaagtggaaggagacggagactccgtttgagaagaggatggacaagtactccatgtcttcttctcttccgcatcacttggagattcactggttctctattattaactcgtgtgtcactgtgctgcttttgactgggttccttgctaccatcttgatgcgtgtcctcaagaatgatttcaccaagtatgctcaagacgaggaagctgctgatgatctggaggaaactgggtggaagtacattcatggcgatgtgtttaggttcccaacgcacaattctttgtttgctgcatcacttggtagtggtactcaactgtttaccctgaccatattcattttcatgcttgctcttgttggagtgttctacccgtacaaccgaggagcactctttaccgctttggtggtcatttacgctctaacctctggaattgctggatacacatccgcctctttctactgccaacttgaaggcaaaagctgggtgagaaacttgttactcaccggatgtctcttctgtggtcctttactcctaaccttctgcttcctcaacaccgtagccatcacctacacagcaaccgcagcactaccctttggaaccatcgttgttatcgtccttatatggacactagtcacgtcgcctctactcgtcttaggtggcatcgccggtaaaaacagcaaagctgagttccaagcgccctgccgtacgaccaagtacccccgcgagatcccgccgctcccttggtacagaagcgctgttcctcagatggccatggctggtttccttcctttcagtgccatctacatcgagctttactacattttcgctagtgtctggggtcaccggatctacaccatctacagcatcctattcatcgtcttcatcatcctcatcatcgtcactgcgttcataaccgtcgctttgacttacttccagctcgctgctgaagatcaccaatggtggtggagatcattcctatgcggtgggtcgaccggtttgtttatctacgcctactgcttatactattactacgctcgatcagacatgtctggattcatgcaaacatcgttcttcttcggatacatggcttgcatttgctacgggttcttcttaatgctcgggactgtcggctttcgcgctgcacttttcttcgttcgtcacatttaccggtcgatcaaatgcgagtaagaagtattttatcttcttacgtctggttctcttcttcttcttcttcggcctccttatgaatttttggtagaacaatgaaagataaagagataggttgttagaaagaagagagacacaatgacaatgtcaatgtctgattgtttcctgaaaa

SEQ ID NO: 2312 - DNA, 2390 bp, Mimulus guttatus
attaaatgagatcgagatctgtgctactttctctctctaaaattcctctcctctttctaaaactgtaatatttcaggtccactgaattataaacccatttcactctgcgactctttacggtgttttgtgaaccaaaaatggcgagaggaggagagtggcgcgccgtcgttttgctgctcctttgcactgcttttccggcggcgagatccgacggatcagatcacaagtacaaagtcggcgatccggtgccgctgtatgcaaacaaggtcggcccttttcacaaccctagcgaaacataccgttactttgatctcccattttgttctccaggtgatgttaaagataaaagtgaagctcttggtgaagtgctaaatggagatcgtttggtcagtgctccatacaagcttgactttctggctgacagagagtcagaagtcatttgtaaaaagcagctgtcaaaggaagaagttgctgtgtttcgaagtgcggtagcaaaagactactattttcaaatgtactatgatgacttgcccatatggggtttcctcggaaaggttgacaaggaaggcaaagctgatcccagcgagtacaaatattacctatttaagcatctccatttcgaaatattttataacaaggatcgtgtgattgagatcaatgcacgcacagaccccagtgctcttgtagaccttactgaagataaggaagttgatgtggagttcgtgtactctgccaaatggaaagagactaatattgcttttgagaagaggatggagaagtactctcattcttcttcactacctcgccacttagagatccattggttttcaattatcaattcatgcgtgactgttctcctcctcactgggtttcttgctacgattttgatgcgtgtgctaaaaaatgattttgtcaaatatgcccatgacgaggaggcagcagatgaccaagaagaaactgggtggaaatacattcatggtgatgttttcaggttcccgaagtacaagtctttgtttgctgctgctcttggaagtggcactcagctatttaccctggcgacttttatattcttacttgctcttgttggtgtattttatccttacaaccgtggagctctttttactgcactggtggtcatatatgctcttacgtctggcattgcaggctatacagcggccgctttctattgccagttagaggggacaaattgggtccggaatttattactaactggaggcctgttctgtgggccactttttctcacattctgcttcctaaacactgttgccattgcttatcatgcaactgccgctctcccatttggtaccattgtggtgatttttctgatatgggctcttgtgacgtcacctttattagtgttgggagggattgcaggaaagaacagtaaggcagagtttcaagctcctgttcgtaccacaaaatatcctagagagattccgccgctcccttggtaccgttcaactgtgcctcagatggctatggccggcttcttgccattcagtgccatctatattgaactttactacatatttgccagtgtctggggtcacaggatttacaccatttacagtattttattcattgtcttcattatcctcctgattgtcactgcatttattactgtggcgttgacatacttccaacttgctgctgaagatcatgaatggtggtggaggtctttcctttgtggtggatcaacgggcttgttcatttacggctactgtctgtattactactatgcacggtcggatatgtcgggctttatgcagacctcattcttctttgggtacatggcttctgtgtgctatgctttcttcctaatgctcggagctgtaggtttccgtgcctctttattctttgttcgccacatataccgctcgataaagtgcgaatgagaaatgggatttgacagaagaagaatattgttgatttgtgagaatggcggtgtatcgtacgataggtaaagtggcatgacaaaggtattgaaaatggcagtattctgtaggaaaatctccactgtggaagcatttctgagcaaaagaagtagtttactgtctaaacttatatcaaataatagtgtatggttttcgttatttgctatagtttcaatttttcttttttttctaaaagattttgtatgaaaagatatgaaagaggttaacaaatttgatcagtgcattccggcgggtgttgcgtatttccagtggcgtatttgagtagaaaatgccgcttttggtaaattacggccaccctgaggtaacgtcaaattaccaaaaaacccctcacgtttgagtaattacagtcaccctcttaactatgaatcttcttatacgtccacctttatcgtgttaaattcaatataacctttt

SEQ ID NO: 2313 - DNA, 2291 bp, Mimulus guttatus
cactctcccattaccgcgcgtggcatgattaacttcaaaattcatccatcttacagctaaatgagatcgagatctgtgctactctttctctctctaaaattcctctcctcgttttaaaactgtatttcacattataaacccattttcagtctgcgactcttactcgtttgtgacaaaaaaatggcgataggaggcgagtggcacgtcgtcgttttgctgctcctgtgcactgcttttcctgcggtaagatccgatgcatcagatcacaagttcaaagtcggagatccggtgccgctgtatgcaaacaaggtcggcccatttcataaccctagcgaaacataccgttactttgatctcccgttctgttctccaggtaatgtcaaagataaaagtgaagctcttggtgaagtgctaaatggagaccgtttggtcagtgctccatacaagcttgattttctggctgacaaagagtctgaagtcatctgcaaaaagcatctctcaaaggaagaagttgctgtgtttcgaagtgcggtagcaaaagactactattttcaaatgtactatgatgacttgcccatatggggtttcctcggaaaggttgacaaggaaggcaaagctgatcccagcgagtacaagtatcacctatttaagcatctccattttgaaatattttataataaagatcgtgtgattgagatcaatgcacgcacagaccccaatgctcttgtagatcttaccgacgataaggaagttgatgtggagttcgtgttctctgccaaatggaaggaaactaacattgaattcgataagaggatggagaagtactctcattcttcttctcttcctcgccacttagagatccattggttttcaattatcaattcgtgcgtgactgttctcctcctcactgggttccttgctacgattttgatgcgtgtgctaaaaaatgattttgtcaaatatgcccatgacgaggaggcagcagatgaccaagaagaaactgggtggaaatacattcatggtgatgttttcaggttcccaaagtacaagtctttgtttgctgctgccctcggaagtggcacacagctatttaccctgacgacttttatattcttacttgctcttgttggtgtattttatccttacaaccgtggagctctttttactgcgctggtggtcatatatgctcttacatctggcattgctgggtatactgcatcatctttctattgccagttagaaggaacaaattgggtcagaaatttattacttagtggaggtctgttctgtggtccgctttttctcacattctgcttcctaaacactgttgccattgcttaccatgcaactgccgctctcccgtttggtaccattgtggtgatttttctgatatgggctcttgtgacgtcacctttattagtgttgggaggtattgcaggaaagaatagtaaggcagagtttcaagctccagttcgtaccacaaaatatcctagagagattccaccgctaccttggtaccgttcaaccgtgcctcagatggctatggccggcttcttgccattcagcgcaatctatattgaactgtactacatatttgccagtgtctggggtcacaggatttacaccatttacagtattttattcattgtcttcattattctcctgatcgtcactgcgtttattactgtggcgttgacatacttccaacttgctgctgaagatcatgaatggtggtggaggtctttcctatgtggtggatctaccggcttgtttatctatagctactgcctttattactactatgcgcgatcggatatgtcaggcttcatgcaaacctcattcttctttgggtacatggcttgtgtatgctatgctttcttcctaatgctcggagctgttggtttccgtgctgctttattctttgtgcgccacatataccgctcgataaagtgcgaatgagaaatgagatttatccatattcctgccaaagtccaacagaagaagaatatgtagatcgcgggaaaaaggccgcgtgctatatgacgcaagtactgaaggaaaatgtctgttagggttttacgtattatgaaaggcatttatgagtaaaatgtagtttatttgtcgaaacttatatatcgaacggtagtgtagggtttttgactattcactatagtaggttgttcatcttttgaaaagattttgtataacaagacattaaagaggtgaaatattgttggcacttgcttcagttaacaaacatctctgtttattttgatcagtgcatttcattt

SEQ ID NO: 2314 - DNA, 5022 bp, Ricinus communis
caccagccctctcagtctcatcggtttcatttccaaaggaaaaaaataaaacgagaagaaaaaagaacaccatgagctataatccattaaccattctcattctcttactttcaatctcaagttctttactccacgttagatcagatacctccgatcaccgctacaaagaaggtgaccctgttcctttctacgccaacaaagttggtccctttcataatcccagtgaaacatatcgctattttgatctacccttttgtgttccagatcatctgaaagagaaaaaagaagctcttggtgaggttttgaatggagaccgtttagttagtgctccatatacacttaactttagagatgataaagtatcagcacccgtttgtcagaagaaactttcgaaggaggatgttgcacaatttagatctgcaattgctaaagattattacttccagatgtattacgatgatctaccaatttggggtttcattggaaaagttgttaaagatggtaaggatgaccccagtgagtataaatacttcctttaccaacatgtccaattcgatgttctttataataaggatcgcgtgattgaagtgggtgtccgaatggatcctaattcaatgttggatctgacggaggacaaggaagtcgatgtggagtttctttatactgtgaagtggaaggaaacagataatacttttgagaatagaatgaagaaatactcattgtcttcttcactgccacatcacttggaaatccattggttttctattataaactcatgtgtgacagtgctccttttaactggttttcttgccacaattctcatgcgtgtcttaaagaatgattttgtgaaatatgcacaagatgaggaagaagctgatgatcaggaagagactggatggaagtacattcatggcgatgtatttaggtatcctaaatacaaatctttgtttgctgcagcccttggttctggcacccagctgttcacgctgactctatttatttttattcttgcactggttggtgtattttatccatacaaccgaggagctctatttactgcactggtggtcatatatgcacttacatctgggattgctgggtatactgcaacttctttctactgccagctggaaggaaataactgggtgaggaatcttttgctgacaggatgccttttctgtgggcctctattcctcacattctgcttccttaacactgtagccattgtttatagtgcaactgcagcattgccttttggcactattgtggtcatagtccttatatggacactagtaacttctccgttgcttattttgggtggtattgctggaaaaaatagcaaggctgagtttcaagctccttgccgtaccacaaaatatcctcgagagattccacaattgccttggtacaggagtgctcttcctcagatggcaatggcaggttttcttccttttagtgccatctacatcgagctttactacatttttgccagcgtttggggtcacaggatctataccatttacagcatcttgtttattgtcttcattattcttgtgattgtcactgccttcataaccgtggctttgacctacttccaacttgctgctgaagatcatgaatggtggtggaggtcttttctctgtgggggatcaactgggctgttcatctatgcctactgcttgtattattaccatgctcgatctgaaatgtctggcttcatgcaaacatctttcttctttgggtacatggcctgtatatgctacggcttctttctaatgcttggaacagtgggtttccgtgcatcgctgttctttgttcgccacatatacaagtcgattaaatgcgagtagcggggcagtacttcctcttcagtttacatgcattctgtcaaagagaaatgtacgattttgttaagagctgagggccgagactgcttaattactagaaacaaaagatgcgaactttgagagaccttagcaatgcctgacctgagctactaagtttacagaaaccctggggcatattgacctgaagtacctgacatgtagaagattgaaatgctttgttttgtattattacgtataccctcttttttcttttttagtttgtagaagcaacatctcccctcattctatgtactttcagaatcaactttatagaatcaaatctatgtgtcaggttttacctattgttgtaagaaacaaattcattttgttagaacccttatttccacattgaagtcaaaaggtggatttgttgttggtaaaggctgatcattattatcaaaagtaggttgcaaataggaatcttctttctatttttatatttaactggttttcattgactaaggcaatgtaacgtcagaatcagatagaatttctacttctacacttggagaaggaggaggataggattaatctattgttgacatttgcagatggatcagacatttactaaattcaaaccctttctattatcctgattttagttatagtttttgcgaatttaaaaattaaattaatacccaaaaaagtttctatttgtaagtagcattaagaaaaaacgaaaggaaagttgcaactatttccttttatctttcttccatttgtcttcacattctgttgccgtttgttttatatcttttttctctttcgttaatccaatcattattacatacaataaaaacaaattccttgtttgctcagaaaactatatcaatctttctttgtttctcatccaattttcgcttcagaagtaaaaaacaccagagaaagaaaatgaatgataataatccttttataattctggttgtgtcagttttaataatcgcatgttctgtcactcacgtgagatcagatgcctccgatcatcgctataaagacggcgatcctgttcctctctacgccaacaaagtgggccccttccacaatcccagtgaaacatatcgctattttgatctcccattttgcgttccagatcacctgaaagagaaaacagaagcactcggtgaggttttaaatggagaccgtttagtaagtgctccttacaagctcaattttcgagatgagaaggacacggcggttgtctgtcggaaaaaacttacaaaggaggaggttggtcgatttcgatctgcagttgacaaagattattacttccaaatgtactatgacgacctgcctgtttggggcttcattggcaagattgataagcaagataataagtacttcctttacaagcacattcaattcgatgttctctataataaggaccgtgtgattgaagtgaatactaggatggatcctcagtcattgttggatttgactgaggacaaaaatgttgatgcggagtttctttatactgtaaaatggaaggaaacagatattcctttcgagaagagaatggataagtattctttctcttcttcacttcctcatcacttggaaattcattggttctctattattaactcttgtgtcacagttctccttttgactggctttcttgccacaattctcatgcgggtattgaagaatgacttcatgaagtatgcacaagatgaggaagcagctgatgaccaggaggagactggatggaagtacatccatggtgatgtttttagatacccaaagtacaaatctttatttgctgctgcccttggatctggaacccagttatttgcactaactgtttttatttttatgcttgccctggtcggtgtattttatccatacaatcgaggtgctctatttactgcgctggtggtcatatatgcacttacttctggaattgctggatatactgcaacctctttctattatcagcttgaaggaacgaactgggtgaggaatcttttgctgacaggatgccttttctgtggacctctgttcctcacgttttgcttcctgaacactgttgccattatttacagtgcaactgcagcattaccatttggaactattttggtgatactccttatatggactttagtgacttctccattacttgtattgggtggtattgctgggaaaaacagcaaggctgaatttcaagcaccttgtcgtaccacaaaatatcctcgagaggtcccacagttgccatggtacaggagtgctcttcctcagatgggaatggcgggtttcttgccttttagtgctatctatattgagctctactacatatttgccagtgtctggggccacagaatctacaccatttacagcatcttgttcattgtcttcattattcttctgattgttacagcttttataactgtggctttgacatacttccaacttgctgctgaagaccacgaatggtggtggagatcttttctctgtggtggatcaactgggctattcatctatgcttactgcttgtattactactatgcacgatccgacatgtctggcttcatgcaaacctctttcttcttcgggtacatggcttgcatatgctatggattcttcctcatgcttgggacagtgggtttccgtgcttccctgctctttgttcgtcacatatacaggtcgattaagtgtgagtagttttctggctcttcctcttatctttcattattctgtcggaggaagatctatgatttttgttaaagagttagacgagagattgcattggctacaagaagaggctttagcccttccttccctgacgaggtctactcagatctcggtcacatatcggcgtaggttttagatatcttaacaaaaccatgaggtttatcaacaatttttgctatatgtaattagcatacatacaaattccagtgcggatgttgtgttgcatcttactttggtttcgtagaagcagcttttctctcttcctacatcttctttgagaatgaaatatttcagatcacttaatactgtaaaagtaaaattattttggattcctgtcaaatttcgtcgtaactaactcaaaagatatatctgctgtaaatgcatacatgttttcatagcaaaaacagctttaaaacgaaaaaaaactttgttcaagagttgataatca

SEQ ID NO: 2315 - DNA, 2341 bp, Orobanche aegyptiaca
tatacagagcattactgaattgtaaaccccatttgctctcaccttactttttttttttaaaaaaacaaatgactacacgaggagggtggcatgtcgtcgttctgttggttttgtgcatcgcaattcgcgctgtaagatctgatggatctgatcacaagtataaagtgggagatgctgtgccgctgtatgcaaacaaggttgggccatttcataaccctagtgaaacataccgttactttgatctccccttctgttctccagggaatgtaaaagataaaagtgaagctcttggtgaagtgctaaatggagaccgtttggtcagtgctccatacaagcttgactttttggtcgacaaagagtctgaagtcatttgtaagaagcagctttcaaagaaagaaattgctgaattccgaagtgcggtcgcaaaggactactattttcaaatgtactatgatgacttacccatatggggtttcttggggaaggttgacaaggaaggcaaagctgatcctagcgagtacaaatattacctatttaagcatctacattttgaaatattttataacaaggatcgtgtgattgagattaatgcacgtactgaccccggtgctctggtggaccttactgatgataaggaagttgatgtggagtttatgtactctgccaaatggaaggaaactaacatagattttgagaagaggatggagaagtactctcattcttcttcacttcctcgacacttggagatccattggttttcaattatcaattcttgtgtgactgttctccttcttactggatttctcgccacaattttgatgcgagtactcaaaaatgattttgtcaagtatgctcatgatgaggagacagcagacgaccaagaagaaacagggtggaaatacattcatggtgatgttttcaggttcccaaaatacaagtctttgtttgctgctgcccttggaagtggcacacagctctttaccctggcgacttttatattcttactcgcgcttgttggtgtattttatccgtacaaccgaggtgctctttttactgctcttgtggtcatatacgcactcacatctggcattgcaggatatacagcggcgtctttctattgccagttagagggaacaaattgggtccgtaatttattattgactggagggctgttttgtgggccactgtttctcacattttgcttccttaatactgtcgccattgcttaccatgcgactgcagctcttccttttggtaccatcgtggttatttttctgatatgggctcttgtgacatcacctttattagtattgggaggaatagcagggaagaatagtaaggcagagtttcaagctccttgtcgtaccacaaagtatccgagagagattccaccactgccttggtatcgtggaacactgcctcagatggctatggctggatttttgccatttagtgccatctatattgaactttattatatatttgccagtgtctggggtcacaggatttacaccatttacagtattttattcatagtgttcatcatacttctgattgtcactgcatttattactgtggctttgacatactttcaacttgctgctgaagatcatgaatggtggtggagggctttcctttgtggtggatcaactggcttgtttatttatggttactgcctctattactactatgcacggtcggatatgtcaggcttcatgcagacctcatttttcttcgggtacatggcttgtgtgtgctatgctttcttccttatgctgggagctgtgggttttcgtgctgcattgttctttgtgcgccatatatatcgttcgataaagtgtgaatgagaaattacattatctgtaatttttccaggacagaacatatattgagtgattattttgatcgattcgatgaagtggcagacattaaaatatgacgtcattctggaggaaaatctccctggggttacttgtggaagtgagaacaaagtagttttttgtttataggacttataaatcttatatcaaacatataggtaagattttgcgatttgtgtacttccaagtttttgaatttttttttaattaagacttgaaagttgtaatatgtcgctgttcaatggcttgctccatttaacacctctctttattttgttagtgcgtttaggcaaagttggttttggagtggggggatagtgacaactgacaaatggggatagtgacaactgataaatctcggatcaaaattactgctcttggtttgtttcggaatatttaaggataaaattgatgcatgttatccttgattaatgtgaatatataaacatttaattatctta

SEQ ID NO: 2316 - DNA, 2289 bp, Euonymus alatus
cggccgggggatttttcctacgcatccaccacacaactttccacgttccctaagcccaccgtcaaattaacaaagaataatattttttaaatatatattttttcatagttatcgctatattattgataattatctttttcgctagtctttcgttctgtaaaacggtgaagcgagtgtgatccaaaacgcaaacgaaaaaacatggagaagaggataatggcgtgcatcgtcgcggccgtattgatcctctgcggagtatcccaggtgagatctgatgcatccgatcatcggttcaaagtcggcgacgatgtccctctctacgccaacaaggtcggccctttccacaatcctagtgaaacctaccgctattttgatctcccattctgctcatcagcccctgtcaaggaaaagaaagaggctcttggtgaagtgttgaatggagatcgattggttagtgcgccttacaagcttgactttctgaatgagaaagagtctgaagttgcttgcaagaggaggctgacaaaggaagaagttgttcagttccgacgtgctgtgtccaaggactactactttcaaatgtattatgatgacttgccaatatggggtttcttaggaaaggttgacaaggaaggcaaaagtgacccaagcgaatacaaatattacctttttaagcatcttatttttaatattttttacaataaggatcgagtcattgagattactgtgcaatctgatcaaaactctctagtggacattacagaagataaagaagttgaagtggagttcacctacacagttaagtggaaggaaacagaaatccccttcgagaagaggatggacaagtattcacagtcttcttcactgccacatcacttggaaatccattggttctccataattaattcatgtgtgacagttctccttttaactggttttcttgccactattctcatgcgagttcttaaaaatgatttctccaagtatgctcatgatgaggagtcagcagatgaccaagaggagactggatggaagtacattcatggtgatgtattcaggtatccgaagtacaagtctttgcttgctgcagcacttggttctggtacgcagttatttactctagcgattttcatttttatgcttgctttagttggcgtcttctatccttacaatcgaggggctctgttcactgcactggttgtgatatatgcgcttacatctggcattgctggctacacggctgcttctttctattgccagctagagggaacaaattgggtgaggaatctgttactgactggaagcctgttttgtgggcctctttttctcacattctgttttcttaataccgttgcaatagcttacagtgctactgcggcattgccttttggaacaattgtggtgattttccttatacttactctggtcactacaccattattagtactgggtggcattgctgggaaaaatagcaaggctgagtttcaggcaccctgtcgcacgactaagtatcccagagagattcctccattgccttggtatcgaaagtctcttcctcagatggcaatgtcagggttcttgcctttcagtgctatctatattgaactttactacatatttgctagcgtgtggggtcacaggatttataccatatacagcatcctctttattgtcttcattattctcttgattgtcactgcttttatcactgtggcattgacatactttcaacttgctgctgaagaccatgattggtggtggaggtcattcttgtgtggaggatcaactggcttgttcatttatggctactgcttgtattactactatgcacgatctgacatgtcaggcttcatgcaaacctcatttttctttggatacatggcttgcatctgctatggtttcttactaatgcttgggacagtcggtttccgtgcttctttattctttgtccgtcatatctaccgctctatcaagtgcgagtagcaagtcacctgctcttccctatgttccatggtccggggttgtttgggtccatgcttctggacttgagactcttgaggttttaggatgttgcttcaaggaagaggagttgcatagtagacgatatatctacattgcttcaatggaattgttcatgttggggtttaaggatgccatgtgacatttttctttttatttggtagtaattttttgttgggacaatatgtagacagtagtaagctgcattgggaaaagaagacttgtctaatatttacacgttatgacatcctatataacatgcctctcacaatt

SEQ ID NO: 2317 - DNA, 2342 bp, Quercus alba
agttctctcttatcatcgaaacccacaaaagagagagaaagaaaagaaaagaaaaaagaagaagcatgaagaaaacgattgttatcgtagcggctttagtaataatcagctgttatggaataaccgaggtgagatccgacgcttccgatcaccgatacaaagaaggtgacccagttcctctctacgccaacaaggttggcccctttcacaaccccagtgaaacgtatcgctatttcgatctgcccttctgctcttcaggtcatgtgacggagaagaaggaagcgcttggtgaggttttgaatggagatcgacttgttagtgctccctataaacttgactttaagaaagacaaagacactgaagtggcctgtaaaaggaagctgtctaaggatgatgtcactcatttccggaatgcagtgcaaaaggactattacttccaaatgtattatgatgacttgccaatctggggtttcattggaaaggttgaaaaggaaggcaaagttgaccctagtgaatacaaatattttcttttcaagcatatccaattcgaggtttcctacaataaagaccgtgtgattgaaatcatggctcatatggatcctcagtctgtggtggacctgaccgaggacaaggaagtggaagctgagttcatgtacactgtgaagtggaaggaaacagaaattccttttgagaagagaatggagaagtactcacagtcttcttctttaccgcatcacttggaaattcattggttttcaattattaactcatgtgtgactgttctgcttttgactggttttcttgcaaccattctcatgcgagtcttgaagaatgatttcatgaagtatgctcaagatgaagaagcagctgatgaccaagaagagacaggatggaaatacattcatggtgatgttttccggttcccaaagtacaaatccttatttgctgctgcccttggttctggcagccaattgttcactctcacggtcttcatttttatgcttgcgttggttggtgtattttatccatacaaccgaggagctttgtttactgcactggtagttatatatgcactcacgtctgggattgcaggatacacagcttcctctttctattgtcagcttgaaggaaagaactgggtgaggaatcttttgctgacaggttgcctgttttgtgggcctctgttcctcacattctgttttcttaacactgttgcaattgcctacagtgcaactgcagcacttccttttggcaccattgtggtgatagttctcatatggacattggtaacatcaccattgcttgtgttgggtggtattgctgggaaaaatagcaaggctgagttccaagctccttgccgtaccacaaaatatcctcgtgagattccacctctgccttggtacaggagcacccttcctcagatggcaatggcagggtttctccctttcagtgctatttacattgagctctactacatatttgccagtgtttggggtcacaggatttataccatctacagcatcttgtttattgtcttcattattcttttgattgtcactgctttcatcactgtggctttgacttacttccaacttgctgctgaagatcatgaatggtggtggaggtcttttctttgtggtggatctaccggcctgtttatctatggctactgcttgtattattactatgcacgatcagatatgtccggttttatgcagacctcatttttcttcggctacatggcttgcatctgctatggcttctttctcatgcttggggctgtgggttttcgtgcttctttgctctttgtccgtcacatttaccggtcaatcaagtgtgaatagtggcttgattggtcttgtaggtaaattctttcttgcctctttgtttgtcatagagaaaggtctatgaattttgtgataagtaggttcgttagtgcctccaggagcaaaggaagcaagcctttgactaattccctaaattcagtttctttagattctgctgtgttcactcatgccttaggaaattatgggtattctgggatttattgatatttggcatatgtatctatgagacagatgtatctggggaagctgcttgctacaacattcacctttgccctttggaaataacttctttcttatatgataatactgagagtgacccagtatgtaagttcttactgttctgtactcaatgtgtctttgcattcctagttgagcttataattgtgttcaccttttgaacagtaggttaaatcttaaatgccattatttattttcagattttgcttcttttacacaaatattgaaagatgctatcacgcatacaatcatactcaa

SEQ ID NO: 2318 - DNA, 2199 bp, Eucalyptus grandis
gcaacgtagagagataattagatagagagagaatcagaggcgacgactggcgagcgccgatctctccgcctcctgcgcctccttgactggcctcccctctctctctctcttcgcgcggccatggcgaagaagacgatcgccccgatcctcggcctcgccgtcgtggcgctctgcctggccccggcggccgtgtcgagcccctccaaccaccgctacgaggagcgcgaccccgtccctctctacgccaacaaagtcggcccctttcacaaccccagtgaaacatatcgctacttcgatcttccatattgcacaccagatcaaatgaaagataaaaaagaagctctgggtgaagtgttaaatggagatcgtttagtcagtgctccctttgacctgaactttttaacgaataaagaatatgaagttgtttgcaagaaaacactttcaaaggcggaagtggcacgattccggtctgcaatcatccaggactattactttcagatgtattacgatgacttgcccatttggggtttcattgggaaggttgacaaggaggacagggatccaagtgaatacaagtatcttctttataagcacattatcttcgagatcttttacaacaagaaccgtgtgatcgaaattaatgtccggacagacccaaacagtgtcgcagatcttacagaagacaaggaagttgattttcagtttatgtactcggcaaagtggaaagaaacaactattacttttgagaaaaggatggataaatactctcattcatcttccctgcctcatcatctcgagattcattggttttcaatcgtgaattcatgtgttacagttcttttgttgactggatttcttgccacaatcctcatgagagttctcaagaatgatttcgtcaagtatgcccatgatgaagaatcggctgaagatgaggaggagactggatggaaatacctacacggagatgtgtttaggttcccaaagtataagtctctttttgctgctgcagttggttctggtactcagctctttactctcactgtattcatctttatattggcattggttggtgtcttttatccatacaaccgaggcgcactatttacggcactggttgttatctatgcactcacgtcaggaattgcaggctatactgcaacctccttttactgtcagctggagggaacaaactgggtcaggaatttactattgactggatgcctcttctgtgggcctctgtttctcacattctgcttcttaaatacagttgctattgcctacactgcaactgcagctcttccatttggcacgattttggtcatagttcttatatggacacttgtaacatcacctttgctcatactaggcgggattgctgggaagaatagcaaggctgaatttcaagctccatgccgcactactaagtaccccagagagattccaccattgccatggtataggggcacaatccctcagatggcaatggctggttttctcccgttcagtgctatatacatcgaactatactacatttttgccagtgtctggggtcacaggatctataccatatatagcatcttgtttgttgttttcatcattctcttgatagtcactgcttttatcacggtggcattgacctacttccaacttgctgctgaggaccacaaatggtggtggaggtcttttctttgtggtggatcaactggattattcatctatgggtattgcttatactactactacgcacggtcagatatgtctggattcatgcagacttcattcttcttcggctacatggcctgcatctgttatggatttttcctcatgcttggtaccgtaggtttccgcgcagccttgctgttcatccgacacatataccgatccattaagtgcgagtagatgggtggtcctcgtcaatcttctttttctcttccctttcttcttagctgccctgtataataaccttttcacaaaatgctttcgggctttgtattaaaagcagaagcatatagttctcctcacacatcgtgctacttgagaaaaacgagcttagcattacttatcccgaatgttttgttctgattttctttccggttgatttaggaagatgattctttttttgatcggtatatttcaactcgccttttgaaatttgtgtctgattcttcatctcttcttaccattctttggcacacttga

SEQ ID NO: 2319 - DNA, 2415 bp, Eucalyptus grandis
caaaaataaagccatttattggggaccaaaatagaaaatcatcgaattccaaggactaggatgaaatttccgaagaaaaaagtattggtttttttcattttcctccctctccttctatcttcttcttccaatttttggcacttctctctttctctctgctcagagctcgccctaaaccggagcaaaaaccccgacggatccatcgatcgattccgccatctccggcgagagaagcatgaggaaggagccgtccgccggccgccgcagcctcctcgcggcgatcgccgccctcgcgatcgcctccctcgcgatcggcgccagatccgacgcctccgaccaccgctacaaggacggcgaggtcgtccccctatacgccaacaaggtcggccctttccacaaccctagcgaaacctaccgcttctttgatctgccgttctgctctccagataatgtgaaagacaaaccagaagctcttggtgaggtgctcaatggagatcggcttgtcagtgctccctataaacttaactttaaggaggagcatgactccaaagttgtttgttcaaagaagctatcaaaggaggaagttgccaggttcagagctgctgtgaaaaaggactactacttccagatgtactatgatgacttgccaatatggggattcatagggaaggttgaaaaggaagggaaaggtgacccgagcgagtataaatacttcctctacaaacatatacaattcgatattctctataacaaggatcgtgtgattgaaattagcgctaggatggacccacattctgtggtggacctcacagaggacaaggatgttgatgtggagtttatgtacactgtaaaatggaaggaaacagagactccctttgagaaaagaatggataagtactcacattcttcatcattgccacatcatttggaaatccattggttctcaattatcaattcatgtgtaacggttctcctcttgactggtttccttgcaacaattctcatgcgagtcctcaaaaatgactttgtcaagtatgcccaggatgaggaagcagctgatgaccaagaggagactggatggaagtacattcatggtgatgtatttcgttatccaaagcacaaatctttatttgctgcagcccttggttctggcactcagctgtttacactaacggtgttcatattcatgcttgccctggttggtgtattttatccttataaccggggggcactgttcaccgcactggtggtcatctatgcactcacctcagggattgcaggatatacagctacctctttctattgccagcttgagggaccaaactgggtgaggaatctgttgctgacaggttgccttttctgtggtccactcttccttactttctgcttccttaacactgttgctattgcctacaattctacggcggcattgccttttggtactattgtggtcatattcctcatatggacactggtcacagcacccttgcttgtattgggtggcattgctggcaaaaatagcaaggctgagtttcaagctccttgtcgcaccacaaagtatcctagggagatccccccactgccttggtatcggagtacagttcctcaaatggcaatggcaggcttccttcctttcagtgctatttatattgagctttactatatatttgccagtgtctggggtcacaggatttatacgatatacagcatcctgtttatcgtattcattatccttctgattgtgactgctttcatcactgttgccctgacgtacttccagcttgctgcagaagatcatgaatggtggtggaggtcattcctttgcggtggatcaactgggctgtttatctatggatactgcttgtattactactatgcccgttcggacatgtctggttttatgcaaacttctttcttctttgggtacatggcctgcatctgctatggcttctttcttatgctcgggatggtgggattccgtgcatctttgctcttcgttcgtcacatttacaagtcgatcaagtgtgaatagtggattggctagtcctaattccactaatttctgccatggagagaggtcgttagtttctcatacaaggcgataggcattctggatagtcgatgaagtgggctaaatgtaaaatccatgtgctgccaggggagtatctttgattgcacatttagttaggcctcaagatgctgctggcggcaccaatctttttgttgataatgtgttggtatgtgactcgtgtcaacatttatgtgccgagaaggattggtttttatgtatgcctcaactttccttactgaaaacttctatatcttcttaagtgtaagcagccttagtgcgaagcagccttttctctgcgtgtttgctctcatttttgtggaggttgaaattcctaatggtaggca

SEQ ID NO: 2320 - DNA, 2141 bp, Valeriana officinalis
ttcgctaacatcaaccatttcatcgaattctctctttctcttcttcgaacttcttcgaagatgatgatgatgatgatcagattcgtagcagtagcagtgttgattatatgcagttcaattcaagttgttcgttcagatggatctaatcacaaatacaaagccggagatcaagttcctctttacgctaacaaggtcggccccttccataatcccagcgaaacataccgcttcttcgatctgccattctgttctccagctcatgtgaaagagaaacgagaagctctaggggaagtgctaaacggagatcgcctagtcagcgcaccttataaactagactttttagtcgaaaaggactcggaaactctctgcaaaaagaagttatcaaaagaagaagttagccaattcagagccgctgttactaaagattattacttccaaatgtactatgatgacttacctgtatggggattcttaggtaaagttgacaaagaagacaaatcggacccgtcagaattcaaatactatctttttaagcatcttcactttgagattctttacaataaagaccgggttattgagataaatgcaagaactgacccaaatgcccttgtggatctgactgaagataaagaaattgatgtggattttatgtatacggtgaaatggaaagaaacagatattcctttcgataagagaatggataaatattcgtccacttcttcgcttcctcaccacctcgaaattcactggttttcaattataaattcttgtgttacggttcttttgttgaccggttttcttgctaccattctcatgcgagtgcttaagaacgatttcgttaagtacgctcatgatgaggaggctgccgatgatgaagaagagactggttggaagtacattcacggcgatgtttttaggtacccgaaatacaagtctttattcgcagcagcatacggatcggggacacagttatttactctatcaatattcatatttatacttgcacttgtcggtgtattttatccgtataatcgaggagctctcttcactgctctggttgtcatatatgcacttacgtctgggattgcgggatatactgcttcctccttttatcatcaacttgaaggttcaaattgggtaagaaatctgctactaacgggatgcctattctgcgggcccctctttctgacattctgcttcctaaacaccgttgcgatcgcatacagcgccacagcagcacttccattcggcacgattgtagtaatagtactcatttggagtttagtgacatcaccgctgctcgtcctaggtggcatcgccggcaaaaacagcaaggctgattttcaggctccctgcagaaccacaaaatatcccagagaaattccgcccttgccgtggtaccgtggcacggttccccagatggctatggccggttttctgccgttcagtgccatctatattgaactttattacatctttgccagcgtgtggggccaccggatttatactatttatagtatattgttcatcgtgttcatcattctcttgattgttacggcgtttattacagtcgcgttgacttactttcaacttgctgctgaggatcatgagtggtggtggaggtcattcctatgtggagggtcaactggattattcatttacggatactgcttatattactactatgcgagatccgacatgtcagggtttatgcagacatccttctttttcggctacatggcttgtatttgttacggcttttttctcatgctcggcaccctcggtttccgtgccgctttattcttcgttcgtcacatttatcgctccatcaagtgcgagtgactcttcgtacaaatactccatattctatgttcttcaagtgttgaaggctgtatgatgcggaaggcttgtggaagaaataggcagatataccaggatgaagtttcaaatttgtatacgcgtatcgttttcttttctttattttttaaaacttgaaaatctgtttacaactaaataaatgatgatattgaaatttagggttaggttttaggtaggtaaatatgaatgttgaactttgtttcttttttgatctttttgttgtagctttatgtttgaccattaaatctatctaaagaattttg

SEQ ID NO: 2321 - DNA, 2091 bp, Amsonia hubrichtii
tttctctctgcatctcttctctccccaccccaatttaccctcactggtgaatcgagatctgtgccttttttctatatatgtatttataggcgtagagatcagcggtgccgtgtgcttcggcgagtgaatgtgaaatggaaatggaaatggaaaagaagaagcatagaatggtgagatggcaggtcatcgttttcctggtgatgtcaatggtcgcagtagcgagatcggatggctccgatcacaagtataaagctaaggatcaggtgcctctctatgctaacaaggtcgggcctttccaaaaccctagtgaaacgtaccgcttctttgatcttccattctgttctccagatcatgtgaaagagaaaaaggaagctctaggtgaagtgttgaatggagatcgtttagttagcgcgccttataagcttgactttttagttgacaaagactccgagactgtttgcaaaaagaagttgaccaaggatgaagttaaattatttcgaaatgcagtgacaaaggattactacttccagatgtactatgatgacttgcctgtttggggtttcttagggaaagttgataaggaagggaaatctgatccaagtgaatacaagtattacctttttaaacatctgcattttgagatattctacaacaaggaccgtgtgattgaaatcaatgcacggactgacccaagtgcccttgtagacatcactgaggataagaatgttgatgtagagttcttgtattcagtaaaatggaaagagacaaatattccttttgaaaagaggatggagaaatattcaaagacttctgcgttgccacaccacttggaaattcattggttctcaataattaactcttgtgtgacagttctccttcttactggctttcttgcaactattctcatgcgagttcttaagaatgactttgtcaagtatgctcatgatgaggagactgctgatgaccaagaagaaacagggtggaagtatatacatggtgatgttttcaggtatcctaagtacaagtctctgtttgcagcagcccttggttgtggtactcagttattcatcatggcaactttcatttttattcttgcactagttggtgtattttatccatacaatcgtggagctctgttcactgcacttgttgtcatatatgcacttacatctggaattgctggttatactgctgcatctttctactgccaacttgaaggaacaaactgggtgaggaatgtattactgactggggccctgttctgtggacccctctttctgacattttgctttctgaatactgtagcaattgcttatagtgccactgctgcactgccatttggtaccattgttgtcatctttctgatctgggctcttgtgacctcacctttgctagtccttggtggggtagcaggaaagaattccaaggcagagtttcaagctccatgccgtaccacaaaataccccagagaaattccaccattgccttggtaccgcagtactctgccccagatggcaatggctggatttttgcctttcagtgccatctatattgagctctactacatatttgcgagtgtttggggtcacaggatttacaccatttacagtatcctattcattgtcttcattattctgctaatagttaccgctttcattaccgtggcattgacatatttccaacttgctgctgaagaccatgagtggtggtggaggtctttcctttgtggtggatcaactggactcttcatctatggctactgcttatactactattatgcacgttcagatatgtcaggcttcatgcagacctcattcttctttggatacatggcgtgcatatgctatggtttctttcttatgcttgggactgttggtttccgtgcatcactcttttttgtccgtcatatataccgatcaatcaagtgcgagtagtgagttgactaggtggtcttctttgctcatctttatgtttcatgttattggtaggacaatattgggtcaaagaggactatgtaggatattccttctctaggcaaagcttgtaatatcttactataataccataggaaaccttgttaaactttgcttt

SEQ ID NO: 2322 - DNA, 2370 bp, Zostera marina
gggtcagagagacagagagagaggatccgaaattcctaatcctattcgccatttcgtcggacggacggacgacttaggaactctcttcccatttccaaaaactgatccaatcgggacgtagtttcatcagagtatggcgacaatgaggtcttggtcggcgttccttctggtgcttctggtcggacttgttagatcggacagttctgatcaccggtacaaacctggagatttcgtccctctctacgctaataaggtcggaccgttccataatcccagtgagacgtatcggtactttgaccttccattctgttctccagaacatgtgaaagagaagaaggaagcccttggagaagttttgaatggggatcgactcgttgatgcaccatataaacttgatttccaaactgacgttgaatctaaattggtttgtaagaagtcactctcaaaggaacaagtgtctcaatttcgaaatgcggttaataaggactactactctcaaatgtactatgacgatcttccgatttgggggttcattgggaaggttgagaaggatgcaaagggggacccaactgagtcaaaatacttcctttaccgacacatccacttcgatatactatacaacaataatcatgtgatcgagatcaatgtgaggatggatcccaatgctttggtggatgttactgatgatcgtcaagttgatgtggacttcttgtattctgttaagtggaaagaaacaaccactccctttgagaaaaggatggagaagtattcacagtcatcatcattacctcatcatctagagattcattggttctctatcatcaattcttgtgtcacggtgcttcttttaacaggatttctcgctacaattctcatgcgggttctcaaaaatgactttgtcaagtatgaccgtgacgaggaagcagttgatgatcaggaagagtctggatggaaatatatccatggggatgtctttagatttccaaagaacaattctctgatttctgcatgccttggttctggcacccaactttttacactgaccatctttatttttattctcgcacttgtaggggtgttttatccctataacagaggggcactttttacagcattagttgtcatttatgcactaacgtctggcatagctgggtatacggccacatctttctattgccagcttgaagggacaaattgggtaaggaatttattattaacaggctgtcttttctgcgggcctctgttttttactttctgtttcctcaataccgtcgccattgtctatagtgcaactgcagctcttccttttggcacaatagttgtgattgttctgatatggactctagtcacttctcccttgttggttttgggtggaattgctggtaaaaacagcaaagctgagttccaagctcctgtccgcaccacaaagtatcctagggagattccctctctcccttggtatcgaggaacaattcctcagatggctatggctggatttcttcctttcagtgcgatatatattgaactttactacatatttgcgagtgtttgggggcacagaatttacactatttacagcattctttctatagtcttcgttatcctcatcattgtcactgcatttatcactgtagcacttacctacttccagctcgcttctgaagaccatggatggtggtggaggtcgttcctatgtggagggtcgactgggctatttgtttatgggtattgtttgtattattattatgctcgatctgacatgtcaggctttatgcagacatcattcttctttggatacatggcttgcatatgttatggattcttcctcatgctaggcactgtggggttccatgcctctttgttctttgttcgtcacatatacaaatctatcaagtgtgagtaggaaaatacacaatcaaatccctgttgttggtttcgtaagcttttagaatgttacacaatagacgtgtggtatgccgtacgtctcttttatttttggagtttggagtcctaagaaaatatgatcacagcagcagcgtacacacaaacaaggaccatgagtttttagaaaattattgcatattttctttgcttatttgtagaatattgtaggaagaaatctacattctatgaaaactatgcccatctattgtacctgtatcaacgtaatatatgaattatcttattccaaaacaatgacatccatgattcatgaacccatctattgccaaataaattttaactctaatattgggtttcaattattgggatgaatagtttgctgttttgtaataatctgatgctacttttatttactgcttagcagtgatttaaattatatgtgctatttattattctctggttaaaaaa

SEQ ID NO: 2323 - DNA, 2604 bp, Gossypium raimondii
aagttcgatttcattgttgcagtgatcccattcattaatttaattcctcgcgaatcaaacatggcggaagaggtagaaaaaaaaaattcaaatgtgcctaaaaattccgaacaactaccggttgggcggtcaatttcgttggttcggttacccacggaaggtgcggaccgtggagtgcttctcactcttcatgttatcgtctttttacttttactagcctatttcgagtctattatttaacactatcaccaaataaatctctctttttctctatataacatatcttacaaaatacaagatttaaaccggtttccgatctcattcaaatccttaataaccggcgatcaaaatggatagaataagggcgtttttggtagccgtggcgattgtcaccttatgcggcgtacctcaggtcagatccaccgcttccgatcatcgttacaaagctggtgatgaagttcctctttatgctaataaagtaggtccttatcacaatcccagtgagacctaccgttacttcgattttccgttctgttcctcagctcccgtgaaggagaagaaggaagctttgggtgaagtattgaatggcgatcgactagtgagtgcgccttataaacttgagtttttgacggagaaagaggctgaaattgcttgtaaaaggaagcttacgagggaagaagtggtcaagttcagaaaagctgtctcgaaagactattacttccagatgtactacgatgaccttcccatttggggtttcttggggaaagttgaaaaggaagggaagaccgatccagctgattacaaatattacctctttaagcatctcgtttttgagatccatcataacaaggatcgcgtcattgaggtcactgttcgatctgatcccaacgcccttgtggatctcactgaagatgtaccagttgatgtggattttatgtacactgttaaatggaaggaaaccaacactccttttgagaaacggatggacaagtactcgctatcttcttccttgccacaccatttggaaatccactggttctcaatcatcaactcatgtgtcaccgttttgttattgactggtttcctggccaccattcttatgcgagtcctgaagaatgatttcattaagtatgcacatgacgaggaatcggcagatgaccaggaggagtctgggtggaagtatattcatggtgatgtgttcagataccccaagcacaagtccttgtttgccgccgcccttggttctggcacccagctcttcactcttacaagtttcatttttatccttgctctagttggggtcttttatccatataatcgaggagctcttttcactgctctggtcgtcatttatgcccttacatctggcattgctgggtacactgcagcttctttctattgccagctagaaggaacaaattgggtgagaaacttattactaaccggaagcttgttttgcggacctctttttgtcacattttgctttcttaatactgtcgcaattgcttataaagccacagcagcattgccatttggaaccattgtggtgatttttctcatatgggctctagtcacttcacctttattagtattaggaggtattgctgggaagaatagtaaggcggagtttcaagccccttgtcgcaccacaaaatatcctagagagatcccaccattgccttggtaccggaaaactattcctcagatggcaatggcaggtttcttgccattcagtgctatctatattgaactttactacatatttgccagcgtgtggggacataggatctacaccatatacagcatcctgtttattgtctttatcattctcttgattgtcactgcttttatcactgtggctttgacttattttcaacttgctgctgaagaccatgagtggtggtggaggtccttcctttgtggtgggtctaccgggctgttcatatacacctactgtttgtattattacaatgcacggtcagacatgtcaggcttcatgcaaacttcgttcttctttgggtacatggcctgcatttgctatggcttcttcctcatgctcggggctattggcttccgtgcatctctgctctttgttcgacacatttaccgttcaatcaagtgtgagtaggaagttggatggtcttccctgttcacaagaagtaagcatacttttgctttatcagaaccagttgataggtagtttatcaaaagattctacgatgatgattacgaaaagagcagaccggaagcgcgtgggtgctttgggctgctttggcagtgttgtatgaaatatgaaccattctaaaccttagttgatgccaacaaaaactttgcattcctcacttcaccattcccattttgtttacaattattattatttttgttggagtgaaaacatgttgaatattgagatgcatacttctaggacgagcttttgttattacgcagtcattttcatgttgttagctctaaaaacaataacatatatctacattttgcaatcaattcgtcgcattttgtgttgggtcccgatttggtagtgttctaaaatttcagtttcaacttttgtgaaagaaaaaacaagtgttgaaagtgaatttatct

SEQ ID NO: 2324 - DNA, 2133 bp, Euonymus alatus
ggaaaagaaaagaaaaaacacggaggagaagaggataatggcgtgcatagttgcggccgtgttgatcctctgcggactatcccaggtgagatccgatgcatctgatcatcggttcaaagttggcgacgacgtccctctctacgccaacaaggtcggtcctttccacaatccgagtgaaacctatcgctactttgatcttccattctgctcatcagcccctgtcaaggaaaagaaggaggctcttggtgaagtgctaaatggagatcgattggttagtgcaccttacaaacttgactttctgaacgagaaagagtctgacgttgcttgcaagaggaggctgacaaaggaacaagttactcagttccgacgtgctgtttccaaggactactattttcaaatgtattatgatgacttgccaatatggggtttcttaggaagggttgacaaggaaggcaaaagtgacccaagcgagtacaaatattacctttttaggcatcttatttttaatatcttttacaataaggatcgagtcattgagattactgtgcaatctgatccaaactctttagtggacattactgaagataaagaagttgaggtggagttcacttacacagttaagtggaaggaaacagaaatcccctttcgagaagaggatggagaagtattcacagtcttcttcactgccacatcacttggaaatccattggttctcaataattaattcatgcgtgacagttctcctcttgactggttttcttgccacgattctcatgcgggttcttaagaatgacttttctaaatatgctcatgacgaggagtcagcagatgaccaagaggagactgggtggaagtacatccatggtgatgtatttaggtatccgaagtataagtctttgcttgctgcagcacttggttctggtacgcagttgtttactctaacaattttcatttttatgcttgctttagttggtgtcttctatccttacaatcgaggtgctctgttcactgcactggttgtgatatatgcgcttacctctggcatcgctggctacacggctgcctcgttctattgccaactagagggaacaaattgggtgaggaatctgttattaactggaagcctgttttgtggacccctttttctcacattctgttttcttaataccgttgcaatagcttacagtgctactgcagcattgccttttggaacaattgtggtgattttccttatacttactctggtcactacaccattattagtacttggtggcattgctgggaaaaatagcaaggctgagtttcaggcaccctgtcgcacgactaagtatcccagagagattcctccattgccttggtatcgaaagtctcttcctcagatggcaatggcagggttcttgcctttcagtgctatctatattgaactttactacatatttgctagcgtgtggggtcacaggatttataccatatacagcatcctctttattgtcttcattattctcttgattgtcactgcttttatcactgtggcattgacatactttcaacttgctgctgaagaccatgattggtggtggaggtcattcttatgtggaggatcgactgggctgttcatttatggctactgcttgtattactactatgcacgatctgacatgtcgggcttcatgcaaacgtcatttttctttggatacatggcttgcatctgctatggtttcttgctcatgctcgggactgtaggttttcgtgcttctttgttcttcgtccgtcatatctaccgctctatcaagtgcgagtagcaagtcacatggtcttccatatgttccatggagaaggatttcagggttgtttgggtccatgcttctggacttgcctgaggttttagggtgttgcttcgagaaagaggagttgcacacatatatctatctacattccttcgatggaaatgttgatgttggagtgtaggatgccatgaagcagctggtagtacctgatgcatgttacatttttctttttgtttggtagtaattttttgttgggacaaaatgtagacagtaaaagatgcattggaaaattaagactcataatacttgcacgttatgacatcctttataacatgcttctcacaac

SEQ ID NO: 2325 - DNA, 2171 bp, Elaeis guineensis
cgagtcaccgagctggttctcttccataaaacgcttttcgcgtcaaaggagagagagggcgcgaacgagagcgagggagagagaggggaagagatggggaggaagaaggcgatggttttggtggcggtgttggtggcggttttcttgctatgtttcgggattgcaggagtggcggccgacgcgtccgatcaccgctacaaggccggggagccggtccctctctacgccaacaaggtcggccctttccacaaccccagtgagacgtatcggtactttgatctccccttctgcagtccagaacatgtgaaggagaaatcagaagctctcggtgaagtgctgaatggggaccgcctggtcgatgctccatacaagcttgacttccgtgtcgacctggattccaaagtggtgtgcacgaagaagctgaagagcgaagaggtggcccagtttagaagcgcagtcctcaaggactactacttccagatgtactatgatgacctccccatttggggattcattgggaaggttgacagggaaggcaagactgatgagaatgagtacaagtactacctttacaggcatatccactttgacgtcctatataatggtgaccgagtgattgagatcaatgcccacaccgatcccaatgcattggttgatgtcactaaggacagggaaatcgaggtggagttcttgtattcagtgaagtggagggagacaagcacaccctttgagaaccggatggataagtattcacagacttcatcactgccgcatcacttggaaattcattggttctcaataattaactcatgtgtcacggttcttctgctgaccggattccttgccacgattctcatgcgggtgctaaagaatgactttgtcaagtatgctcatgatgaggaatcagctgaagaccaggaagagactggatggaaatatatccatggggatgtctttaggttcccaaagcacaagtcactctttgctgcctgtgttggttctggcactcagctatttgctcttacaattttcatatttattcttgctttagttggggtgttctacccttacaatcgaggtgctcttttcactgctctggttgtcatctacgcacttacatctggcatagctggttatatttccacttctttctattttcagcttgaaggaacaaactgggtaaggaatttgctgatgacaggatgcctgttttgcgggcctctgttcctgacattctgctttttgaacactgtggccattatctatagtgctacagcagcactcccatttggcactattttagtgattcttctcatatggacactggtaacttctcctctgcttgttctgggtgggattgctggcaagaacagcaaggcagaattccaggctccttgtcgcactaccaagtatcctcgagagatcccacctctgccttggtaccgaggaactattccgcagatggcaatggctggttttctaccctttagtgccatttatattgaactttactacatatttgcgagtgtctggggtcaccgaatttacacaatctacagcatcctctttatagtctttatcattcttctcattgtcactgccttcataactgttgcattgacctactttcaacttgctgctgaagatcatgaatggtggtggaggtcattcctttgcggaggatcaactggcctattcatatatgggtactgcttgtactattactatgcccggtcggacatgtcaggttttatgcaaacttcgttcttctttgggtacatggcttgcgtctgctatggtttcttcctcatgcttgggagcattggtttccgtgctgccttgttatttgtccgtcacatataccggtctatcaagtgtgaataatcagtcatccctggatcatgttaggtggttggactttacatgtggacatggagcagcagatggatttagagctggatcaccttttcttgaacaaaggctgagccttcaaaattgttattttggtggagtcaattgtattcatgttctttttgtattctgctcccttgaaagctccggttaatctgcaaagaagtttgtaccattacatggacctacatattctacaatatagttcctcttttcacacctcaaaaaaaaaaaacaactagaacgtacgtaccgaaccg

SEQ ID NO: 2326 - DNA, 2143 bp, Tropaeolum majus
tttttttcaccctctgatcggtttctgttgggaccgtgaaaaaaaaataggagaagataacgtcgtggttcgttgcggtggccgtacttattctttgcggcggcgcagtaaatgtgagatcggatgcatctgatcatcggtacaaagttggagatgatgttcctctctatgcaaacaaagttggaccattccataaccccagtgaaacgtatcggtattttgatcttccattttgttcatcagctccaatcaaagaaaaaaaggaagctcttggcgaagtcttgaatggagatcgattagtgagtgcaccctacaaactggactttttaaatgacaaagactctgaggttgcttgtaagaggaggttaaaaaaggaagacgtagttacgttccgaaatgcagtttccaaagactactactttcaaatgtactatgatgacttgcctatttggggattcttgggaaaacttgataaggagggcaaaactgaccccacggaattcaagtactacctttttaatcatcttcagtttgaaatcttttacaataaggaccgtgtcattgaaattagtgttcgatctgacccgcattccattgtggacttgaccgaggataaagaagtggacgtggacttcacgtacacagttagatggaaggaaacagaaactccttttgaaaagaggatggagaaatactcacattcttcttcattgccacatcacttggaaatccattggttctcaattattaattcttgtgtgacagttcttctcttgactggtttccttgccactattctgatgcgagtcttgaagaatgattttgttaaatatgcacatgatgaggaggctgctgatgaccaggaggagactgggtggaagtacattcatggtgatgtatttaggtatccaaagcacaactcattgtttgcagcagcacttggctccggctcgcagctatttgctctcacaattttcatttttatgcttgctttggttggtgtcttttatccatataatcgaggcgccctctttaccgcattggttgtcatgtatgcgctcacttcaggaatagctggctatattgctgcctctttctattgccagctagaaggaactaattgggtgagaaatttattgttgactggaggcctgttctgtggacctcttttcctcacattctgcttcctgaacactgttgcaattgcgtacaatgccaccgcagcattgccattcggaacgattgtggtcattttccttatctggacgttagttacatcacctttgttaatactaggtgggattgctgggaaaaatagcaaggctgaatttcaagctccttgtcgtaccacaaagtatccgagagaaatccctccattgccttggtatcgaagagctcttcctcagatggccatggcaggatttttgccattcagtgctatctatattgaactttactacatatttgccagcgtttggggtcacagaatatacacaatatatagcatcctctttattgttttcatcattctcttgattgtcactgcatttatcactgtagcattgacatattttcaactcgctgctgaagaccatgcctggtggtggaggtctttcctttgcggtggatcaacaggcttgttcatatatgcttactgcttgtactattacttcgcaagatcagatatgtcaggtttcatgcagacttcgttcttctttgggtacatggcttgcatctgttatggctttttcctcatgcttgggaccataggattccgtgctgcgttgttatttgttcgtcacatttaccgttcgataaagtgtgaatagaaggttgcaagaacttcgcccctcttcaacagatattgtggattcatgaaattacattcaagactttggcgtcattatagatgtagtaacttcacggttgcaactcatcaatatctgtatgagaggtttgttttgaaagagtaggatggaccaccatgaaaagaaaagctttcagtaggtacatgtaaggttgggagatttacttgaattccatatatttagttatatttgttagatataaaccatgtacgaaccgtagtgtcgttgcagtacctgcggctagtgatgtaaaactcaaatcatcttttgcataa

SEQ ID NO: 2327 - DNA, 2274 bp, Gossypium hirsutum
aattaatctctctttttctctatataacatatcttacaaaatacaagatttaaaccggtttccgatctcattcaaatccttaataaccggcgatcgaaatggatagaataagggcgtttttggtagccgtggcggttgtcgccatatgcggcgtacctcaggtcagatccaccgcttccgatcatcgttacaaagctggtgatgaagttcctctttatgctaataaagtaggtccttatcacaatcccagtgagacctatcgttacttcgattttccgttctgttcctcagctcccgtgaaggagaagaaggaagctttgggtgaagtattgaatggagatcgactagtgagtgcgccttataaacttgagtttttgacggagaaagaggctgaaattgcttgtaaaaggaagcttacgaaggaagaagtggtcaagttcagaaaagctgtctcgaaagactattacttccagatgtactacgatgaccttcccatttgggggttcttggggaaagttgaaaggaggaagaccgatccagctgattacaaatattacctctttaagcatctcgtttttgagatccatcataacaaggatcgtgtcattgaggtcactgttcgatctgatcccaacgcccttgtggatctcactgaagatgtaccagttgatgtggattttatgtacactgttaaatggaaggaaaccaacactccttttgagaaacggatggacaagtactcgctatcttcttccttgccacaccatttggaaatccactggttctcaatcatcaactcatgtgtcaccgttttgttattgactggtttcctggccaccattcttatgcgagtcctgaagaatgatttcatcaagtatgcacatgatgaggaatcggcagatgaccaggaggagtctgggtggaagtatattcatggtgatgtgttcagataccccaagcacaagtccttgtttgccgccgcccttggttctggcacccagctcttcactcttacaagtttcatttttatccttgctctagttggggtcttttatccatataaccgaggagctcttttcactgctctggtcgtcatttatgcccttacatctggcattgctgggtacactgcagcttctttctattgccagctagaaggaacaaattgggtgagaaacttattactaaccggaagcttgttttgcggacctctttttgtcacattttgctttcttaatactgtcgcaattgcttataaagccacagcagcattgccatttggaaccattgtggtgatttttctcatatgggctctagtcacttcacctttattagtattaggaggtattgctgggaagaatagtaaggcggagtttcaagccccttgtcgcaccacaaaatatcctagagagatcccaccattgccttggtaccggaaaactattcctcagatggcaatggcaggtttcttgccattcagtgctatctatattgaactttactacatatttgccagcgtgtggggacataggatctacaccatatacagcatcctgtttattgtctttatcattctcttgattgtcactgcttttatcactgtggctttgacttattttcaacttgctgctgaagaccatgagtggtggtggaggtccttcctttgtggtgggtctaccgggctgttcatatacacctactgtttgtattattacaatgcacggtcagacatgtcaggcttcatgcaaacttcgttcttctttgggtacatggcctgcatttgctatggcttcttcctcatgctcggggctattggcttccgtgcatctctgctctttgttcgacacatttaccgttcaatcaagtgtgagtaggaagttggatggtcttccctgttcacaagaagtaagcatacttttgctttatcagaaccagttgataggtagtttatcaaaagattctacgatgatgattacgaaaagagcagaccggaagcgcgtgggtgctttgggctgctttggcagtgttgtatgaaatatgaaccattctaaaccttagttgatgccaacaaaaactttgcattcctcacttcaccattcccattttgtttacaattattattatttttgttggagtgaaaacatgttgaatattgagatgcatacttctaggacgagcttttgttattacgcagtcattttcatgttgttagctctaaaaacaataacatatatctacattttgcaatcaattcgtcgcattttgtgttgggtc

SEQ ID NO: 2328 - DNA, 2251 bp, Zostera marina
cggagattaaagaaagtggggattccattaggagaagggttcatgaggtgtggtgctcccgcaagtcggtggtgttaaaactgacccacaatcgttccctcaaaaacgcataggacgactctggaatctggatcccctttccattccccgattcccagataatgagaggaatgaggttgacagatagggtttcattggcgacgttggccatttttctcatattcttgtccagagaagtctcgtcggatggttccaaccatcgctatagtacaggcgatgccgtgcccctctacgctaataaagttgggccttttcataacccaagtgaaacttatcgttactttgatcttcccttttgtacaccagaacatgtgaaagaaaaattggaagctcttggagaagttctcaatggagaccgtcttgttgatgccccttacaaacttgattttcttactgatctagattcaaaagtgctatgcaagaagaaacttagtgtgcaggaagttaaaaaattccgcagtgctgttaacaaagattattacttccagatgtactatgatgacctccctctatggggattcattgggaaaatggaaaaagatgcatctggggatccaaatgaatccaaatcctttctttacagacatattcaatttgacatattgtacaacaaaaatcgtgtcatcgagatcaatgtgaggacagatcccaatgcaatggtggatgtcactgaggacagagaagttgacgtggagtttctgtattctgtgaaatggaaggagacaaacactccatttgaaaagagaatggagaagtactcacaatcttcctcattacctcaccatctggagatacactggttctcgatcataaattcttgtgttactgtattactattaacaggattccttgctacgattctgatgcgggttcttaagaatgactttgtaaaatatgctcatgatgatgaggcagttgaagatcaagaggaaacaggatggaaatatattcatggtgatgtcttcagattccctcaaaacaaatcgttatttgctgcttgtcttggatctggcactcaattgtttgcactcaccatttttatattcattcttgcactagttggtgttttttatccctacaacaggggagcactgttcactgctttggttgttatatatgctctcacatctggaatagctgggtatgtagctacgtcattctattgccagcttgaaggatcaaattgggtaaggaacttgctattaaccggatgtcttttctgtggaccattgttcttgactttctgtttcctcaacactgttgctattgtatatagtgctacggcagctcttccttttggcaccattgtagtgattgttctaatatggacccttgtgacttcacctttgttagttttgggaggcattgctggtaaaaacagtaaggctgaatttcaagctcctgtcagaaccaaaaaatatcctagagagattccaccatcaccttggtatagaggaaccgttccacagatggctatggctggttttctgcctttcagtgctatctacattgaactctactacatatttgccagtgtgtggggccacagaatctataccatatatagcattctgtttattgtctttatcatccttctcattgtcacagctttcatcacagtggcactgacctactttcaacttgccgcagaagaccacaagtggtggtggaggtcattcctatgtggaggatctacaggtctcttcatttatggctattgcctgtactactatcatgcccgttcggacatgtcaggtttcatgcagacgtcattcttctttgggtacatggcttgcatctgctatgggttctttcttatgctgggttcagtgggtttccgcgcatcactcttcttcattcgccatatatataagtctgtcaagtgtgagtaggcaaacggctggctgatgccaaatttggcatacattttcttttgtttgttttatataagatttgtaatagttgtccgataagttatgataaaaatgaatcatgtaccatcagatctggatgttattttgttccctgtcaattgtcataggaagtagcttaatgggaaatcgttggtaaaatatgttgattatgttcgtaatttgacatcacacattgacatgtatcttttcttaacttgctacatgatgatatctactctcagacaacatgtatctttctttcattgaatatatttatt

SEQ ID NO: 2329 - DNA, 2475 bp, Hordeum vulgare
gcccctccccccccctctcgtcaacgccgccccgccgccccaccgcccgaggagaggagaggagaggacgagccatggcatcgccggccgcgcgcgcggcctcggcgctcctcctcctgctcgccctcgccgtggccggcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctaggcgaggtcctcaatggggatcggctggtcgacgcgccctacaagcttgatttccgcacggatcatgactccaaggcggtttgccccaagaagcttaccaaggaggacgtggccaagttccggaacgccgtagccaaggactactacttccagatgtactatgatgatctcccactgtggggttttattggtaaggtcgagaagggaggcaagccggacccgagcgagtggaagtattacctctacaggcacattatctttgacatcctctacaataacgaccgtgttattgagatcaatgtgcacactgaccagagtgccctggttgacctgacggaggacaaggaggttaatgtggacttcctttacactgtcaagtggaaggagacacctaccccgttcgagaagaggatggagaagtattccagctcctccaacatgccgcatcacttggaggttcattggttctccattataaattcttgtgttacggtcctcctcctcacagggttcctggcaacaatcctcatgcgagttctgaagaatgattttgtgaagtacgcacatgatgaggaagcagctgatgaccaagaagagtctggatggaagtatattcacggtgatgtcttcaggttccccaagaacaagtcattgttttcggctgctcttggcactggaactcaactgtttgctctaacaaccttcatattcctgcttgcacttgttggagtattctacccttacaatcgtggtgcccttttcactgcattggtcgtcatctatgcactcacctcaggaattgctggttacattgcaacctctttctattgccagctagagggaacaaactgggtgaggaacttgctgttaacaggatgcctgttttgtggacctctcttcctgacattctgtttcttgaacactgttgctattgcttatagtgcaacagcagcattgccattcggcacaatctgtgtcattgtgctgatctggaccttagtcacattccctctactagttttgggaggcattgctggtaaaaacagcaagagtgaattccaagctccttgccgtaccaccaaataccctagggagattcctccacttccttggtaccggacaacagttccgcagatggctatggctggatttttgcctttcagtgctatatatatcgagctctactacatctttgctagtgtttggggccaccgaatttacacaatttacagcattctcttcatagtcttcatcatcctccttatcgtcactgccttcatcactgttgcgctgacatacttccagcttgctgctgaagaccatgagtggtggtggaggtcattcctgtgcggaggatcaactggatttttcgtctatggctactgtctgtactactactatgcacgatcggatatgtctggcttcatgcagacatctttcttctttgggtacatggcgtgcatctgctatgcattcttcctgatgctgggtatggtgggcttccgtgccgccttgttctttgttcggcacatatacaagtcgatcaagtgtgagtaaggtgctgttggaggatgaagagcagcaagcagagttgtactcctttttggtgccgctaagaagtcccagtatagaaaaggttagctctcgcgtgcaacaggaagcaactagaagagattggcatgtttgagattaggccattattcataggaagaggtaatgaacctataaatttcttgtcattgtgcgactggtgtgatgaaccaaccgtctttcctttgatccatccccatgtattatgtgacgtccagacagtattactttgttgaaccataacaacctatataaatttctgtgcaagttcctatggcagaataacacgtgtagagatgatgcctcaagaagggcatgtccagtcgatctgtaccgttgtacttgtatcctatgcgttctggttatatattgtcagattttgaaacattttctttacaaagatggcaaagattcttctgtaatttaccagtgggctaattgttgttatcgctggtttgtaaaaccatggccaaatgcctctggaggttctcttattttttataatgcaatgtatgtcaaatctgagttaaatgtatacttcagagggaaagaaaacaaaaacacaatggagaaatcaatggcgata

SEQ ID NO: 2330 - DNA, 2342 bp, Secale cereale
acctgagccaaacccacccccgcggccagagccagatctccttccttcccccctccctcctccgacgcccttctatttctattaagaaggaagcaagcagggcgccactcagatctctccgccccttcctcgcctcgtgcccccctccctctcgtcaacgccgccccgcccgaggagacgagaggagaggaaggacgagcgatggcatcgccggccgcgcgcgcggcctcggcgctcctcctcctgctcgccctcgccgtggccggcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctcggcgaggtcctcaatggggatcggttggttgatgcgccctacaagcttgatttccgcacggatcacgattccaaggcggtctgccccaagaagcttaccaaggaggacgtggccaagttcaggaacgcggtagccaaggactactacttccagatgtactacgatgatctcccactgtggggtttcatcggtaaggttgagaagggaggcaagcctgacccgagcgagtggaagtactacctctacaggcacattatctttgacatcctctacaacaacgaccgtgtcattgagatcaatgtgcataccgaccagagtgcactggttgacctgacggaggacaaggaggttaatgtggacttcctttacactgtcaagtggaaggagacacctacaccgtttgagaagaggatggagaagtattccagctcctccaacatgccgcatcacttggaggttcattggttctccattataaattcttgtgttacggtccttctcctcacagggttcttggcaacaatcctcatgcgagttctgaagaatgattttgttaagtatgcccatgatgaggaagcagctgatgaccaagaagagtctggatggaagtatattcacggtgatgtcttccggttccccaagaacaagtcattgttttcggctgctcttggcactggaactcaactgtttgctctaacaacctttatattcctgcttgcactcgttggagtattctacccttacaatcgtggtgcccttttcaccgcattggtcgtcatctatgcactcacctcaggaattgctggttacattgcaacctctttctattgccagctagagggaacgaactgggtgaggaacttgctactgacaggatgcctgttttgtggacctctcttcctgacattctgtttcttgaacactgttgccattgcttatagtgcaacagcagcattgccgttcggcaccatctgtgtcattgtgctgatctggaccttagtcacattccctctactagttttgggaggcattgctggtaaaaacagcaagagtgaatttcaagctccttgccgtaccaccaaataccctagggagattcctccacttccctggtaccggacaacagttccgcagatggctatggctggatttttgcctttcagtgctatatatatcgagctgtactacatctttgctagtgtttggggccaccgaatttacacgatctacagcattctcttcatagtcttcatcatcctccttattgtcactgccttcatcactgttgcgctgacatacttccagcttgctgctgaagaccatgagtggtggtggaggtcattcctatgcggaggatcaactggatttttcgtctatggctactgtctgtactactactatgcacgatcggatatgtctggcttcatgcagacatctttcttctttgggtacatggcgtgcatctgctatgcattcttcctgatgctgggtatggtgggcttccgcgccgccttgttctttgttcggcacatatacaagtcgatcaagtgtgagtaaagtgatgttggaggatgaagagcagcaagcagagttgtactcctttttggtgccgctaagaagtcccagtatagaaaaggttagctctcgcgtgcaacaggaagcaactagaagagattggcatgtttgagattaggccattattcataggaagaggtaatgaacctataaaatttcttgtcattgtgcgactggtatgatgaaccgtctttcctttgatccccccatgtattatgtgacgtccagacagtattactttgttgaaccataacaacctatataaatttatgtgcaagttcctatggcagaataacacgtgtagagatgatgatgcctcaagaagggcatgtccagtcgat

SEQ ID NO: 2331 - DNA, 2064 bp, Valeriana officinalis
ccagatctatgtcttctctcgcttaattacctatttcacacacacacacacacacactatctccctctgtaaacatacacggagctcataatgcggtggttagcggtggtgctggtggtggtggtggcgatttgcagtgtgccggaagttaagtcagatggatcagatcacaaatacaaagttgcagatcaggttcctctttacgccaacaaagtcggtccatttcagaatccaagtgaaacataccggtattttgatctgccgttttgtttaccagctcatttgaaagagaaaaaagaagctttaggtgaagttttgaatggagatcgtttggttagcgcgccctacaaactagactttttagtcgagaaagacggtgaaattatatgcaataagaagttaacaaaagaagaagttgctcaattcagaagtgccatcgcaaaagactactatttccaaatgtattatgatgatttaccactttggggattcctaggaaaacacgaaaaagaaaaagatgatccgaacgaatctaaatattaccttttcaagcatcttcattttgatatacagtacaataatgaccgggttattgaagtcaatgttcggaccgaccccaatgctcttgtggatcttactgaagataaggaagttgatgcagatttcatgtattcggttaagtggaaagaaacagatactccttttgagaaacggatggagaaatattcgttcatttcttcactaccacatcacttggaaattcactggttttcgatcattaattcgtgtgtgacagttcttttgttgactggttttcttgcgacaattctcatgcgagtactcaagaatgactttgtcaagtatgctcacgatgaggaaacagccgaagaacaagaagaaactggatggaaatatatccacggtgatgtgtttaggtacccaaaatataaatctttgtttgcagcggctcttggttctggaactcaactattcattctagcaattttcattttcatacttgccctagttggtgtattttatccatataatcgaggagctttgttcaccgctcttgttgtcatttacgcccttacttctggtattgctggctacactggagtttctttctattgccagttagaaggaacaaattgggtaaggaacttgttactgacaggatgcctattctgcggtcccttatttctaacattctgctttctaaacaccgtagcaatcgcatacagcgcaaccgcagcgctgccagttggcacgatcctagtgatagttctaatatgggccctagtgacatcaccattattagtcctaggtggcattgctggcaagaacagcaaatcggagtttcaagccccatgtagaaccacaaaatacccaagagaaattccacaattgccctggtacagggctactattccccaaatggcaatggccggttttctcccattcagcgccatctacattgaactttattacatttttgccagcgtgtggggccaccggatttatactatttacagtatattgtttatcgtcttcattattctccttattgttaccgcttttatcacggtggctttgacatattttcaacttgctgctgaagaccataaatggtggtggaggtcattcctatgcggaggatcaacagggctgtttatatacggctactgtttatattactattacggacggtcagatatgtctggattcatgcaaacctcatttttcttcggatacatggcttgtatttgttatggatttttcctcatgttgggcgccgttggtttccgtgcctctcttgtctttgttcgtcacatatatcggtctatcaagtgcgagtagagcatggtatttttgtaatttttctaatttacagaatctcggttttcggaccaccatgtgtaggataattgtagttttagtttgagttcacaagataaatcaagcttgtgttgttgtagaattaatgaattgtgcttccttatttcggaatttatagttcgaatttgtttatatctatgctacttagtactcctatgttactta

SEQ ID NO: 2332 - DNA, 2509 bp, Setaria italica
cggaccaatacgctccgtcgccaccttccaccacccaacctgacaagtgacaacgccatcccaggaggccaacccccgcgtccccgcccggcccccagatctcccccatcccttccttcccgtccgtccctctctattaagcagcaagcaaagcgccactcgcaatcccgcaagtctcagatctctccgccccccgtctccgtctctcttccacccccaaaccctcctcgccccgcctccctcgtcaacgccgcccgacgagagcgatggcggcctcgccggccgcggccgcggcgctcctcgccctcctcgccctcgcggcggccggcggcgtggcggctgacggctccgaccaccgctacaaggccggcgagcccgtcccgctctacgccaacaaggtcggccccttccacaaccccagtgagacgtatcggtactttgacctgcctttctgctctcctgagaaagtgagggagaagagcgaggccctgggtgaggtccttaatggggatcggctggtcgatgcaccttataagcttgatttccgtgtggaccttgactccaggtcggtttgctcaaagaagctcaccacggaggatgtggccaagttccggaatgcagtagctaaggactactacttccagatgtactatgatgatctcccactatggggtttcattggtaaagttgataaggaaggcaaggctgacccgagcgagtggaagtactacctatacaagcacatcatcttcgatatcctcttcaacaatgaccgggtgatcgagatcaatgtgcacactgatcagagtgcattggttgacctgacggaggataaggagaccaatgtggaattcctttactcggtcaagtggaaggagacacttacaccatttgagaagaggatggagaagtattccagctcctccaacttgccacaccacctggaggttcattggttctcgattataaactcttgtgttacagtcctcctcctcacagggttccttgcaacgatcctcatgcgagtactgaagaatgattttgtcaagtatgcccatgatgaggaagcagctgatgaccaagaagagtctgggtggaagtatatccatggtgatgtcttccggttccccaagaataagtcactattttctgctgctcttggtacaggaactcaattatttgccctcacaacctttatattcctgcttgcacttgttggagtattctacccttacaaccgtggtgcattgtttactgcattggttgtcatctatgcgctcacttcaggaattgctggatacattgctacctctttctattgtcagctggaggggacaaactgggtgaggaacttgctattgacaggatgcctgttttgtggacctctcttcctgacattctgtttcttgaacacagttgctattgcttatagtgcaacagcagcattgccctttggcacgatctgtgtcattgtgctcatctggaccttggtgacatttcctttgctcgttttgggaggtattgctggtaaaaacagcaaaactgaattccaagctccttgccgcaccactaaataccccagggagattcctccacttccctggtaccggcaaacaattccccagatggctatggctgggtttttgcctttcagtgccatatacattgagctgtactacatctttgctagtgtttggggccacaggatttacacgatctacagcattctctttatagtctttatcatcctccttatcgtcactgctttcatcactgttgcactgacgtacttccagcttgctgctgaagaccatgagtggtggtggaggtcattcctatgtggaggatcaaccggtttctttgtatatggctactgcctgtactactactatgcacgatcagacatgtctggcttcatgcagacctctttcttctttggctacatggcctgcatctgctatgcattcttcttgatgctcgggatggtgggcttccgtgccgccttgttctttgtccgccacatatacaaatccatcaagtgtgagtgagctgtctgttggaagatgaagagcagcagagttgtacccgtttttggtgccactaagaagtcccaaatatagaaaaggttagctctcgcgtgcaacaggagcagctagagattgccgtgtttcagattaggccattatttataggaacaggtaatgaacctataaatttgttatgtttatgccactgctgtgataaagatcgtcttttccttcgccctatgtactatctcctagtgacgtcagacagtaccataacatttgttggaaccatgacatgcctgaatatctgtggagtacccgtgttgtgttgtcttgtgtgctctaaagcaaaataacagatgtgtagagacgatgccacttgaggggcaagtccatttatacgtgtattcactgcttcattgtgaactgttaaaatggcagtcattttttgtactcatgagctttttgtgtcttcaaaattt

SEQ ID NO: 2333 - DNA, 2372 bp, Hordeum vulgare
cccacagccagatctccatgggtcctggctcctccgtctccctccctcccttctatttctattaagaagcaagcagggcgccactcagatctctccgccccttcctcgcctcgtgcccctccccccccctctcgtcaacgccgccccgccgcccgaggagaggagaggagaggacgagccatggcatcgccggccgcgcgcgcggcctcggcgctcctcctcctgctcgccctcgccgtggccggcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctaggcgaggtcctcaatggggatcggctggtcgacgcgccctacaagcttgatttccgcacggatcatgactccaaggcggtttgccccaagaagcttaccaaggaggacgtggccaagttccggaacgccgtagccaaggactactacttccagatgtactatgatgatctcccactgtggggttttattggtaaggtcgagaagggaggcaagccggacccgagcgagtggaagtattacctctacaggcacattatctttgacatcctctacaataacgaccgtgttattgagatcaatgtgcacactgaccagagtgccctggttgacctgacggaggacaaggaggttaatgtggacttcctttacactgtcaagtggaaggagacacctaccccgttcgagaagaggatggagaagtattccagctcctccaacatgccgcatcacttggaggttcattggttctccattataaattcttgtgttacggtcctcctcctcacagggttcctggcaacaatcctcatgcgagttctgaagaatgattttgtgaagtacgcacatgatgaggaagcagctgatgaccaagaagagtctggatggaagtatattcacggtgatgtcttcaggttccccaagaacaagtcattgttttcggctgctcttggcactggaactcaactgtttgctctaacaaccttcatattcctgcttgcacttgttggagtattctacccttacaatcgtggtgcccttttcactgcattggtcgtcatctatgcactcacctcaggaattgctggttacattgcaacctctttctattgccagctagagggaacaaactgggtgaggaacttgctgttaacaggatgcctgttttgtggacctctcttcctgacattctgtttcttgaacactgttgctattgcttatagtgcaacagcagcattgccattcggcacaatctgtgtcattgtgctgatctggaccttagtcacattccctctactagttttgggaggcattgctggtaaaaacagcaagagtgaattccaagctccttgccgtaccaccaaataccctagggagattcctccacttccttggtaccggacaacagttccgcagatggctatggctggatttttgcctttcagtgctatatatatcgagctctactacatctttgctagtgtttggggccaccgaatttacacaatttacagcattctcttcatagtcttcatcatcctccttatcgtcactgccttcatcactgttgcgctgacatacttccagcttgctgctgaagaccatgagtggtggtggaggtcattcctgtgcggaggatcaactggatttttcgtctatggctactgtctgtactactactatgcacgatcggatatgtctggcttcatgcagacatctttcttctttgggtacatggcgtgcatctgctatgcattcttcctgatgctgggtatggtgggcttccgtgccgccttgttctttgttcggcacatatacaagtcgatcaagtgtgagtaaggtgctgttggaggatgaagagcagcaagcagagttgtactcctttttggtgccgctaagaagtcccagtatagaaaaggttagctctcgcgtgcaacaggaagcaactagaagagattggcatgtttgagattaggccattattcataggaagaggtaatgaacctataaatttcttgtcattgtgcgactggtgtgatgaaccaaccgtctttcctttgatccatccccatgtattatgtgacgtccagacagtattactttgttgaaccataacaacctatataaatttctgtgcaagttcctatggcagaataacacgtgtagagatgatgcctcaagaagggcatgtccagtcgatctgtaccgttgtacttgtatcctatgcgttctggttatatattgtcaga

SEQ ID NO: 2334 - DNA, 2345 bp, Triticum aestivum
cctccgactccctcttctatttctattaagaaggaaggaaagcaagcagggcgccactcagatctctccgccccttcctcgcctcgtgccccccaccctctcgtcaacgccgccccgcccgaggagaggaggaaggacgagccatggcatcgccggccgcgcgcgcggcctcggcgctcctcctcctgctcgccctcgccgtcgccggcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctcggcgaggtcctcaatggggatcggttggtggatgcaccctacaagcttgatttccgcacggatcatgattccaaggcggtttgccccaagaagcttaccaaggaggacgtggccaagttccggaacgccgtagccaaggactactacttccagatgtactacgatgatctcccactgtggggattcatcggtaaggtcgagaagggaggcaagcctgacccgagcgagtggaagtactacctctacaggcacattatctttgacatcctctacaacaacgaccgtgtcattgagatcaatgtgcataccgaccagagtgcactggttgacctgacagaggacaaggaggttaatgtggacttcctttacactgtcaagtggaaggagacacctacaccgttcgagaagaggatggagaagtattccagctcctccaacatgccgcatcacttggaggtccattggttctccattataaattcttgtgttacggtccttctcctcacagggttcttggcaacaatcctcatgcgagttctgaagaatgattttgttaagtatgcccatgatgaggaagcagctgatgaccaagaagagtctggatggaagtatattcatggtgatgtcttccggttccccaagaacaagtcattgttttcggctgctcttggcactggaactcaactgtttgctctaacaacctttatattcctgcttgccctcgttggagtattctacccttacaatcgtggtgcccttttcaccgcattggtcgtcatctatgcactcacctcaggaattgctggttacattgcaacctctttctattgccagctagagggaacgaactgggtgaggaacttgctactgacaggatgcctgttttgtggacctctcttcctgacattctgtttcttgaacactgttgccattgcttatagtgcaacagcagcattgccgttcggcaccatctgtgtcattgtgctgatctggaccttagtcacattccctctactagttttgggaggcattgctggtaaaaacagcaagagtgaattccaagctccttgccgtaccaccaaataccctagggagattcctccacttccctggtaccggacaacagttccgcagatggctatggctggatttttgcctttcagcgctatatatatcgagctctactacatctttgctagtgtttggggccaccgaatttacacgatctacagcattctcttcatagtcttcatcatcctccttattgtcactgccttcatcactgttgcgctgacatacttccagcttgctgctgaagaccatgagtggtggtggaggtcattcctatgcggaggatcaactggatttttcgtctatggctactgtctgtactactactatgcgcgatcggatatgtctggcttcatgcagacctctttcttctttgggtacatggcgtgcatctgctatgcattcttcctgatgctgggtatggtgggcttccgtgccgccctgttctttgttcggcacatatacaagtcgatcaagtgtgagtaaagtgttgttggaggaagaagagcagcaagcagagttgtactcctttttggtgccgctaagaagtcccagtatagaaaaggttagctctcgcgtgcaacaggaagcaactagagattggcatgtttgagattaggccattattcataggaagaggtaatgaacctataaaatttcttgtcattgtgcgaccggtatgatgaaccgtctttcctttgatcccccccatgtattatgtgacgtccagacagtattactttgttgaaccataacagcctatataaatttctgtgcaagttcctatggcagaaagaaagggcatgcccagttgatctgtacctttgtccttgtatcctatgcgttctggttatatattgtcagattttgaaatattttctttaacctgcccgggcggccgctcga

SEQ ID NO: 2335 - DNA, 2416 bp, Triticum aestivum
gccctcttctatttctattaagaaggaaggaaagcaagcagggcgccactcagatctctccgccccttcctcgcctcgtgccccccacccgcctctcgtcaacgccgccccgcccgaggagaggaggaaggacgagcgatggcatcgccggccgcgcgcgcggcctcggcgctcctcctcctgctcgccctcgccgtcgccggcgtcctctccgacggctccgaccaccgctacaagctcggcgaccccgtcccgctctacgccaacaaggtcggccccttccacaaccccagcgagacgtaccgctacttcgacctccctttctgctccccggagaaagtgaaggagaagagcgaggccctcggcgaggtcctcaatggggatcggttggtcgatgcgccctacaagcttgatttccgcacggatcatgattccaaggcggtttgccccaagaagcttaccaaggaggacgtggccaagttccggaatgccgtagccaaggactactacttccagatgtactacgatgatctcccactgtggggtttcatcggtaaggtcgagaagggaggcaagcctgacccgagcgagtggaagtactacctctacaggcacattatctttgacatcctctacaacaacgaccgtgtcattgagatcaatgtgcataccgaccagagtgcactggttgacctgacggaggacaaggaggttaatgtggacttcctttacactgtcaagtggaaggagacacctacaccgttcgagaagaggatggagaagtattccagctcctccaacatgccgcatcacttggaggtccattggttctccattataaattcttgtgttacggtccttctcctcacagggttcttggcaacaatcctcatgcgagttctgaagaatgattttgttaagtatgcccatgatgaggaagcagctgatgaccaagaagagtctggatggaagtatattcatggtgatgtcttccggttccccaagaacaagtcattgttttcggctgctcttggcactggaactcaactgtttgctctaacaacctttatattcctgcttgcactcgttggagtattctacccttacaatcgtggtgcccttttcaccgcattggtcgtcatctatgcactcacctcaggaattgctggttacattgcaacctctttctattgccagctagagggaacgaactgggtgaggaacttgctactgacaggatgcctgttttgtggacctctcttcctgacattctgtttcttgaacactgttgccattgcttatagtgcaacagcagcattgccgttcggcaccatctgtgtcattgtgctgatctggaccttagtcacattccctctactagttttgggaggcattgctggtaaaaacagcaagagtgaattccaagctccttgccgtaccaccaaataccctagggagattcctccacttccctggtaccggacaacagttccgcagatggctatggctggatttttgcctttcagcgctatatatatcgagctctactacatctttgctagtgtttggggccaccgaatttacacgatctacagcattctcttcatagtcttcatcatcctacttattgtcactgccttcatcactgttgcgctgacatacttccagcttgctgctgaagaccatgagtggtggtggaggtcattcctatgcggaggatcaactggatttttcgtctatggctactgtctgtactactactatgcgcgatcggatatgtctggcttcatgcagacctctttcttctttgggtacatggcgtgcatctgctatgcattcttcctgatgctgggtatggtgggcttccgtgccgccctgttctttgttcggcacatatacaagtcgatcaagtgtgagtaaagtgttgttggaggaagaagagcagcaagcagagttgtactcctttttggtgccgctaagaagtcccagtatagaaaaggttagctctcgcgtgcaacaggaagcaactagagattggcatgtttgagattaggccattattcataggaagaggtaatgaacctataaaatttcttgtcattgtgcgaccggtatgatgaaccgtctttcctttgatcccccccatgtattatgtgacgtccagacagtattactttgttgaaccataacactatataaatttctgtggaagttcctatggcagaataacacacgtatagagatgatgcctcaagaagggcatgtccagtcgatctgtaccgttgtactcctactactctgtatcctatgcgttctggttatatattgtcaggttttgaaactagttatttttctttgtacaaacctggactaaagtttctactgttatttagactaatgagctgtaatgttgtac

SEQ ID NO: 2336 - DNA, 2144 bp, Elaeis guineensis
atacgcgtcaacggacagagcggagcacaaggacaaagaggggaggaggaagagatggggaaggaaaaggcgatggatttggcggcggtggcagcggtgacgactctcttgctttgtttggggatcaccggagtggcggccgacgcgtccgatcaccggtacaaggccggggaggctgtccctctctacgccaacaaggtcggccccttccacaacccaagtgagacgtatcggtactttgatctcccattttgccctccagaacatatgaaggagaaatcagaagctcttggtgaagtgctgaatggggaccgcctggtcgatgctccatacaagcttgacttccgtgtcgacctggactccaaagcagtatgcaagaagaagctgacgatagaagaagtggcacaattcaggagtgcagtccttaaggactactacttccagatgtactatgatgacctgcctatttggggattcattgggaaggttgacagggaaggcaagaccgacgaggatgagtacaagtactatctttacagacatatccactttgacatcctatataatggtgaccgtgtgatcgagatcaatgtgcacactgatcccaatgcattggctgatgtcactacggacaaggaaattgaggtggagttcttgtattcggtgaagtggaaggagacaagcacaccctttgagaacaggatggaaaagtattcacagtcttcatcactaccacaccatttggaaattcattggttctcaataattaactcatgcgttacggttcttttactgactggattcctcgccacgattcttatgagggtgctaaagaatgattttgtcaagtatgctcatgatgaggaatcagctgaagaccaggaagagactggatggaaatatattcatggggatgtctttaggttcccaaagcataagtcactctttgctgcatgtattggttcaggcactcagctatttgcccttgcaattttcatatttattcttgctttagttggggtattctacccttacaatcgaggtgctcttttcactgcacttgttgtcatctacgcacttacatctggcatagctggttatatttctacatctttctattttcagctcgaaggaacaaactgggtaagaaatttgctgatgacaggattcctgttttgtgggcctctattcctgacattctgctttctcaacactgtggccattatatatagtgctactgcagcactcccatttggcacaattttggtaattcttctcatttggatgctagtaacttttcctttgcttgttctgggtggggttgctggcaagaacagcaaggtggagttccaggctccgtgtcgcactaccaagtatcctcgagagatcccacctctaccctggtaccgagcaaccattccgcagatggcaatggctggttttctaccctttagtgccatttatattgaactttactacatatttgcaagtatctggggccacagaatttacacaatctacagcatcctctttatagtctttatcattcttcttatcgtcactgccttcataaccgtggcattgacctactttcaacttgctgctgaggatcatgaatggtggtggagggcattcctttgcggaggatccactggtttgttcatatatgggtactgcttgtactactactatgctcggtcagatatgtcaggtttcatgcaaacttcattcttcttcgggtacatggcctgcatctgctatggtttcttccttatgcttgggaccatcggtttccgtgcttccttgttgttcgtccgtcatatatatcgatcaatcaagtgtgaataatcagtcatccctggatcttgttgggtggttggactttacatatgaacttggagcagcagctggatttagggcgggatcatcatttcctgacatggggctgagccttctagtttttcattttggtggaattaattataattaggttccttttgtattctgctccctataaatctctagatattctgtgtagaaatttgtagcatcacacgtgcctacatattcaagaaaacaactaattttttctcactccttgaatctgaaagaatgagtattttcctgtaaaaaaaaaaaaaaaa

SEQ ID NO: 2337 - DNA, 1906 bp, Centaurea maculosa
  misc_feature (957)..(957): n is a, c, g, or t
gggcgctgcgcagacagacccaaaaagatgttgaagaagaagatggtggtgatccggtggtggttgctggtggcgttactggtggtttcccccatccaacaagttcgatcaggttcctcagatcacaagtacaaacctaacgatgaagtccctatttacgctaacaaagtcggccccttccataaccctagtgaaacatatcggttttttgatctaccgttctgtctaccagctcacttgaaggagaagccagaagctcttggtgaagtactgaacggagatcgtttagtcagtgctccttataagctaccatttatggttgaaaaggactcggaaattgtttgcagaaaaaaactgacaaaggaggaagtctctaaattccgaagcgctgttgccaaggattattactttcagatgtactatgatgacttgcctttctggggctttttggggaaggttgaaaaggacaaaactgatcccagtgaggaaaagtattacctctttaagcaccttcactttgagatccactacaataaggatcgtgtcatagagataaatgcaaaagccgatcctaatgctgttgtggatctgactgaagacaaggagcttgaggtagagtttatgtacacagtcaggtggaaagaaacagacatccctttcgagaataggatggagaagtactcccagtcttcttctcaaccacatcatcttgagatccattggttttcaattattaactcatgtgtgacagttcttctcttaaccggtttccttgccacgattcttatgcgagtccttaagaatgactttgttaagtatgctcacgatgaggaggcagctgatgaccaagaggaaactgggtggaagtacattcatggtgatgttttcaggtacccgaagtacaagtccctttttgctgcatcccttggttctggaacccagctattttcccttgcnctttttatctttgcactggctcttgttggtgtattttatccatataaccgaggagctctgtttaccgcgctagttgtcatatatgctcttacttctgggattgcaggctacactgcagcctccttttatcaccagctagaaggaactaactgggtgaggaacttactattgactggttgcctgttttgtggacctctgtttcttactttctgctttctaaacacggttgcaattgcttataccgcaactgctgctctgccattcggtaccatcgtggtgatcgttttgatatggactttggtgacatcgcctttgctggtattggggggtattgcaggaaagaacagcaaggctgagtttcaggctcctgttcgcactacaaagtatcccagagagatcccaccgttgccttggtacagaaagactattcctcagatggccatggctggttttctccctttcagtgcaatttacatcgagctttactacatattcgccagtgtgtggggccacaggatatataccatatacagcatcttatttattgtttttatcatcctcctcattgttactgcctttatcaccgtggcattgacttatttccaacttgctgccgaagatcatgaatggtggtggaggtctttcctctgtggtggttcaactggtgttttcatctatgggtattgcctgtattactactacgaacgttctgacatgtcagggttcatgcaaacctcgtttttctttggttacatggcttgcatctgttatggcttctttttgatgcttgggacagtcggtttccgtgcgtctttgttctttgtccgccacatctaccgctcaatcaagtgtgaatagatgttaatgttcagtctacgatgctcagacaggagctggctgatcctgtggccattgctgctgatgctggaacggtgaaaccatgaaagct

SEQ ID NO: 2338 - DNA, 2312 bp, Lactuca sativa
tttgtttttcagatctgggatttagatcggggggaaatcaaccaagacatggttaggcagtcggcatagactactttgagtcattttatacgtaaacatcatttttaagcaaacacaaaatgctttaaatgtaagtcctccttttggggatcgagtttcttctcgcattaccatcatagagaagagagtgtgagatctagatctatacatctccctctctccgatcttgttcatatcccatacatacttcttcatatatgtgaagatgatggtgaaaccacagatttacaaatggctggtgctagcattgttcgtgatttgcagtgtaatgggagcagtcacatccgatgcttcaaatcacaaatacaaaaatggagacgttgttcctctctacgccaacaaggttggccctttccagaatccaagtgaaacataccgctattttgatctacccttctgcttaccaggtgatttgaaagagaaaaaggaagcacttggagaagtcttaaatggagaccgattagttagtgctccatacaaactcgatttcttagttgacaaagactctgaattcatttgcactaaaaaactaacaaaacaagaagtcaacaaattccgtaaagccatttcaaaagactactacttccaaatgtactttgatgacttgccattatggggtttcattgggaaatatgaaaaaaccgagttaaatgagctaaaatactacctctttaagcatctacagtttgaggtgctttacaacaaggatcatgttattgaggttaatgtcagaactgaccctagtgctcttgtggatgttactgaagacaaagaagtcaatgttgactttatgtatacagttcgatggaaggaaactaatattccttttgataagagaatggagaagtactcacaaaattcttcattgccacatcatttggaaattcattggttttcaatcattaattcttgtgtcacagtgcttcttttaaccggttttcttgccactattctcatgcgggttctcaagaatgattttgtcaagtatgctcatgatgaggaaacagctgaggatcaagaagaaactggatggaaatacatacatggtgatgtcttcagatacccaaaattcaaatctttatttgctgctgcccttggttctggcacccaactatttgcacttacaatctttatcttcatacttgcactagttggtgtgttttatccatacaacagaggagctcttttcactgcattggttgtcatatatgccctcacatctggaattgctggctatacagcttcctctttctattgtcagcttgaaggaacaaattgggtacgaaacttgctgttgactggaagtctgttttgtgggccccttttcctaaccttctgcttcctgaacacggttgcaattgcatactctgccactgccgccttacctttcgggacaattgtcgtaattgcccttatatgggccttagtgacatcaccattgttggtgttggggggtatcgccggaaaaaacagcaaggcggagttccaagcaccttgccggaccaccaaatatccgagagagattccgccactgccatggtatcgtggcagcctcccgcaaatggcaatggccggatttcttccattcagtgccatttatattgagctttattacatttttgccagtgtttggggtcatagaatttacacaatttacagtattttgtttattgtgtttatcattctcgtgattgtcaccgcgtttatcaccatcgcgctcacatattttcaactggcggccgaggatcatgaatggtggtggaggtcttttgtttgtggtggatcaacggggctttttatctacgggtattgcttgtattactactacgggcgttctgatatgaccgggttcatgcaaacatcgtttttctttgggtacatggcatgcatttgctacgggttctttttgatgcttgggatgataggttttcgtgcttcactcttctttgttcgacatatataccgttccattaagtgtgagtaagaaaagtaaaaaaaatatgttaaaatttgtaaggatacaaaagcttatgttgtaggagagcgttgtatggagttcaatttttcctatatttctaatgatgaaaaggcgacatgtttgacaattttcaatttatagcgatattttcgttgtagattgtttcttgtgattcggatatatgttgtagtgtatgtgtttgttatactcgtgcattagtgtcctaccggtaaggatttgatggagttagactagattgcacaaatggtccctg

SEQ ID NO: 2339 - DNA, 2253 bp, Zea mays
cggaccagtactccgtcgccaccttccaccaccgaacctgagaacgccattcgaggagttcaggtctccaagccaaacccgacccagaccttcagatctcccttcccttccgttcctgttcctctctattaagcagcaagcaaagcgccactctcaatccacctcaggcctcgctcagatctctccgcccgggtccatcttcccaccccaaaccttctcccgcctctctcgtcaacgccgcccgacgagagggatggcggccttgcgggctccggccgcaacgctcctcgtcctcctcgccctagcggcggccggcggcgtggcggccgacggctccgatcaccggtacaagattcgcgagcccgtcccgctctacgccaacaaggtcggcccatttcacaatcccagtgaaacatatcgatatttcgacctgcctttctgctctcctgacaaagtgaaggagaagagcgaggcccttggggaggttctcaatggggatcggttagttgatgcgccttacaagcttgatttccgtgacgaagttgagtccaaggcagtttgctcaaagaagcttactacagaggatgtagtgaagttccggaatgcagtggctaaggactactacttccagatgtactatgatgatctcccactgtggggcttcatcggtaaagttgagaagggcggcaaggatgatccgagcgagtggaaatactatctgtacaggcacatcatcttcgacatcctatacaacaacgaccgggtgatcgaaatcaatgtgcacactgatcagagtgcattggttgacctgacagaggataaggagaccaatgtggaattcctgtactcagccaagtggaaggagacaccaacaccattcgagaagaggatggagaagtactccagctcctccaacatgccacaccacctggaggttcattggttctcaattataaactcttgtgttactgtcctcctcctcacagggttccttgcaactatcctcatgcgagtattgaagaatgattttgtcaagtatgcccatgatgaggaagcagccgatgaccaggaagagtctggatggaagtatatccatggtgatgtcttcaggttcccaaagaataagtcgctattttccgctgctcttggcacaggaactcaactatttgctctcacaacctttatattccttcttgcacttgtcggagtattctatccttacaaccgtggtgcactatttactgcattggttgtcatttatgcactcacttcaggaattgctggatacattgctacctctttctattgtcagttggaggggacaaactgggtgaggaacttgctattgacaggatgcctattctgtggacctctcttcctgacattttgcttcttgaacaccgttgctattgcttatagtgccacagcagcactgccctttggcactatctgtgtcattgtgctcatctggaccttggtcacatttcctttgcttgttttgggaggtattgctggcaaaaacagcaaaagtgaattccaagctccttgccgtaccacaaaataccccagggagattcctccacttccgtggtaccggagaactattccacagatggctatggccgggtttttgcctttcagtgccatatacatcgagctgtactacatctttgctagtgtttggggccacaggatttacacaatctacagcattctgtttattgtctttatcatcctccttatcgtcactgcattcatcacagttgcactgacatacttccagcttgctgctgaggaccatgagtggtggtggaggtcattcctatgcggaggatcaactggatttttcgtatacggctactgcctgtactactactatgcgcgatcggatatgtctggcttcatgcagacatctttcttctttggctacatggcctgcatctgctatgcattcttcttgatgcttgggatggtgggcttccgtgcctccttgttctttgtccgccacatatacaaatctatcaagtgtgagtgagctgttgttggaagatcaagagcagcagagctgtacccgtttttggtgccaccgagaagtcccaaatatagaaaaaaaatggtttgctctcgcgtgcaacaggagcagctagtgattgccatgtttcagattaggccattatttatagtaacagctaatgaacctataaatttgttccgttcatgggactgctatgataaaatcgtctttttttgtcc

SEQ ID NO: 2340 - DNA, 2934 bp, Amborella trichopoda
cactgtgttctaaatactgcaaattttagagagagaaatagagtttataagagagagaggaagaaaaaaaataaaataaacaaaggcaaaaaaatcagggaagagggataaaaacccttgttcccaaatcacggttcctgcacgagaaaaactggcacccacgactaaaacctacctctctctctctctctctctaaaaaagagcctctccccttctctctcatcctgctacaattaattatcatcattttcttcagggaaacgatttgatcttctagttgaagatcataggccaaggaaggagggtgaagaactttgccagctattgatctgggggtcaaggaggaggacattcatcttcaagatggtggtgaatatgggattggttggttgtatctttcttctatttgtgatctctggtttcaaagttggagcagatgggtccgatcacaaatataagcaaggagatcgggtgcctttgtatgcaaacaaagtcggccctttccataaccccagtgagacgtatcgatattatgatctgcctttctgttcaccagagcatgtaactgagaagagggaagatctcggagaagtcttgaatggggatcgcctagtcgatgccccttatcaactgcaattccggcttgagagagagtctgaggttctttgtaagaagaaattatcaaaagacaaagttgcccaactaagggatgctgttaataaagactactactttcaaatgtattatgatgatttgcctatttggggattcatcgggaaggttgataaggataacaaagccgacccaagcgagtatagatacttgctttttaagcatatccactttgaaatctcttataataaggaccgtgttatagagataaacgttaagactgacccaaatttctcagtggatattactgaggataaggaagtggaagtagagttcttatattctgtgaagtggaaggaaactgatacccccttcgagaagaggatggacaaatactcgaagtcttcctcaatgcctcaacacttggagattcattggttttcaatcataaactcgtgtgtcacagtcctcctgttaactgggtttcttgctaccattctcatgcgtgtcctgaagaatgattttatcaagtattcccatgatgatgatgctgctgatgaccaagaggaaactgggtggaagtacattcatggggatgtcttcagatttccaaagcacaagtcattgtttgcagctgttctaggatctggcactcagctcttggcacttgcaatgttcatctttcttcttgcgcttgttggggttttctatccatacaacagaggggctctctttacagctctggttgtcatatatgctctcacctcgggtattgcaggctacactgcaacatccacctatctgcaactagaaggaaccaattgggtgaggaatcttttgctcactggctgtttattctgtggcccccttttcctcactttctgctttctcaacactgttgccatagtatatagcgccactgcagctttaccttttggtactatattggtaattcttcttatatggaccctggttacttctcctttacttgtactggggggaattgctggaaaaaacagcaaaactgagttccaagctccctgccgaactacgaagtacccaagagaaattccacctctcccttggtatagaagcacgattcctcagatggccatggctgggtttcttccatttagtgctatctacatcgagctatattacatatttgcaagtgtttggggccacaagatctatacaatatacagcatcctatttatagtattcatcattctaatcatagtcacagcattcattactgtggcactgacatacttccagcttgctgttgaggaccatgagtggtggtggaggtctgtgctttgcggtggctccactggtgtatttatccttgggtattgtttgtactattactatgcaaggtcggacatgtcgggctttatgcagacctctttcttctttggatacatggcctgcatttgttatggctttttcctcatgctcgggactgtcggattccgagcctcgttgctctttgtacgccacatataccgctccataaagtgtgagtagaggtttgtccaatgggaacatgccatgggggcacaatggaggtatggatccagccgttcaatttgctgggttccaagtcttatatattctattatagtggtcaagtggtgccttgattcatgcacttgccttagctaaatttctgaaattcctttatgtagaggaagactgctttcagtctagcttttttgtgtaggtttttattttgttttcttttctttttttggtagttgtaattttgtcttaccttgaattttcatttgtattattttgcatccccactgtgctttcatactcttttgttcaagagttggtactgtgtgcatgtgagaggggagagagatgatggtatgtttgggaaaattctaaaatataactaggcgcttttttgaaagtttttgacttttaaggtatattttatgaatactttaatattatagagttaactttctggaattttgtatatcttgccgctacttatataaagttttgaataacgccaatgtatttttgaaacatgaagtgatacattagttaacagtttcaggtcagggccttaagttgaagaagctgttttggcttaagcaaagcagattgaatgtgattacattgctaccgagtcgtctaaatgcatgctccgaagcaaatcgaatatgataacattgctagtgtgtttgtaactgtgccgtgtgcacacgcaagagttgtgaatgagcaaatcatacatgataacatttcaaatcatactcaatgtttgtgactctctactgtatgcgcacttgagagagaga

SEQ ID NO: 2341 - DNA, 2680 bp, Aristolochia fimbriata
caggaagcagcgaccgagatccacctccccttgtttaccttttacagggctcgctcaggaaatcgacccagcgaaattcctggaggtaacctctcagatctgctgacccatttcacgcttccctccccgtttagcgattctctattaaaacccctcgctttggccatttcttccctttgggtcctcgcgggctgtcttagatttgatcttccttcgaagatttcagctcggtcgatctggggttttcatttcttggcctgcatcgcagcttctgtcgtcagaaatccctactcgggaactctaccgtctctcctcctggtcatgatttgacgacatcttagcttggagtgggatccctctcgtgtctgtattttgtggtctgtctgacggaagagttgcttcgagtgctgacttgggggaagatgaaaacgctcccggcttttgtggtggctctgtgcttgctttcggctctcagagtttccgcagatgggtcgaatcacaagtataaggagggagatcatgttcctctgtacgccaacaaagttggtccttttcacaatcccagcgagacatatcgctactatgatttgcccttctgcacaccagagcatgtgaaggagaaaagagaagaccttggggaagttcttaatggagatcgtttagtaagtgcaccataccaattgaacttccgtgtggataggcaatctgaaactctttgtcagaaaacactatcaagagaagaggttgcaaagctacgtgatgcagtctcaaaggactactactttcaaatgtactatgatgacttacctttttgggggtttattgggaaagttgacaaggagaacaagttggattctagcgagttcaaatatttgctattcaagcatatccattttgatattctttacaacaacgaccgtgttattgaaataaatgtacaaactgatccaaacttggctgctgatattactgaagataaggaagttgtggtggagctctcttactcagtcaagtggaaagaaactgatatcccatttgaaaagaggatggagaagtactccaagtcttcttctatgccacagcacttggagatccactggttctcaattataaattcatgtgtgacagtccttctattgactgggtttcttgcgacaattctcatgcgtgtgctcaagaatgacttcattaagtattcacatgatgaagaatcacttgatgaccaagaagagactgggtggaaatacattcatggagatgtttttcgtttcccgaagtacaagtccttgttttgtgctgtccttggatctggaactcaactgctggccctggcgatattcatcttccttcttgcacttgttggagtgttttatccatacaatagaggtgctttattcacagctcttgttgttatttatgctcttacctctggaattgcgggctacactgcgacgtctatgtacttgcagctggaaggaacaaactgggtgagaaacttgttgttgactggatgcctattctgtggacctctcttcctgacattttgcttcttaaacactgttgctattgcttatagtgcaacggcagctttacctttcggtactatcttggtgattcttctcatttggaccctcgtaacatcacctttgcttgtattgggtggaattgctggtaagaacagcaaggctgagttccaagctccatgccgcacaaccaagtatccaagagagattcctcctttgccatggtacagagggactattcctcaaatggcaatggctgggtttttgcccttcagtgctatctatattgagctgtactacatatttgcaagtgtttggggtcataaaatctataccatttacagcatcctgttcattgtcttcatcattctcattatcgttacagccttcatcacagtggctttgacatactttcagcttgctgttgaagaccatgagtggtggtggaggtctgttctttgtggaggctccacaggtgtatttatttttggatattgcttgtattactattatgcaagatcagatatgtcaggtttcatgcagacttctttcttctttgggtacatggcttgcatatgctatggtttcttcctcatgctaggaacagttggattccgagcttccctgctgtttgtgcgtcacatataccgatcaatcaagtgcgagtaagtggaagcacaagcaaagaatgatcgatcaagcacaagtatgtggactcacaaactaaggtcgatcgatcaagtgcaagctgtctgaaccacaaacctctccttgctctatcaacaaatcccagttgtagtattatattagtgcctggactagccagaggaaattcttcatctgtcaattaccctatatattttccttgtgcctgtgttgtcatctagggaacatctccaaccaatctgcagtcaccaacttagtccttttgtttttctcttttttcttggttttgtttctgttttcttgaatatacagttatatatcactctttgagtggtgtaatcagaagcatgcttaaattagaaagaaattttgttattgacatcgaggacaggccattgttactgatgttctaggccaaagtggttcaagtgttgagttgaaagttttttatgaaaagagcttgcaatggccaggtgcttatgagcatttca

SEQ ID NO: 2342 - DNA, 2282 bp, Zea mays
cagtccttcagatctcccctcccttcctgtccttctctattatagcaagcaaagcgccactcgcaatcgcaacccaccaccctcaggtcaggcctcgctcagatctctccgccctcgtcccccctcacaccccaaaccctcggcccgcctctctcgtcaacgccgcccgacgagagcgatggcggcctcgccggccgcggccgcggcactcctcatcctcttcgccctcggggcggccggcggagtggcggccgacggctccgaccaccggtacaagatgtacgagcccgtcccgctctacgccaacaaggtcggccccttccacaatcccagtgagacatatcgttacttcgacctgcccttctgctctcctgagaaagtgaaggagaagagcgaggcccttggcgaggtcctcaatggggatcggctagttgatgcgccttacaagcttgatttccgttcggaagttgagtccaaggcggtttgctcaaagaagcttaccaaagaggatgtagtgaagttccggaatgcagtagcgaaggactactacttccagatgtactatgatgatctcccactgtggggcttcattggtaaagttgagaagggaggcaaggccgatccgagcgagtggaagtactacctgtacaggcacatcatcttcgatatcctgtacaacaacgaccgggtgattgaaatcaatgtgcacactgatcagagtgctttggttgacctgacggaggataaggagacaaatgtggatttcctgtactcagtcaagtggaaggagacaccaacaccatttgagaagaggatggagaagtactccagctcctccaacatgccgcaccacctggaggttcattggttctcaattataaactcttgtgttactgtcctcctcctcacagggttccttgcaacaatcctcatgcgagtattgaagaatgattttgtcaagtatgcccatgatgaggaagcagctgatgaccaggaagagtctggatggaagtatattcatggtgacgtcttccggttcccaaagaataagtcgctattttccgctgctcttggcacaggaactcaattatttgcactcacaacctttatatttcttcttgcacttgttggagtattctacccttacaaccgtggtgcactatttactgcattggttgtcatctatgcactcacttcaggaattgctggatacgttgctacctctttttattctcagctggaggggacaaactgggtgaggaacttgctattgacaggatgcctgttctgtggacctctcttactgacattttgcttcttgaacactgttgctattgcttatagtgcaacagcagcactgccctttggcactatctgtgtcattgtgctcatctggaccttggtcacgtttcctttgcttgttttgggtggtattgctggtaaaaacagcaaaagtgagttccaagctccttgccgtaccacaaaataccccagggagattcctccacttccctggtaccggagaaccattccacagatggctatggctgggttcttgcctttcagcgccatatacattgagctatactacatctttgctagtgtttggggccacaggatctacacaatctacagcattctgtttattgtcttcatcatcctccttattgtcaccgcgttcatcactgttgcactgacatacttccagcttgctgctgaagaccatgagtggtggtggaggtcattcctttgcggaggatcaactgggtttttcgtgtacggctactgcctgtactactactatgcgcgatccgacatgtctggcttcatgcagacatctttcttctttggctacatggcctgcatctgctatgcattcttcttgatgctcgggatggtgggcttccgcgccgccctgttctttgtccgccacatatacaaatcaatcaagtgtgaatgagctgttgctggggagacgaagagcagcagagttgtacccgtttttggtgccccaccgagaggtcccagatatagaaaaggttagctctcgcatgcgacaggagcagctagagattgccatgtttcagagtaggccaattatttataggaacaggtaatgaacctataaatttgttctgtttttgtgactgctgtgataaaaagaccgtctgttccttcgtcctatgtatcatctcctagtgacgtcagacagcactataactttgttggaaccgtgacatgcctgaatatctgtggaaaaagaaacccgtgttatgttgtta

SEQ ID NO: 2343 - DNA, 2526 bp, Saccharum officinarum
cctctccctggccggctgtattaagcagcaagcaaggcgaaactcgcaatccaccctcaggccaggcctgagctcagagctctccgcccgcgtgcgcgtacgcgtcccttgtgccacccccaaaccctggcgcgactgtctcgtgaacgccgcccgacgagagccatggcggcctcgccggccgtggccgcagcgctcctcgttctcctcgccctcgcggctgctggcggcgtggcggccgacggctccgaccaccggtacaagatgaacgagcccgtcccgctctacgccaacaaggtcggcccctttcacaatcccagtgagacatatcgttacttcgacctgcctttctgctctcctgagaaagtgagggagaagagtgaggcccttggcgaggtcctcaatggggatcggttagttgatgcgccttacaagcttgatttccggttcgaagttgagtccaaggcggtttgctcaaagaagcttaccgtagaggatgtagtgaagttccggaatgcagtagctaaggactactacttccagatgtactatgatgatctcccactgtggggcttcattggtaaagttgagaagggaggcaaggctgatccgagcgagtggaaatactacctgtacaggcatatcatcttcgatatcctatacaacaatgaccgggtgattgaaatcaatgtgcacactgatcagagtgcattggttgacctgacggaggataaggagaccaatgtggaattcctgtactcagttaagtggaaggagacaccaacaccattcgagaagaggatggagaagtattccagctcctccaacatgccacaccaactggaggttcattggttctcaattataaactcttgtgttactgtcctcctcctcacagggttccttgcaacaatcctcatgcgagtattgaagaatgattttgtcaagtatgctcatgatgaggaagcagctgatgaccaggaagagtctggatggaagtatatccatggtgatgtcttccggttcccaaagaataagtcactgttttctgctgctcttggcacaggaacccaactatttgccctcacaacctttatattccttcttgcacttgtcggagtattctacccctacaaccgtggtgcactatttactgcattggttgtcatctatgcactcacttcaggaattgctggatacattgctacctctttctattgtcagctggaggggacaaactgggtgaggaacttgctattgacaggatgcctgttctgtggacctctcttcctgacattttgcttcttgaacactgttgctattgcttatagcgcaacagcagcattgccctttggcactatctgtgtcattgtgctcatctggaccttggtcacatttcctttgcttgttttgggaggtattgctggtaaaaacagcaaaagtgaattccaagctccttgccgtaccacaaaataccccagggagattcctccacttccctggtaccggaaaactattccacagatggcaatggccgggtttttgcctttcagtgccatatacatcgagctatactacatctttgctagtgtttggggccacaggatttacacaatctacagcattctgtttattgtctttatcatcctccttattgtcactgcattcatcactgttgcactgacatacttccagcttgctgctgaagaccatgaatggtggtggaggtcattcctatgtggaggatcaactggatttttcgtgtacggctactgcctgtactactattatgcgcgatcggacatgtctggcttcatgcagacatctttcttctttggctacatggcctgcatctgctatgcatttttcttgatgcttgggatggtgggcttccgtgcggccttgttctttgtccgccacatatacaaatctatcaagtgtgagtgagctgttgttggaagatgaagagcagcagagttgtacccgtttttggtgcccactgagaagtctcaaatatagaaaaggttagctctcgcgtgctacaggagcagctagagattgccatgtttcagattaggccattatttataggtacaggtaatgaacctataaatttgttctgtttttgtgactgctgtgataaaaatcgtcttttccttcgtcctatgtattatcttctagtgacgtcagacagtactataactttgctggaaccgtgacatgcctgaatatttgtggaatacccttattatgttgtcatatatatattctctaaagcatataataatagaagtgtagagacgatgcctgagaaaggtttatttgcaaaaaaaaaaaaaaaaaagggcggccgccgtggccgggtgcgccatcatcgcggcgcccgacccgccgcggggccgctgctacaccgtccacatgtcggccaccgtcgtcgtctccatcctgcaggggcgccggcgccgtgcttcgctttttccgcaccgcgggagttctctccgaccggctcaggtcgtacgtcccgca

SEQ ID NO: 2344 - DNA, 2948 bp, Sorghum bicolor
gcagaaacttgagttggactcaaccggccgcttgatggtgtcaaaccgacggacgcaccaaagacgtgggttcgctcgcggaccaataccatcacgctccgtcgccaccttccaccacccgacctgaaaacgccattcgaggagtccaggccaacccgccccggccccgaccccgacccaggccacgccactcctccagatctccccctccctccatcccctctcccctgtccgtctctattaagcagcaagcaaagcgccactcgcaatccaccctcagggcctcgctcgctcagatctctccgcccgcgcctgcgtccccttgtccgcgtccctcctcccaccccccaaaccctcgcccgcctctctcgtcaacgccgcccgacgagagcgatggcggcctcgccggccccggccgcggccgcagcgctcctcgtcctcctcgccctcgcggcggccggcggcgtggcggccgacggctccgaccaccggtacaagatgaacgagcccgtcccgctctacgccaacaaggtcggccccttccacaatcccagtgagacatatcgttacttcgacctgcctttctgctctcctgagaaagtgagggagaagagtgaggcccttggtgaggtcctcaatggggatcggttagttgatgcgccttacaagcttgatttccgtttagaagttgagtccaaggcagtttgctcaaagaagcttaccgtagaggatgtagtgaagttccggaatgcagtggcaaaggactactacttccagatgtactatgatgatctcccattgtgggggttcattggtaaagttgagaagggaggcaaggctgatccgagcgagtggaaatactacctgtacaggcacatcatctttgatatcctatacaacaacgaccgggtgatcgaaatcaatgtgcacactgatcagagtgcattggttgacctgacggaggataaggagaccaatgtggaattcctgtactcagtcaagtggaaggaaacaccaacaccattcgagaagaggatggagaagtattccagctcctccaacatgccacaccacctggaggttcattggttctcaattataaactcttgtgttactgtcctcctcctcacagggttccttgcaacaatcctcatgcgagtattgaagaatgattttgtcaagtatgctcatgatgaggaagcagctgatgaccaggaagagtctggatggaagtatatccatggtgatgtcttccggttcccaaagaataagtcactattttctgctgctcttggcacaggaactcaactatttgccctcacaacctttatatttcttcttgcacttgttggagtattctacccctacaaccgtggtgcactatttactgcattggttgtcatctatgcactcacttcaggaattgctggatacgttgctacctctttctattgtcagctggaggggacaaactgggtgaggaacttgctattgacaggatgcctgttctgtggacctctcttcctgacattttgcttcttgaacactgttgctattgcttatagtgcaacagcagcattgccctttggcactatctgtgtcattgtgctcatctggaccttggtcacatttcctttgcttgttttgggaggtattgctggcaaaaacagcaaaagtgaattccaagctccttgccgtaccacaaaataccccagggaaattcctccgcttccctggtacaggagaactgttccacagatggcaatggccgggtttttgcctttcagtgccatatacatcgagctatactacatctttgctagtgtctggggccacaggatttacacaatctacagcattctgtttattgtcttcatcatcctccttattgtcactgcattcatcactgttgcactgacatacttccagcttgctgctgaggaccatgagtggtggtggaggtcattcctatgcggaggatcaactggatttttcgtgtacggctactgcctgtactactactatgcgcgatcagacatgtctggcttcatgcagacatctttcttctttggctacatggcctgcatctgctatgcattcttcttgatgcttgggatggtgggcttccgtgcggccttgttctttgtccgccacatatacaaatctatcaagtgtgagtgagcggttgttggaagatgaagagcagcagagttgtacccgtttttggtgcccactgagaagtctcaaatatagaaaaggttagctctcgcgtgcaacaggagcagctagagattgccatgtttcagattaggccattatttataggaacaggtaatgaacctataaatttgttctgtttttgtgactgctgtgataaaaatcgtcttttccttcgtcctatgtattatctcctagtgacgtcagacagtactataacttttgttggaaccgtgacatgctgaatatctgtggaatacccatgttatgttgtcatatatattctctaaagcatataataataatagaagtgtagagacgatgcctgaggcacgtccatttgtacgtgtatcattttcttgttcattgtggagtgttgatatacacccccagactttcggtactcctgtcgcgtatttgcatattgctttcagtgatgctttctcaggattgtggatcgaacaccttataaaccttttgattggttccttttattttaaaaaaaatggtacctaccgcctgctcatctttccgtaagccggccggcccctaaaagcgagaacatgagcggtgagtgcgaagtagccgattcgcttggcaaaacggtgcagccgcaaaccttgcaagttgcaacgcaactctggttgaggcttcgctagttgctagtcgctacgcggtactaggtactttgtacaaccgggcttgtttgtccctccgggggcttgggactt

SEQ ID NO: 2345 - DNA, 2605 bp, Sorghum bicolor
gtcaaaccgacggacgcaccaaagacgtgggttcgctcgcggaccaataccatcacgctccgtcgccaccttccaccacccgacctgaaaacgccattcgaggagtccaggccaacccgccccggccccgaccccgacccaggccacgccactcctccagatctccccctccctccatcccctctcccctgtccgtctctattaagcagcaagcaaagcgccactcgcaatccaccctcagggcctcgctcgctcagatctctccgcccgcgcctgcgtccccttgtccgcgtccctcctcccaccccccaaaccctcgcccgcctctctcgtcaacgccgcccgacgagagcgatggcggcctcgccggccccggccgcggccgcagcgctcctcgtcctcctcgccctcgcggcggccggcggcgtggcggccgacggctccgaccaccggtacaagatgaacgagcccgtcccgctctacgccaacaaggtcggccccttccacaatcccagtgagacatatcgttacttcgacctgcctttctgctctcctgagaaagtgagggagaagagtgaggcccttggtgaggtcctcaatggggatcggttagttgatgcgccttacaagcttgatttccgtttagaagttgagtccaaggcagtttgctcaaagaagcttaccgtagaggatgtagtgaagttccggaatgcagtggcaaaggactactacttccagatgtactatgatgatctcccattgtgggggttcattggtaaagttgagaagggaggcaaggctgatccgagcgagtggaaatactacctgtacaggcacatcatctttgatatcctatacaacaacgaccgggtgatcgaaatcaatgtgcacactgatcagagtgcattggttgacctgacggaggataaggagaccaatgtggaattcctgtactcagtcaagtggaaggaaacaccaacaccattcgagaagaggatggagaagtattccagctcctccaacatgccacaccacctggaggttcattggttctcaattataaactcttgtgttactgtcctcctcctcacagggttccttgcaacaatcctcatgcgagtattgaagaatgattttgtcaagtatgctcatgatgaggaagcagctgatgaccaggaagagtctggatggaagtatatccatggtgatgtcttccggttcccaaagaataagtcactattttctgctgctcttggcacaggaactcaactatttgccctcacaacctttatatttcttcttgcacttgttggagtattctacccctacaaccgtggtgcactatttactgcattggttgtcatctatgcactcacttcaggaattgctggatacgttgctacctctttctattgtcagctggaggggacaaactgggtgaggaacttgctattgacaggatgcctgttctgtggacctctcttcctgacattttgcttcttgaacactgttgctattgcttatagtgcaacagcagcattgccctttggcactatctgtgtcattgtgctcatctggaccttggtcacatttcctttgcttgttttgggaggtattgctggcaaaaacagcaaaagtgaattccaagctccttgccgtaccacaaaataccccagggaaattcctccgcttccctggtacaggagaactgttccacagatggcaatggccgggtttttgcctttcagtgccatatacatcgagctatactacatctttgctagtgtctggggccacaggatttacacaatctacagcattctgtttattgtcttcatcatcctccttattgtcactgcattcatcactgttgcactgacatacttccagcttgctgctgaggaccatgagtggtggtggaggtcattcctatgcggaggatcaactggatttttcgtgtacggctactgcctgtactactactatgcgcgatcagacatgtctggcttcatgcagacatctttcttctttggctacatggcctgcatctgctatgcattcttcttgatgcttgggatggtgggcttccgtgcggccttgttctttgtccgccacatatacaaatctatcaagtgtgagtgagcggttgttggaagatgaagagcagcagagttgtacccgtttttggtgcccactgagaagtctcaaatatagaaaaggttagctctcgcgtgcaacaggagcagctagagattgccatgtttcagattaggccattatttataggaacaggtaatgaacctataaatttgttctgtttttgtgactgctgtgataaaaatcgtcttttccttcgtcctatgtattatctcctagtgacgtcagacagtactataacttttgttggaaccgtgacatgctgaatatctgtggaatacccatgttatgttgtcatatatattctctaaagcatataataataatagaagtgtagagacgatgcctgaggcacgtccatttgtacgtgtatcattttcttgttcattgtggagtgttgatatacacccccagactttcggtactcctgtcgcgtatttgcatattg

SEQ ID NO: 2346 - DNA, 2184 bp, Amorphophallus konjac
gccgtagtccccgtcgtggtcgccgttcgccgtcccgacgaacgtgggagagggagagggagagggagaggggaggagtggcgaagagggcggcggtgctggtagcggtctcggctctcctggtctgcttcggggtcgccggcgtcgtcggcgacccctccgaccaccgctacatgcagggggaccccgtccctctctacgcgaacaaggtcggcccgtttcacaaccccagtgaaacatatcggtactttgacctccccttctgttatccagaaaacatgaacgagaaaagagaggcccttggtgaagtcctgaatggggaccgtctagttgatgctgtatacaaacttgacttcctcatggaccaggattctaaggttgtctgcaataagcgacttacgaaagaagaagttgcccagttccggaatgctgtctccaaggactactacttccagatgtactatgatgacctgccaatctggggctttgttgggaaggtagagaaagatggcagggaccccagcgattataaatacttcctttacaggcacatccactttgaaatcctttacaacaaggaccgtgtgattgagatcaacgtgaagactgatcctaatgccctggtggatctcactgaggacaggggagttgatgtagtatttttgtacacagtcaagtggaaagagacaactactccatttgagaagagaatggagaaatactcccatacctcatctctgctacaccacttggagatccattggttctcaatcatcaactcatgtgtgacagtgcttctcttgacaggattcttggccacaatactcatgcgcgtgctgaagaatgactttgttaagtatgcccacgatgaggagtctgctgatgatcaagaagagactggatggaaatatatccatggggatgtctttagatttcctaaaaacaagtcacttttttctgcctgtcttggctctggcactcagctgtttacacttgccattttcatttttgttcttgcactagttggggtgttctatccttacaaccgtggagcatttttcacagctttggttgttatctatgcacttacttctggaattgctggttataccgcaacttctttctactgtcagcttgaaggaaacaactgggtgaggaatttgttattaacaggatgcctcttctgtggtcctcttttcttgacattctgctttctcaacacagttgcaattgcatatagtgccactgcagcattaccttttgggaccatcgtggtgattgttctaatatggactctagtaacatttcctttgcttgttttgggtggtattgcgggtaagaacagtaaggctgaattccaagcgcctgttcggacgagcaagtttcccagggagattccaccattgccttggtaccggagtacaattccacaaatggcaatggctgggtttttgcctttcagtgcgatttatattgaactctactacatatttgctagtgtctggggccacagaatttacaccatatacagcatcctctttattgtcttcattattcttctcattgtcactgctttcatcaccgtggcattgacatacttccagcttgcggctgaagatcatgaatggtggtggaggtcgttcctgtgtggcgggtcaactggtctgtttatttacggatactgcttgtactactattatgctcggtcagatatgtcagggttcatgcagacgtccttcttttttggctacatggcttgcatttgctatggtttcttcctcatgcttggcacggtgggtttccgtgccggcttggtgtttgtccgtcacatataccggtctatcaagtgtgagtagataatgcaagtcacgtgtgccgtctttttttgcttatacgaggtttatcataaagaaatctgtggagggtgcttcaatgatatgcttgcttcgttaaggaaaaagacgttgcagggtctgtcggtgacctgttttttgtgctgaacaatgaaatgggccttttggtgttattatacgagtctcatggatggattctacgaggtcgggtcccctcccgcgtttgttcttgagaaaaaaaaactccaatgtaattcctgggatatctgtaccaccacatgcatgtacctgcactatgtaaacaacaaaattctttatttgctgttggcgt

SEQ ID NO: 2347 - DNA, 2065 bp, Ambrosia trifida
tactactacctatctatctatctatatctagttcacattgcacgtcaacaccatttttaagcaaaggtgtgttgtgtgtttattaatcgaatccaaccacatttgacattacacacacacacactctgtgtgatctggatctagatctctatccatccctccatcaacacacccacataacataaacctgttgtcttcatatgatggacaacaacacactgatccatcaatggctgcttctagcattgctccttatctgcagtgtaatgacgtctgtcacgtcagatgtttccaatcataaatacaaaagcggtgatgctgttcctctttatgccaacaaagttggcccctttcaaaaccctagtgaaacataccgctattttgatctaccattctgcttgccagatgatttgaaagagaaaaaggaagcgcttggagaagtgttaaacggagaccgtttggttagtgctccatacaagcttgatttcttggttgataaagattcagagtcgatttgctccaagaaactttcaaagaaagaagttgaaaagttccggaaagccatttcaaaggactactactttcaaatgtactttgatgacctgcctctgtggggtttcatagggaaatatgatacaaaagaacaaaaatactacctttttaagcatctgcagtttgaggtgcgctacaacaagaatcatgttattgaggttaatgtccaaacggatcctactgctcttgtcgatatcactcaagacaaggaggtcaacgttgactttgtgtacacagttagatggaaggaaaccaacattccttttaaaaagaggatggacaagtactcacaaaattcttcactaccacatcatctggaaatacattggttctcaattatcaattcttgtgtcaccgtgctccttttaactggtttccttgccacgattctcatgcgtgttctcaaaaatgattttgtcaagtacgctcatgatgaggaagcagctgaggatcaagaagaaactgggtggaaatacatacatggtgatgtcttccgatacccgcaacataaatctttatttgctgctgcccttggttcggggacccaattatttgcccttacaatctttatcttcatacttgcattggttggtgtcttttatccatataaccgaggagctttgttcactgcgttggttgtaatatatgcactaacttctggaatagctggctatactgcatcctctttctattgccagcttgaaggaaccaattgggtgaggaatttgatattgactggaggcctgttttgtggaccccttttcataacgttttgctttctaaatacagtcgcaattagttacagtgcgactgcagcattaccgtttggaacaatagtgataataggtctgatatgggcattggtgacatcgccattgcttgttttaggtgggattgcaggaaagaacagcaaagccgagttccaagccccatgtaggaccaccaaatatccacgagagattccaccattgccatggtaccgtgggaccctccctcagatggcaatggctggttttcttccattcagtgccatctacatcgaactttactacatatttgccagtgtttggggtcacagaatttataccatatacagcatcctgttcattgtcttcatcattccggtcattgtcaccgcgtttattacaatagccttgacatacttccaactagctgctgaagatcatgaatggtggtggagatcttttgtttgtggcggttcaaccgggctgtttatctacggatattgcttgtattactactatgggcgttcggacatgacaggtttcatgcagacctctttcttctttggttacatggcgtgcatttgctatggtttcttcctcatgctcggcactattggtttccgtgctgcactcttctttgttcgacatatataccgttctattaagtgtgagtaatacaacatgccctcacaatttgtactagtagagggaacttcaaattttctatcatatattattagacagattattttgcaaacaaaaaagaa

SEQ ID NO: 2348 - DNA, 2218 bp, Amborella trichopoda
ttggtgggggttttcatggatgcgaagatggctattgctggttttcttctgctgctgttcttgtgcagtggggtcaccgtgcaatctgatgcttcgaatcacaaatacaagcctggagatcccgtccctctttatgtcaacaaagtaggcccatttcataatcctagtgagacataccgctactttgatctccccttctgtcctccagctcatttgactgagaaaaaagaagcccttggagaagttctaaatggcgaccgtttggttgaggctgcctacaaacttgactttcgggttgataaagattctgatgttgtttgtaagaagaggttatcaagggatgaagttgctagttttaggaatgcagttataaaggattattattttcagatgatttatgatgaccttcctctttggggatttgttgggaagattgagaaggatatcaaagcggatgtgccggagtttagatacttgctttataaacacatccattttgaagcaatttacaacaaggaccgaattattgagataagtgttcaggccattcagggtgaacccaatcatttagtggatgtcactgaggataaggggattgatcttgaacttacctactctgtaaaatggaaagaaacagataccccttttgaaaagaggatggggaagtattcgaaaacttcggccttaccccaccatttggagatacattggttctcaattttaaattcgtgtgttactgtactcctcttaactgggtttttagctacaattctcatgcgggtcctgaagaatgactttgtcaagtactcccatgatgaggacgtggctgatgaccaagaggagactggttggaagtatattcacggggatgtttttaggtatccgaagcacaagtctttgtttgttgccatccttgggtgtggcactcaacttttggcacttgcaatgttcatctttatcctgtctctggttggtgtgttttatccatacaatagaggagcgctgttcactgctcttgtggtcatttatgcacttacttccggcattgcaggctacactgcaacatctttctattctcaacttgagggaacgaattgggtgaggaaccttttgttgactggatgcctcttttgtgggcctttgttcctaacattttgcttcttaaacactgttgctattgtgtatagtgccactgctgcacttccctttggtaccattgttgtgattgttctcatatggtctttggtgacatctcccttacttgttttgggtgggattgctggtaaaaatagcaaggctgaattccaagctccttgtcgcactacaaaatatccaagagagattcctcctttgccatggtatcgaggaaccattcctcagatggctatggctggatttttgccgttcagtgctatctacattgagctacactacatatttgccagcgtgtggggtcacaagatttacaccatatacagcatcctctttatagtcttcatcattctcatcattgtcacggcattcattacagtagcattgacatactttcagctggctgcagaagaccatgaatggtggtggaggtctttgttgtacgggggctcgactggctttttcatatttggttactgcttgtattactactacgtgcgatcagatatgtctggattcatgcaaacttccttcttttttgggtacatggcttgcatctgttatggtttctttctcatgcttggaactgtggggttccgggcttccttgctgtttgttcgccacatatatcgctcaatcaagtgcgaatagaatcattctccacaatccacctcgtgtttttactgagggggcagtttcaggagaagttttacacttttaccagaagctggggtattgacaatgcaagcccattggcagattggggaagaagaagggttgttatatggtgagagaaatcctcagctgtttcctgcgtcttttatccgagaaattcgcagctttcttccaacttagttctgtattatattaggaagtctgttatttttgcaatcacaaggactgttattttattgctggagaacaattttctttaccccttgccttgttatagagtatttgtttgtttgaatggttctgaatgaaatattggcccctttctacaatttcttgtgaaatcattgtgagatattggagtgatatatgatgatattgatcgctttctaca

SEQ ID NO: 2349 - DNA, 2107 bp, Eutrema halophilum
ataagttatcatgatcatcgacccaaccgcttaaacctctcaaagcatctctcactctctctcatagctaaattcagaatccatggagaagccagcgtcgcgtgtgctgctgccttcgcttctactggtcctcttcatctacggcgttgctccggtgatatccgacggctccgatcaccgttacaaagtcggtgatgatgttccgctttatgctaataaagtcgggccgtttcacaatccgagtgaaacataccgatactttgatctaccattctgttcatcagctccggttaaggaaaagaaggaagctcttggggaagttctcaatggagatcggttagtcagtgcaccctacaaacttgaatttttgggtgagaagaactctgaagttgcatgcagaaagaggttgagtagagaagatgttgctaaatttcgagatgtgatcaccaaagactactactttcagatgtattatgatgacttgcccatctggggattcctgggaaaagttgtaaaggatggcaaatctgacccatccgagtataaatattatctattcaatcacctacagtttgagattttctacaataaggaccgtgttattgaaatcattgtgagaacagaccagaacttcctcgtggacttgactgaggacaaggaagtcgaagtggatttcacatacacagttcggtggaaagaaacagaaattccattcgagaagaggatggagaaatactcactggcttcctcaatgccgcatcacttggaaatccactggttctcgatcattaactcatgtgtcactgtccttctcttgactggcttccttgcaactattctcatgagagtcttgaagaatgattttgttaagtatgcacatgatgaagaggcagctgatgaccaagaggagactggctggaagttgatccatgctgatgtatttaggttcccaaaacacaaatccctgctggctgcagcccttggttctggcacacaattgtttacactggctgttttcatatttatgcttgcattggtcggtgtcttttatccctacaaccgtggggcattgtttactgcattggttgtcatatatgcactcacttcaggaatcgccggatatactgctgcttctttctattgccagctagaaggaactaattgggttaggaatcttatgctgactggaagccttttctgtggacctcttttactaactttctccttccttaatactgttgcgattgcttaccaagccactgcagcgttgccattcgggacaattgtggttattttccttatatgggcactggttacttcaccattacttatattgggaggtatcgccgggaagaatagaaaacccgagtttcaagctccttgccgtaccacaaaatatccaagagaaatcccaccattgcgctggtaccggagaacacttccgcagatggctatggctggttttttgccgttcagtgccatttacatcgaactttactacatttttgccagtgtttggggtcacagaatttacaccatctatagtattctctctatcgttttccttattctcgtcatagtcactgctttcatcacagttgcattgacttacttccaacttgcttctgaagaccatgagtggtggtggagatcattgctatgcggtggatcaacaggcttattcatatacgcctactgcttgtattactactatgcacggtcagatatgacagggtttatgcagacctccttcttctttggctatatggcttgcatctgctatggattcttcctcatgctcggggcaatcggattccgtgcttcgcttttctttgtccgtcacatttaccggtccataaagtgcgagtaaaaattgaagattacttcactctcttcaactattccactatagtgatcggtggtggatgcggccgagggcaatcgatccggtgaagttgtccatttttttactgtttatgataatttttcattttctaagtttttttttgtcttttttttggtattcggttgtgaggatattgtccttgagaacgataatgagatagtaggaaaagaacacttaatgtttcacttagattttttcccc

SEQ ID NO: 2350 - DNA, 2745 bp, Pinus taeda
acgtgcgaccttggctgtcactcaaaaatcctgcttttggaaggccacattaacaacttacgaatttctgagcagtatgcgactgcactaacctgttgactgggcccaaccttccggtttcacggccgaccaattttcctcctgcattttataaatctcgtcgctagatacagtttcatatcctccaccatgtgaccgaggggcaggtgtggaacctcaaagaacggtactcttcgtttgaaagaagcagcctcgtgcttgtactgtttgctggatctatccatatgcctaattacctgagtgttagcttaaacagagactgacatgggagcgggagaagcagaagtagaaagatcatttacagtagagtgaactagggttttcagtgaatataaggcgcagggtttctgaacaaaccctgagggtccggggaagcaattcaatggcaatgggaaggtttctggtgctggcgttggcattagcatttttgtttggatatggagttgaagggagcgcctctgatcacagatacagcaaaggagatcatgtcccgctttatgccaacaaagttgggccctttcacaaccccagtgaaacataccggtattttgatttgccattctgccctccagataaggtgaccgagaaaagggaagatcttggagaagtgttaaatggtgatcgaatggttggtgctcgatataagcttcatttccaggaagacaaaaattctgaacttctttgcaggaaaaaattaactaaggaggatttggggaagtttagagaagcagtgaagaaggattattattttcaaatgtattatgatgacttgcctatctggggttttataggaaaaaccgataaagaaaataatgcaaatccaatttttctttacaaacatctccactttgaaatcctgtacaacaatgatcgcgtcatagaaattactgttcgtacagatccaaattttactgttgacattactgaggacaaggaggttgaagttgatttcacatactcagttaagtgggtggagactcagactccatttgaacggcgaatggataaatattcaaagtcttcatccttgccccagcatttggaaatccattggttctctattataaattcttgtgtaacagttcttcttctgactggatttcttgccacgattctcatgcgtgttctaaagaatgacttcattaaatattctcatgacgaggaatcaactgatgaccaagaggagacaggatggaagtacattcatggagatgtcttcagatatcctccatacaaatctttgttttgtgctgttcttggttctgggactcagctttttacccttgccatctttatcttcatgcttgcactggtgggtgttttctatccatacaacaggggagctctatacacagcccttgtagttatatatgcccttacatctggcattgcaggttacactgcagcctccttctatcgccagcttgaaggatcaaactgggtgcgaaatttgttgctgactggctgcctcttttgtgggccccttttcctaaccttctgctttcttaatacagtggccattgcttacaatgctactgcagcattaccatttggaactattgttgtcattcttctcatctggacgcttgttacctctcctttgcttgtgttgggtggtattgcgggtaagaatagcaagtctgagtttcaggctccttgccgcacgacaaagtatcccagagaaattccacttttgccttggtacagaggaacaattcctcagatggctatggcgggctttttgccattcagtgcaatatacattgaactatactatatttttgcaagcgtgtggggtcacaaaatttacacaatatacagcatcctcttcattgttttcattatccttattatcgtgacggcattcataaccattgcattgacatacttccagctggcagtcgaggatcatgagtggtggtggaggtctgtcttatgtgggggatcaactggtgtcttcatctttgggtactgcttatattattattttgcacgatcagacatgaatggtttcatgcaaacctcctttttctttggttatatgacttgcatctgctatggctttttcttaatgctcggaacagtgggcttccgtgcatctttactgtttgtccgtcatatctatcgctcaattaagtgtgaataattctattcctaggcatagtgaacttctaggcttcatcggacattgttgggaggtgcagttgcatgtaatggccatatattctgttttcaagatgacgggttatgacgcaagggtacatgaactcgatgatcatagagaagaaaatgaaaggaaatttcaaacgagaatcatgtagtcttttattgtaacttgttaggtttccaaagctttaagtgttagcggactgactaacaaggttgttgcggaagagtaaaacattgaaatctcaaaagaaggttattaatgtatcctggctcagtcgctgttattgttcactttattcaatgggccaaatttatgttatgcgtagagtacagtgaggttatagataaatctctgttatgcttcggggaatttcacgtgttaggttgcaaatactctgtatcatgctgctgccttgtatctgttttcgaaaagtgcaaaagggcataatgtgttttttcatatggtatcctttctttaatactagtttaattttaatgaaataggtttatgttttc

SEQ ID NO: 2351 - DNA, 2400 bp, Podocarpus macrophillus
agatattcttggagaaaacaaagtcaaaagaatgcctagcaaacccaaatttcagatcagtcatcgttcgtcttgggttaaaatgtttgcataagtgttgatggtgcgttggaatcctgaggaaaaccccagagatcagatcggagtagtatattgatacaatggcaaaattggtattagtgtcggcttttctactactttcatttctagttcataatgttcatggaggatactcagatcacaaataccatgatagagatcatgtaccactctatgcaaataaagttggaccttttcagaatccaagtgagacatatcaatattttgacctgccattttgccagccagaccacatgactgagaagagggaagatctaggcgaagtcttaaatggtgatcgtatggttgatgccccatataagcttgattttaaggttaacaaggaatctgagatcctctgcaagaagaagttgacaatagagtatttgaggaagtttagggaagctattaaaaatgattactattttcagatgtattatgacgatttaccaatttggggtttcattggaaaggttgacaaggaaataaaatctgatggaaagggccctagatatttactatacacccatgtgcactttgacatcttttacaacaaagatcgtgtcattgaaatcaatgtgcgcactgatccgaggttcactgttgatatcactgaggataaggagatcgaagttgaatatatgtactcagtaaagtggcaagaaagtgatcttccatttgagcaacgaatggaaaaatattcaaagtcttcatccttgccacaacatttggaaattcattggttttctattattaattcttgtgttacagtactgcttctcacaggatttctagctacaattctcatgcgtgttttgaagaatgattttgtcaagtactcccatgatgaagagacagcagatgatcaagaggagacaggatggaaatacattcatggagatgtttttagataccctccacacaagtctctgttttgtgctgtgctggggtcaggcacacagctgttggcacttgctatcttcatctttatgctggcattggtcggtgttttctacccatataataggggtgctctctacacagcccttgttgttatctatgctcttacatctggcattgcaggatatactgcagcctctttctatcatcaacttgaaggaacaaattgggtacggaatttgttgttgacaggttgcctgttttgtggaccattgttcttaacgttttgcttcttgaacactgttgctatagcctaccatgccactgctgcattgccatttggaacaattcttgtgattctcctcatctggacccttgtcacatcccctttgcttgtcttggggggcattgctgggaagaacagtaagactgagtttcaagcgccttgccgaaccacaaagtatcccagagagattccaccgttgccatggtacagaggaacaattccacaaatggctatggcgggatttttgccattcagtgccatatacattgagctgtactacatttttgcaagcttatggggtcacaagatttacacaatttatagcatcctcttcatagtcttcattattctcattattgtaacagcatttatcacaatagcccttacctactttcagcttgctgtggaggaccatgagtggtggtggaggtctgtagtatgtggaggatcaactggtgtctttatctttgggtactgcttctactattattttgcacgatcagatatgtctggctttatgcaaacatcatttttctttgggtacatggcttgcatatgctatggcttcttccttatgcttggaacagttggtttccgtgcttctttattgtttgttcgccacatatatcgctcaataaagtgcgagtagctttaagcttgtgggtggaagagatgtactcttaggttcatgcttgcattgatgtagaactacttctaagagccattccttctatttctaagatgacatgtttcaagaactgtatattctgaaagtaaattatggtagagacaacatggtaagaagtagtttaaaaatttattatacttgtatgctagaatggaaacttggtttaggttgaggtggctgtcaaaaaactacagttctacatggaaagatgcatatatgcatcaatttggaattcagggggacttgagatgaataatttctatttagttttcttagcattttgttgtatttcttgagctgggtcatgttagagcaagtgctcaggagtttgttgtattcacttgaaaaagctagatcattaaattgtattttatttcctttactctgggaaaatcattaatgtgctttgcagccaaattttgactac

SEQ ID NO: 2352 - DNA, 1593 bp, Trifolium pratense
gagacacaaacatgtctactttgaatgttttctctcaaccattgcatcctacaatttcatcttcactatgttgttcttcaagtttaaacaacaacaacaataactatgtttattcatgtcaaaattctaaattaagtttcttgtccaattctcataatttttctattctttcttcttcccactctacccctactaagctttctaatttccacaacatcttctcaaagtcaggcaatggaagttcatggctgcaaagtagtgccactgcttccaacagtgagcacaagaagggtgctgtatattcaacatttccttcatcacctgcccaagtttcatctgtgcaagacctgtttgaatttatttgttcaggacctttgcttgacaaaatcggtttgacgtcagagaatgtggccgagtctatagataagtggttatcgtacggtctgcaattatgcagactatttcagcttaatgaattgttcttgacggaacctcagaaagttaggctttatcattactatataccagtcttcctctggtgtgaaagtgagattgctcggcatcgatcccaattcaaagacgaagaagatattcctcctttagtgattggatttagtgctcctcaaggctgtggaaagacgaccctcgtctttgctcttgacttccttttccaaatgatcggcaggaagtcggcaacaatatctatcgatgatttttatttgacggctgaaggtcagagtaaactaagagaagctaatccaggaaatgcacttctcgagtttcgtggaaatgcaggaagccacgatcttcctttttctgttgaaactttgacatctttaaccaaaatgtctagagaaggtatcaagatgaagttaccaagatatgataaatctgctttcggtgggagaggtgaccgtgctgatccttcgacatggcctgaaattgaaggccccctaacagttgtgttgtttgaaggctggatgcttggtttcaagcccgttccagatgaagtcgtaaaggccgttgatccccagctagaaataataaataaaaacctcgaagcttattatgaggcgtgggacaaatatataaagtcatggatagtcattaagattcaggacccaagttgtgtcttccagtggcgcttgcaggctgagattgctatgagggaggcaggcaatcctggaatgtctgatgatgaggtgcgagattttgtttctcgctacctgccagcatacaatgcataccttcctacactttactcgcaaggtccgaatggatcagatcctcaacatctactaaccattgaaatagatgaaaagagaaacccgatcctcggtgtctagtttatctagataataggacattgctagcttttccattctttgaagaatcgaaacagccattcggcattgaaaatgtatcagcactattttcattgaaatgtatagaggatatttttatcgacacataataataatgcctaatgctttctagtttttcttgtggaataaatgactacataaaccaaattctgatcacaaattttgtgattgtgatttattgaaattgaaatgttgacctgcagcccgg

SEQ ID NO: 2353 - DNA, 1782 bp, Cajanus cajan
atggtgctcctcttccaatctgttggcccaagaggtgaagactacgtggcggctaagccctgtcggtttttttctgtttcatagtaaaagtagagagagaaagaaagaacggagacataaacacaaatggcgactctcaatctcttctctcagccattgcaacccacaatttctccttctttctgttgctctaatactaatcactataattctaacaattctaaattacatttctttaccaattcccgtcacttctctgttcttcctcaattctccactcactcctcaaactcaaagtcaggcagtggaaattcatggctgcaaaacagttccacttctgctggcattgagtacaggaagcgtcctctatattctgtgtttcccacaaaacctgctcaagtcgcctctgtgcaagacctctatgaatttatttgctcaggacctttgcttgacaaaataggtatcacacaagagcaggtggctgagtccattgatacgtggctactgtatggccggtacctatgcagattgtttcagcttaatgagttgtaccttacagagcctcaaaaggctaggatttatcactactatgtaccagtctttctctggtgtgaacagcagatttctcagcatcagtccaagttcaaagagggagaagatatacctcccttagtgattggttttagtgctcctcaaggctgtggaaagacaacccttgtctttgctcttgactatctttttgaagagattggcaggaagtctgcaacaatatctatagatgatttttatttgacggctgaaggtcagaataaactgagggaggctaatccaggaaatgcacttcttgagttccgtggaaatgctggaagccacgatcttgcaatttctgttgaaactctgtcagccttaaccaaaatgacaagagaaggtatgaaaatgaagttaccaagatatgataaatctgcattcagtgggagaggtgaccgtgctgatccttcaacatggccagaaattgaaggccccctgacagttgtgttgtttgaaggttggatgcttggtttcaagccccttccagttgaagcagtaaagggtgttgatccccagctagaaactataaataaaaaccttgaagcatactatgatgcatgggacaaatacataaagtcatggatagtcatcaagattaaggacccaaattgtgtcttccaatggcgcttgcaggctgagattgccatgagggaagcaggcaagcctggaatgacagatgatgaggtgagagattttgtttcgcgctacctgccggcatactatgcataccttcctacactttactcagagggaccaagtggatcagatcctaagcatctcctaaccattgaaatagatgaagggagaaaccctatccttgctgcctaggttgactgtatgatagatcattgcaggtttttcaattctttgagatgatttgaatggctattcagcattaattagttacaccatcagtggagctatgtcattgaatcagcactatttcccttgaaatgtatagagaatatttcattaatatataatagcgaacggctaatgctttctgttttgttatttgatcaaaaaatagaataagaagcctagactactagtcgttgatagttaatggcttttttattttttcaagactttgttcataaaattatgatcacttcagtgacttcaatagtacactatgtgctgctgcacctgcacttgatttatttaatagtcataacgaattcatttgttctt

SEQ ID NO: 2354 - DNA, 1706 bp, Cajanus cajan
ggctaagccctgtcggtttttttctgtttcatagtaaaagtagagagagaaagaaagaaaggagacataaacacaaatggcgactctcaatctcttctctcagccattgcaacccacaatttctccttctttctgttgctctaatactaatcactataattctaacaattctaaattacatttctttaccaattcccgtcacttctctgttcttcctcaattctccactcactcctcaaactcaaagtcaggcagtggaaattcatggctgcaaaacagttccacttctgctggcattgagtacaggaagcgtcctctatattctgtgtttcccacaaaacctgctcaagtcgcctctgtgcaagacctctatgaatttatttgctcaggacctttgcttgacaaaataggtatcacacaagagcaggtggctgagtccattgatacgtggctactgtatggccggtacctatgcagattgtttcagcttaatgagttgtaccttacagagcctcaaaaggctaggatttatcactactatgtaccagtctttctctggtgtgaacagcagatttctcagcatcagtccaagttcaaagagggagaagatatacctcccttagtgattggttttagtgctcctcaaggctgtggaaagacaacccttgtctttgctcttgactatctttttgaagagattggcaggaagtctgcaacaatatctatagatgatttttatttgacggctgaaggtcagaataaactgagggaggctaatccaggaaatgcacttcttgagttccgtggaaatgctggaagccacgatcttgcaatttctgttgaaactctgtcagccttaaccaaaatgacaagagaaggtatgaaaatgaagttaccaagatatgataaatctgcattcagtgggagaggtgaccgtgctgatccttcaacatggccagaaattgaaggccccctgacagttgtgttgtttgaaggttggatgcttggtttcaagccccttccagttgaagcagtaaagggtgttgatccccagctagaaactataaataaaaaccttgaagcatactatgatgcatgggacaaatacataaagtcatggatagtcatcaagattaaggacccaaattgtgtcttccaatggcgcttgcaggctgagattgccatgagggaagcaggcaagcctggaatgacagatgatgaggtgagagattttgtttcgcgctacctgccggcatactatgcataccttcctacactttactcagagggaccaagtggatcagatcctaagcatctcctaaccattgaaatagatgaagggagaaaccctatccttgctgcctaggttgactgtatgatagatcattgcaggtttttcaattctttgagatgatttgaatggctattcagcattaattagttacaccatcagtggagctatgtcattgaatcagcactatttcccttgaaatgtatagagaatatttcattaatatataatagcgaacggctaatgctttctgttttgttatttgatcaaaaatagaataagaagcctagactactagtcgttgatagttaatggctttttatttttcaagactttgttcataaattatgatcacttcagtgacttcaatagtacactatgtgctgctgcacctgcacttgatttatttaatagt

SEQ ID NO: 2355 - DNA, 1452 bp, Cajanus cajan
agtttttgattataaaatggtgaaggggcacaccaaatatcttgtgagttgtgacaagagctactccaatataaaaaaaggtgtgtgttcttccttccttaacaggtgaagtgttctgcaatcctagtacccttcagatctttcccattacatccttttccatcttcatatgctgtcactgacactgttacagaacaagacagtgcctactccatcattccagggttgtctcattcttccagtgtcttctcatttcacttgctatttgtgaaactgcacacccttttgagcaagttactttttttcgttgttattgagagatggaaatggaagcttttttatggggtgatgacattgatggagatgcccctaaggggaaaagtgatggttttggagggaacaatggggtaattggaagtgggtgtggttcgtctttctctctggttttggatggggagagaggggagcttgtggaggcacctgtgaagttggaaaggaaaggggtgtccactgagagaagcattgaagctttgaagagccatagtgaggcagagaggagaaggagggcaaggataaatgcacatcttgatacacttcgcagtgtcattccaggtgctatcaagatggacaaggcgtcattacttggcgaggttattagacatttgaaagagcttaagaagaatgcagcacaagcatgtgaaggcttgatgattccaaaggacaatgatgaaataagtgttgaagaacaagagggtgggttgaacggttttccttattcaattagagcatcactatgttgtgaatataaacccgggttattgtctgatataagacaagcactagatgctcttcatctcatgataataagggcagatattgcaaccttggaaggcagaatgaagaatgtgtttgtgatcattagctgcaaagaacagaactttgaagacgccgcgtaccggcagtttctcgccggatctgttcaccaagctcttaggtctgtgctcaatagattttctgtttcacaggacctgttaggaaccaggaaaagaaggaggatttctatattcagttcttcatctttggaagatttcttgtaatgtcacttgttaagaataagttaaatccccatatctataccaagtttgaatatgatgaggtggtgagtgatatagttgtagtaatttcgtcatgggccatgtaaactcatgtatacataatgaaatgttactcttccatgatttataacgtggacatgtacttctttgaagacaaatcatgtgaaaagataatgggcatcttatttggggtgtacaaatatttaggtgctttgaaaaattggttgatggctaattgatcatagtagcatcttttagtcttttgatcaagacaaaatggagtcttctatgatattgtaccttgtttatagaagggtgactattgttatgaattgtt

SEQ ID NO: 2356 - DNA, 2252 bp, Cicer arietinum
cgtttcctttcttattttctcatcacaacttcaccaccaccatcaacgtttctcgaacctcttcttttcgtgtgttttgctgtcaatctgaattcaagacagagaaagttcaaataagaaggttctctcctttattagaaagttcattggtttctggtaatggtgctgtggctttagatgagtggaaagcagttcctgacatttggagaacttctgctgagaagtttggtgataatgtagcattggtagatcaatatcatgatcctcctacaactatgacatacaaacagttggaggatgcaatattggactttgctgagggtttgagagttattggagtaaaacctgatgagaagattgccctttttgctgataactcatgtcgttggcttgtagcagatcaaggcatgatggcaattggagcaatcaatgtggtaaggggttcaaggtcatcaattgaagaacttctgcaaatatacaaccactctgaaagtgttgcactggctgtggacaatcctgaaatgtttaatcggattgcaaaaccattttacttaaagagttcaatcagatttatcattcttctttggggagaaaaatcatgcctggttagtgaaggaaacaaggaggtgccaatctttacattcatggaagtcatacatttagggcgagaatgtcgcaaggcattgtttgagtgccatgatgctagacaaccctataagtttgaagcaataaaatctgatgacatagctactcttgtgtacacaagtggaactactggaaatccaaaaggtgttatgctaacccatcacaatcttttgcatcagatcaaacacttaacggatgttgcacctgctgaagttggggatatatttctaagtatgctgcctccatggcatgcatatgaaagagcttgcgagtatttcattttcgcacgtggtgttgaacaaatatacactaccgtgagaaacttgaaggatgatttgggacgttatcagccacagttgatggtttctgttcctttagtttatgaaactttgtacagtgggatccaaaagcagatatcaacaagctcacttattagaaagtttgtcgcactcacattcatacggatcagcttagggtacatggagtataagcgaatttatgagggtaaatgtttaacatcgaatcagaagccaccttcctttctctattcaatattagacttaatatgggcaagacttatagctgcaatactatatccaattcatatgctggcaaataaactggtctacagtaaaatccgttcaaccattggaatatcaaaggttgcaataagtggtggtggtagcttaccttctcatgttgataaattttttgaggctattggtttcaatttgcagaatggatatggtttaacagaaacttcaccggttattgctgctcggcgacctggttgtgacgttattggatctgtggggtatccaatcaagcatacagaattcaaagttgtagattctgaaactggtgaaattcttccacctggttcaaagggaatactgaaagtcaggggcccaccattgatgaaaggatactacaagaatccttcagctacaagtcaggccatagatagggatggctggctgaatactggtgacataggttggattgttccctaccattcaactggacggagtcgtaattctggtggtgtgattgttgttgaaggtcgtgctaaagacaccattgtgctttcatcaggtgaaaatgttgaaccgggagaacttgaagaagctgcgttgagaagtaacctcatacaacaaattgttgttattggccaggataagcgacgtctgggagctgtagttgttcctaataaagaaggagctttaaaggtagcgagggaattgtcaattatagattccaaaagttcagatatcagtcaagaaaaattgaccagtctaatatataatgaattaaggacctggacgtcagagtttccatttcaaattgggccaatccttctcgtgaatgatcccttcacgattgataatgggctaatgacacccacaatgaaaattcgaagggatagagttatggctcaattcaaggaccaaatagagaatctatacaagtaaacttctctagtgccaatggtaggggacataatatactcatacagtcatactaattgattacagttatagcataactaaataattagattgataataactattttatagtatatttatagtgactcatgtaactct

SEQ ID NO: 2357 - DNA, 1751 bp, Medicago truncatula
aagataatctgagattaacttggagttctatatagtcttcaaccttgttacgtacttcagccaaaccaaagcattcattgtagacatgtcttttgcactaacaacaacaatgtttgcttttcttctcttcactttcatgtactttctattcaaactctacttacatccaaaacaaaaaaccctaaaccataaaaaaccaccaggtccatcaacactaccaataattggaaatcttcacatattaggcaaacttccacatagaacacttcaatcactctccaaaaaatatggtccaatcatgtccttacaacttggtcaagttccaactattatcatttcatcttcaaaagctgcagaatcattcctcaaaactcatgacatcgtttttgcaagtcgaccaaaggttcaaggatcagatctcatgtcttatggttccaaagggatggctttttctgagtatggtccttattggcgtagtgtgaggaaattttgcactttgaaactttttagtgcttcaaaagttgagatgtttggtcctattaggaaggagaagttggatgttttggttatatctttggagaaagctgccttggagggtgaggttgtgaatgttagtgaggttgtagagaatcttattgaggatattgtgtataagatgatgtttggtcggagtaagtatgagcaatttgacatgaataagttagttctagaagcaatggctttgatgggagcttttaatctggctgattatgtaccttggctaggcgtttttgaccttcagggattaacacgagcttgcaaaaaaaccagtaaagccctcgatgaggttttggagatgataataacagagcacgaacagactactaatactgacaaaactcgtaatgaagactttgtagacatacttctttcaattatgcaccaaaccattgatgtcgagggtgaacaaaatctcgtcattgatcgaactaacatcaaggctattttgctcgacatgatagcggcatcagttcatacatctgctaccacgattgagtgggctttatctgaacttctaaggcattcaagagtgatgaaaattcttcaagatgagatacaaaatgaagtaggaaataaaagaatggttgaagagaaggatctgaagaagtttaattacttagatatggttgttgatgaaaccttaagactttatcctgttggacccttattaatccctcgtgaatgtagagagagcataacaattgatggatattttataacgaaaaagactcgagttatagtaaatgcatgggctattgggagagattgtaacgtttggtcagaaaatgctgatgaattttacccagagagatttattgacaagaaaatgaattatcaaggacatgagtttgaatctataccatttggttctggtcgtaggcgttgtcctggaattcaattgggtttaattatcgttaagttggttatagctcaatttgtgcattgctttaactgggaacttccacataatattagtccttccaatttgaatatggaggagaaatttggactctctataccaagagctcagcatttgcaggcaataccgagttatcgtttggatgatgctaagcatgaatagttacaagaataatactatgttcttgttcaacaagtttctactagtaataaagatgctaagtatggcaggtctattaatgatgttttaatgcatattgcttgttctttatatatgttcatagccaacattt

SEQ ID NO: 2358 - DNA, 1617 bp, Medicago truncatula
aagataatctgagattaacttggagttctatatagtcttcaaccttgttacgtacttcagccaaaccaaagcattcattgtagacatgtcttttgcactaacaacaacaatgtttgcttttcttctcttcactttcatgtactttctattcaaactctacttacatccaaaacaaaaaaccctaaaccataaaaaaccaccaggtccatcaacactaccaataattggaaatcttcacatattaggcaaacttccacatagaacacttcaatcactctccaaaaaatatggtccaatcatgtccttacaacttggtcaagttccaactattatcatttcatcttcaaaagctgcagaatcattcctcaaaactcatgacatcgtttttgcaagtcgaccaaaggttcaaggatcagatctcatgtcttatggttccaaagggatggctttttctgagtatggtccttattggcgtagtgtgaggaaattttgcactttgaaactttttagtgcttcaaaagttgagatgtttggtcctattaggaaggagaagttggatgttttggttatatctttggagaaagctgccttggagggtgaggttgtgaatgttagtgaggttgtagagaatcttattgaggatattgtgtataagatgatgtttggtcggagtaagtatgagcaatttgacatgaataagttagttctagaagcaatggctttgatgggagcttttaatctggctgattatgtaccttggctaggcgtttttgaccttcagggattaacacgagcttgcaaaaaaaccagtaaagccctcgatgaggttttggagatgataataacagagcacgaacagactactaatactgacaaaactcgtaatgaagactttgtagacatacttctttcaattatgcaccaaaccattgatgtcgagggtgaacaaaatctcgtcattgatcgaactaacatcaaggctattttgctcgacatgatagcggcatcagttcatacatctgctaccacgattgagtgggctttatctgaacttctaaggcattcaagagtgatgaaaattcttcaagatgagatacaaaatgaagtaggaaataaaagaatggttgaagagaaggatctgaagaagtttaattacttagatatggttgttgatgaaaccttaagactttatcctgttggacccttattaatccctcgtgaatgtagagagagcataacaattgatggatattttataacgaaaaagactcgagttatagtaaatgcatgggctattgggagagattgtaacgtttggtcagaaaatgctgatgaattttacccagagagatttattgacaagaaaatgaattatcaaggacatgagtttgaatctataccatttggttctggtcgtaggcgttgtcctggaattcaattgggtttaattatcgttaagttggttatagctcaatttgtgcattgctttaactgggaacttccacataatattagtccttccaatttgaatatggaggagaaatttggactctctataccaagagctcagcatttgcaggcaataccgagttatcgtttggatgatgctaagcatga

SEQ ID NO: 2359 - DNA, 1596 bp, Medicago truncatula
ttatagttctcatccttagaacttagatccaaagaattcactgtaaacatgttttcaacaacaataataattcctttcattctcttcactttcacataccttttattcaaattctacttacgtgaaaaacaaaacaccataaatcataaaaaaccaccaggtccaccaacactaccaataataggaaaccttcacatgttaggtaaacttccacatagaacacttcaatcactgtccaaaaaatatggttcaatcatgtccttacaacttggtcaagttccaacaattgttatttcatcttcaaaagctgcagaatcattcctcaaaactcatgacatcaattttgcaagtcggccaaagactcaagcatctcagctcattttttatggttccaaagggttggctttttctgagtatggtccttattggcgtagtgtaaagaaactttgcactttgaaacttcttagtgcttcaaaagttgagatgtttggtcctattaggaagaaggagttggatgttttggttaagtcattagagaaagttgttttggtaggtgaggttgtgaatgttagtgagattgtagagaatcttattgaagatattgtgtataagatgatattgggtaggggtaagtatgagcaatttgatttaaagaagttggttcaagaaggaatggctatgcttggagcttttaatctggctgattatgtttcttggttaggtccttttgatcttcagggatttacacgaacctgcaagaaaaccggtaaagcacttgatgaggtattggagatgataattacagagcatgaacaaagcactaatgtagacaaagttcgtcatgaagatttcattgatatacttctctcaattgtgcaccaaacggtagatccagaaaatgaacaaagtggtgttattgacagaactaacatcaaggcaattttactagacatgattgtggcaggaattgatacagccactaccacgattgagtgggctttatctgaacttttcagacatccaagagtgatgaaaaagcttcaagatgagatacaaaatgaagtaggaaataaaagaatggtcgaagagaatgatttgaagaagttgaattacttagatatggtggttgatgagacattaagactttaccctgttggacccttattacttcctcgtgaatgtagagaaagcataacaattgatggatattttataaaggaaaagacacgagttatagtaaatgcatgggctatagggagagattcaaatatttggttagaaaacgctgatgagttttatccagagagatttagtgataagaaaatgaattatcaaggacagcaatttgaatctataccatttggttcaggtcgtagacgttgtcctgggattcaattgggtttggttacggttagatttgttgtagctcaattggtgcattgctttaattgggaacttccacataatattagcccttccaatttgaatatggaagagaaatttggagtcactataccaagggctcaacatttgcacgcaataccgagttatcgtttggaatgtgatgagaagcttgaataggtccataaaggacat

SEQ ID NO: 2360 - DNA, 1145 bp, Glycine max
caatttttatcaaccaacgcaacatgtcacggacgatggagtgggcggcgagggcggagcacctccgcggcattcccagaaaactcgtgattgcggcggtgggcggattcgccaaaacggtgtcgtctttcctcaacaccgccgatgttcacaacggcgacactctcctccgcctcgtccgctccagaccccaccgcgtccccctcattaccgttagcaatcacatgtccactttggatgatccggttatgtgggggttcaagggttttcctatcttcgacaccaacttagctcgctgggttctcgctgccgaagatatttgcttcaggaatgccctctattcctatatttttcgggttgggaaatgcatacctattacgagaggtggtggaatttatcaagagcacatgaatgaagctcttgagcgcttaaatgatggagaatggctgcatacttttccagaaggaaaagtgtatcaagaagatgcacctataaggcaattgaaatggggaactgctagtctaattgttcgagcacctataactccaattgtattgccaattgtccatcatggttttcatgaggtgatgccagagaattacatgtttggtaaacgacctcctataccattatggaataagaaaattcacatagttattggtgatccaattgaatttgatcttccagcaatgaggcaaaaggctatttcccagtctcgtaatgagtcattccctactattgggtggcccagcactcctgatggtttggatgaagcagcacaaagatatctctacaccacaatttcagagcaaatccgtgctgcaatggagagattaaggtgtttgggtaaaagttttatgaagtcataggtaggttcaaaccaacctaagtcggagattagggtaatttagatcttcagttgatcaattgaatcattctttgttgttgtaattgatggttgagtgagagatcttaacctcggcttcttaaaatcaaatgtcattcattagaatagacactagttttgtagggtaagatggctcctccccctcccaaaatttacaccccaaaattattagatgggctagtatttcaaaatccaaagtttcattttaaaaataaaagtttcagtccttgacgaataa

SEQ ID NO: 2361 - DNA, 1104 bp, Phaseolus coccineus
ggtgaagtgaggttggtaagtcaaatgtcacgcaccatggagtgggcggcgagaacggaccacttccgaggcattcccagaaaaattgtgattgcggtggtgggcgccttcgccaaaacggtgtcgtctgttctcaacaccacctccgttcacaacgccgacaccctcctccacctcgtccgctccagacccagccgtgtcccactcgtcaccgttagcaatcacatgtccaccttggatgatccgctcatgtggggttttaagggttttcccatctttgatactaagttggctcgatgggttcttgctgcggaagatatatgcttcaggaatgccctctattcctatatttttcgccttgggaaatgcatacctattacaagaggaggtggaatttatcaagagcacatgaatgaagctcttgagcgcttaaagaatggagaatggatgcatacttttccagaaggaaaggtgaatcaagaagaggcacctataaggcggttgaaatggggaactgctagtctaattgttcgagcacctataactccaatcgtattgccaattttccatcatggttttcacgaggtgatgccagagaaatatatgtttgatagacgacctcctttaccattatggaataagaaagttgacattattattggcgatccaattgaatttgaccttccagcaatgaggcaaaaggctatttcccaatctcgtagtgagtcattcccaactgctggatggccaagcacttgtgatggtttggatgaagcagcacaaagatgtctctacgccacaatttcagagcaaatccatgctgcaatggagagattaaggtgttttggtaaaagttttctgaggtcataggtaggttgagtcagagattaaggtgttttagatattgaatcattctttgttattgtaattgatagttgagccagaactattcggtttcttaaaatcaagtttcattcagtagaatatatacaagtttgtagggtagatgtacagcccaaaattagatgggctttgtattccaaaatccaaaatttcatttgaagaataaaaatttggagtccatggtaactttgggttgtgtat

SEQ ID NO: 2362 - DNA, 1322 bp, Cajanus cajan
acaatgtcacgcaccatggagtgggcggcgcggcccgaccacctcagaggcattcccagaaagctcgtgattgcggcggtgggcgcattcgccaaaacggtgtcgtctcttctcaacaccacctccgttcacaacgccgacaccctcctccgcctcctccgctccaggccccgccgcgtccctctcatcaccgttagcaatcacatgtccactttggatgatccttcaatgtggggcttcaagggtttccccatcttcgatgctagcttagctcgatgggtactcgctgccgaagatatatgcttcaagaatgccctctattcctatatttttcgtcttgggaaatgcatacctattacgagaggtggtggaatttatcaagagcacatgaatgaagctcttgaacgcttaaataatggagaatggctgcatacttttccagaaggaaaagtgtatcaagaagatgcacctataaagcggttgaaatggggaactgctagtctaattgttcgagcacctagaactccaattgtattgccaattgtccatcatggttttcacaaggtgatgccagaggagtatatgtttggtagacggcctcttgtaccgttatggaataagaaaattaacataattattggtgatccaattgaatttgaccttccagaaatgaggcaaaaagctattttccagtctcgtaatgagtcattccctactactggatggcccagcacttctgatggtttggatgaagcagcacaaagatgcctctactccacaatttcagaccaaatccgtgctgccatggagagattaaggtgtcttggtaaaagttttctgaagcaatagcttctttagatctcgagtttagtatttgtgtcattctttgttattgtaattgataattgagtgagaagtctatacttcggtttggcttcctaaaatcaagtgtcattagaatacatactagttttgtaaccaagggaggtttagctcaattgattgagcagggtgtatgagtattgtaaacccttggtaccaagttcgattcttacaggtcaaagaaacaaaaagcatactagttttgtagggggaaatgagttcccctccatgtaaagcccaaaattagatgggctagtatttcaaaatccatagcttcattaattgatttggattcttagcatttgagtagtgtcatatcacctaggaaggatacataatagaaataagcagctgggactggcatttcagatggggtctcattgttcatttctttctgtgtaatgtacaatatcctaatccatggtttcatatcatgtgtc

SEQ ID NO: 2363 - DNA, 868 bp, Glycine max
cggcggcaatgtcacggacgatggagtgggcggcgagggcggagcacctccgcggcatttcgagaaaggtcgtgatcgcggcggtgggcgccttcgccaaaacggtgtcgtctcttctcaacaccgccgccgttcacaacgccgacactctcctccgcctcgtccgctccagacccaactgcgtccccctcattaacgttagcaatcacatgtccactttggatgatccggttatgtggggattcaagggttttcccatcttcgacaccaagttagctcggtgggttctcgctgccgaagatatatgcttcaagaatgccctctattcctatatttttcgggtcgggaaatgcatacctattacaagaggtggtggaatttatcaagagcacatgattgaagctcttgagcgcttaaaagatggagaatggcttcatacttttccagaaggaaaagtgtatcaagaagatgtgcctataaggcggttgaaatggggaactgctagcctaattgttcgagcacctataactccaattgtattgccaattgtccatcatggttttcacgaggtgatgccagagaaatacatgtttggtagacgacctcctgtaccattatggaataagaaaatagacataattattggtgatccaattgaattcgaccttccagcaatgaggcaaaaggctatttcccagtctcgtaatgagtcattccctaccattggatggcccagcactcctgatggtttggatgaattagcacaaagatgtctctacaccgcaatttcagagcaaatccgtgctgcaatggagagattaaggtgttttagtaaaagttttgtgaagtcatgggtaggttcaaacct

SEQ ID NO: 2364 - DNA, 1104 bp, Phaseolus coccineus
ggtgaagtgaggttggtaagtcaaatgtcacgcaccatggagtgggcggcgagaacggaccacttccgaggcattcccagaaaaattgtgattgcggtggtgggcgccttcgccaaaacggtgtcgtctgttctcaacaccacctccgttcacaacgccgacaccctcctccgcctcgtccgctccagacccagccgtgtcccactcgtcaccgttagcaatcacatgtccaccttggatgatccgctcatgtggggttttaagggttttcccatctttgatactaagttggctcgatgggttcttgctgcggaagatatatgcttcaggaatgccctctattcctatatttttcgccttgggaaatgcatacctattacaagaggaggtggaatttatcaagagcacatgaatgaagctcttgagcgcttaaagaatggagaatggatgcatacttttccagaaggaaaggtgaatcaagaagaggcacctataaggcggttgaaatggggaactgctagtctaattgttcgagcacctataactccaatcgtattgccaattttccatcatggttttcacgaggtgatgccagagaaatatatgtttgatagacgacctcctttaccattatggaataagaaagttgacattattattggcgatccaattgaatttgaccttccagcaatgaggcaaaaggctatttcccaatctcgtagtgagtcattcccaactgctggatggccaagcacttgtgatggtttggatgaagcagcacaaagatgtctctacgccacaatttcagagcaaatccatgctgcaatggagagattaaggtgttttggtaaaagttttctgaggtcataggtaggttgagtcagagattaaggtgttttagatattgaatcattctttgttattgtaattgatagttgagccagaactattcggtttcttaaaatcaagtttcattcagtagaatatatacaagtttgtagggtagatgtacagcccaaaattagatgggctttgtattccaaaatccaaaatttcatttgaagaataaaaatttggagtccatggtaactttgggttgtgtat

SEQ ID NO: 2365 - DNA, 1221 bp, Trigonella foenum-graecum
aactctcctgaataagtgtcgaatgcataacaataataatttcaacaataacaacaccaactcgattctcttctcttttaaatctcctctatcattagttacactttagccacgcaactagaataatcacaaccatccatggctgtggactttagctccatccccataattgatattagtcccctgttagccaagtcagatgacccaaaaatggctgaggaccctggtgtacttgatgttgttgcacaattggataaggcttgtactgaagcagggttcttttatgtgaaaggccatggtatacctgatagtctcctcaaaggggttagagatataacgcgaagattcttcgaacttccgtatgaagaaaaggcaaagatcaaaatgactcgggctactggtttcagaggatatgagaagattggagaaaatattactgaaggtgcacctgatatgcatgaagctattgattgctatagggaagtaactaagggcatgtatggagatcttggcaaagttatggaaggatgcaaccagtggccacaaaatcctccaaagttcaaatttcttatggaggaatatattagtctctgcaaagatcttgcaaggaaaattatgcgcggaattgctttagcattaggtggatcaccatatgaatttgaaggtgatagagctggtgatccattttggataatgcgtataattggttaccctggtgtatccactgatgacattggatgtggggctcacacagattatggtttattgacattgttgaatcaggatgatgatgtaaatgcacttcaggtaagaaacctatccggcgaatggatatccgcacctccagttccagggtcatttgtgtgcaacattggtgacatgcttaagatatactccaacggtttgtacgagtcaactttgcatcgggtgataaacaactcctcaaaatatagagtcagtgtagtatatttttacgagacaaactttgatactgcggtagagccgttggatacatataaaacaaggacaaacggtgacaagaaatttgaaagagctgtctacggagagcatctagtcaagaaggtcctcacaaattttgttgatgagtgactgtttttcttttctagtgaataataagttaagcatcttgtagataagctcctacttgtatgtcaagatctactaagaataatgttaagtcaaagtcaagcgtttatcatc

SEQ ID NO: 2366 - DNA, 1214 bp, Cicer arietinum
atccatttacaatcatccatggctgcagactttagctccatccccataattgatattagtccccttttagccaaatcagatgaacccaaaatgggtgaggactctagtgtacttgatgttgtcacacaattggataaggcttgtaccgaggcaggcttcttttatgtgaaaggccatggtattcctgaaagtcttctcaaagaagttagagacgtaacacgccaattctttgaacttccgtatgaagaaaaggcgaaaatcaaaatgactccggcgaacgggttcagaggatatgagaagattggagaaaatgtaactcaaggtgtacctgacatgcatgaagctattgattgctatagggaagtgactaagggcatgtatggagatcttggcaaagttatggaaggatgcaatcagtggccagaaaatcctccaaaaatgaaagttcttatggaggaatatattattctttgcaaagatcttgcaaggaaaattatgtgcggaattgctttagcattaggcggatctccatatgaatttgaaggtcatagagctggtgatccattttgggtaatgcgtataattggttaccctgctgtatctactatgaatgacattggatgtggagctcacacagattatggtttattgacattattgaaccaagatgaaaatataaacgcacttcaggtaagaaacctttctggagaatggatatccgcacctccaattcctggaacgtttgtgtgcaacattggcgacatgcttaagatatactccaatggtttgtatgagtcaacattgcatcgggtgataaacaacaacacaaaatatagagtcagcgtagcatatttttacgagacaaactttgatactgcagtagagccattggatacatataaaacaaggacaaatggccacaggaagtttgaaagagccgtctacggcgagcatctagtcagcaaggtcctcagcaatttcatacatgagtgactttgtttttctctttgtagtgaataataagtttagcatcttttggtaagctcttgctatcatgtccagatatactaaaattaatgttaagtcaaagtaagtgtttgttatctatcaaggtctcccattcttaaaatatatgctttgtttcagtttgaaaactagacctggagtttgcacactgtaacataatatcatccaatataagcaaaaatattaac

SEQ ID NO: 2367 - DNA, 1376 bp, Cajanus cajan
atcatacacaaacgtgagtgagtcacgctctcctgaaactgaaactatgattttattttacgtatgaattatgatgataataaacaattcgttcctttaattagcttagcctcttcaatagcacacgccacgccacttcatacaaacacagtactttgagtttgagataaccgcaaccgcgccatggccacggactttagctccatccccttaatcgatattagtccccttctagctaaggcagatgatccaaaaatggctgaggaccctggtgtactcgaggttgttagacaattggataaggcttgtacggaggcagggttcttctacgtgacaggacatggtattcctgatattctcctcaaagaggttagagatgtaacacgcagattctttgaacttccatatgaagaaaaggcaaagatcaaaatgactccggctgctgggttcagaggttatgaaaggattggagaaaatattactctaggtgtacctgacatgcatgaagccattgattgctatagggaagtgaccaagggcatgtatggagatcttggcaaagttatggaaggaagcaaccagtggccacaaaatcctccaactttcaaagctcttatggaggagtatattagtctctgtacagaccttgcaaggaaaatcatgcgtgcaattgctttagcattaggtggatcaccggatgaatttgaaggtcaaagagctgggaatccattttgggtgatgcggctcattggttacccaggtgtatcatctgcaaatggaaccaatgctcttaaaaatgacattggctgcggagctcacactgattatggtttattgacattgcttaaccaagatgacgatataaacgcacttcaggtgagaaacctgtctggcgaatggatatcagcacctccggttcctgggtcatttgtgtgcaacattggtgacatgttaaagatatactccaatggtttgtatgagtcaactttgcatcgggtgataaacaagaactcaaaatatagagtcagcgtagtatatttttacgagacgaacttcgacactgcagtagagccattggacacacataaaacgagggcaaatggcaacaagaagttcgaaagaccagtttatggagagcatttaattagcaaggtcctcacaaattttatttgagtaactttgtttttcttgttatggtttgtaaataagtcagcctatcgtctagcaggctccttgcttgcttgtctaaagctgataatagtttaagtacaaatcaactatttgttatatatcaacgtcttccttcttttcaaaatttatgacagaggttcaggattaggacttgggaggtatccacatactcccagaagccataa

SEQ ID NO: 2368 - DNA, 1295 bp, Glycine max
gaatccgtgactttactaacttacaacaatatgataaaagcaatgcacacacacactagtacttccagataaccacaacacccgatggcaacggactttagttccatccccataattgatattagtccccttttggctaaggcagatgatccaaaaatggctgaggatcctggtgtgcttgaggttgttaaacaattggataaggcttgtacagaggcagggttcttctacgtgaaaggacatggttttcctgagactctccttaaagaagttagagatgtaacgcgcagattctttgaactttcatatgaagaaaaggcgaagatcaaaatgactccagctgctgggttcagaggttatcaaaggcttggagaaaatataactaaaggtgtacctgacatgcatgaagctattgattgctatagagaagtgaccaaggacatgtatggagatcttggcaaagttatggaaggaagcaatcaatggccacaaaatcctccaacattcaaagttcttatggaggagtatgttagtctctgcagagaccttgcaaggaaaattatgcgtggaatcgctttagcattaggtggatcgcccaatgaatttgaaggtcaaagagctggggatccattttgggtaatgcggctcattggttacccaggtgtatcatctgtaaatggaaccaatgttcataaaaatgacattggatgtggagctcacactgattacggtttattgacattacttaatcaagatgacgatgtaaacgcacttcaggtgagaaacctgtctggtgaatggataacagcacctccagttcctgggacatttgtatgcaacattggtgacatgctaaagatttactccaatggtttgtacgagtccactttgcatcgggtgataaacaacaactcaaaatatagagtcagtgtagtatacttttatgagacaaacttcgatactgcagtagagccattggacacacataaaacgagggcaaatggcaacaaggagttcaaaagagcagtctatggagagcatttaactggcaaggtcctcacaaattttgttgatttgtaaccttgtttttattgctctggtgtgtaaataaataaggcatcttgtcttgcaagctcatcgcatgcatgtctagacctacaagtgctgataatatttgaagtgcaattctcaatttatacaacttcaggacttgacttgggaatccacatactcccagttgtcataaatcatagtctcagacagaccaaataaacaaccatctaagttcaacagga

SEQ ID NO: 2369 - DNA, 1339 bp, Phaseolus coccineus
gtcatgttcctgaatctgtcacttcacctgcagtattaggatatgcaattcctttttcataccttcttccatactacaaacaaatccatagtaaagaaacaaagtgcactgagtttcagataatcacaattccctcatggccacggactttagttccatccccgtaattgatattagtccgcttttggctaacgcagagtggccattacggccggggaccctggtgtactcgaggttgttagacaattggataaggcttgtacagaggcagggttcttctacgtgaaaggacatggtgttccggagaccctcctcaaagaagttagagatgtaacgcgcagattctttgaacttccatacgaagaaaaggcaaaaatcaaaatgactccggctgctggatacagaggttatcaaaggattggagaaaatataaccaaaggtgtacttgacatgcatgaagctattgattgctatagagaagtgaccaagggcatgtatggagatctgggcaaaactatggaaggaagcaaccagtggccacaaaatccaccaatattcaaagttcttatggaggagtatattagtctctgcacagaccttgcaaggaaaattatgcgtggaattgctttagcattaggtggatcaccggatgaattcgaaggtcaaagagctggggatccgttttgggtaatgcggctcattggatacccatgtgtatcatctgtgaatggcacacatgttcttaaacatgacattggatgtggagctcacactgattacggtttattgacattgcttaaccaagatgacgatataaacgcacttcaggtgagaaacctatctggcgaatggatatcagcacctccagttcctggctcatttgtgtgcaacattggtgacatgctaaagatatactccaatggtttgtacgagtcaacttttcatcgggtgataaacgacaactcaaaatacagagtcagcgtaccatacttttacgagacaaacttcgatactaccgtagagccgttggacacacataaaacgagggcaaatggcaacaaaaagttcgaaagaccaatctatggagagcatttagttcgcaaggttctcacaaactttgttcttgagtaaccttgttttccttgttctggtctgcaaataagcctgacatcttgattttgtcaagcagatctctagcttgctactagacctacaactgctgatactgtaatattttaagtacaaatcaaacttgttatttatcaacgccttcattctcaaaattatcaccgatttcatgactaggacttgtgaatccacgtagcctcaaaaatcataa

SEQ ID NO: 2370 - DNA, 1392 bp, Arachis hypogaea
tggggggcctttgatgtgcattactccatttgtctctctttataagaggcaattgccaccgcagagcttgcattgtatcaccgacctcacccgcaatacacagaacacacaaaagtcagcgatggctacggacttcagttcaattcccctaattgatgttagtgcccttttagccaagtgtgatgacccaaaaatgggagaggaccctggtgttcttgaagttgttagacagttggataaggcttgcactgaggctgggttcttctatttgaaaggtcatggtgtttctgatgctctccttaaagaagttaaagacataactcgcagattcttcgaactaccttgtgaagaaaagacaaaaatcaaaatgactccggctgcagggttcagaggttaccagagggttggagaaaatataactaaaggcacacctgacatgcatgaagcaattgattgctataaggaggtgacaaggggcatgtatggagatcttggcaaaactatggaaggatacaaccagtggcctcaaaatcctccaaagttcaaagttattatggaggaatatattagtatctgcacagagcttgcaaggaaaattatgcgaggtatcgctttagcactaggaggatcaccagacgaatttgaaggacagagagctggggatccattttgggtaatgcggcttattggttacccgggcttaaccactacaaatggaactcatgaagctatgaaaaatgacattggatgtggagctcatactgattatggtttattgacattgttaaaccaggatgaagatataaatgctctccaggtgagaaacctctctggtgagtggatatcagcacctccagttcctggcacatttgtgtgtaacattggtgacatgctaaagatatattccaatggtttatatgagtcaactttgcatcgggtgataaacaactctccaaaatatagagtcagtgtagtatacttttatgagacgaactttgatactgccgtagagcctttggatacaattagaacaaggaaaaatggtaccaagaagtttgaaaaagctatctatggagagcatctagttagcaaggtcctcacaaatttcgtcgacgtctaattttatttcgttgtgaattcttataagtcaggcatctaattagctggtttaatttggactgtacaacatccatcttgcttgactagtttgcaaggagtgacaatactttttatcagctatgattatgggatccaaattctctgtatggtgattaggtatatatatatcacgctcacatttttctcttgttattgtaggtaagtcgtgtatgtatcaatatcttcatcaacaaaatgtaaatttatatttcaattaagagtttgcaaattgga

SEQ ID NO: 2371 - DNA, 1122 bp, Vigna unguiculata
aactttagttccatccccgtaattgatattagttcgcttttggctaaggcagatgatcccaaaatggccgaggaccctggtgtacgcgaggttgtaagacaattggataaggcttgtatagaggcagggttcttctacgtgaaaggacatggtgttccggagactctcctcaaagaagttagagatgtaacgcgcagtttctttgaacttccatatgaagaaaaggcaaaaataaaattgactccggctgctggatacagaggttatcaaaggattggagaaaatataaccaaaggtgtacctgacatgcacgaagctattgattgctatagagaagtgaccaagggcatgtatggagatctgggcaaaactatggaaggaagcaaccagtggccacaatatcctccaacgttcaaagttcttatggaggagtatattcgtctctgcacagaccttgcaaggaaaattatgcgtggaattgctttgggattaggtggatcacctgatgaattcgaaggtcaaagagctggggatccattttgggtaatgcggctcattggatacccaggtgtatcaactgtgaatggaacacatgttcttaaaaatgacattggatgtggagctcacactgattacggtttattgacattggttaaccaagatgaggatacaaacgcacttcaggtgagaaacctatcaggcgaatggatatcagcacctccagttcctgggacttttgtgtgcaacattggtgacatgctaaagatatactccaatggattgtacgagtcaacttttcatcgggtgataaacgacaactcaaaatacagagtcagcgtagcatacttttacgagacaaacttcgatactgcggtagagccgttggacacacataaaacgagggcaaatggcaacacgaagttcgaaagaccagtctatggagagcatttaattgccaaagttctcacaaactttgttttttagtaactttgttttccttgttctggtgtgcaaataagccagccatcttgatcttgtctagcaggcttctagcttgctactagacctacaactgcggatactgtaatattgtaatgcaaatcaagcctgtcatttatcaat

SEQ ID NO: 2372 - DNA, 1123 bp, Vigna unguiculata
aactttagttccatccccgtaattgatattagttcgcttttggctaaggcagatgatcccaaaatggccgaggaccctggtgtacgcgaggttgtaagacaattggataaggcttgtatagaggcagggttcttctacgtgaaaggacatggtgttccggagactctcctcaaagaagttagagatgtaacgcgcagtttctttgaacttccatatgaagaaaaggcaaaaataaaattgactccggctgctggatacagaggttatcaaaggattggagaaaatataaccaaaggtgtacctgacatgcacgaagctattgattgctatagagaagtgaccaagggcatgtatggagatctgggcaaaactatggaaggaagcaaccagtggccacaatatcctccaacgttcaaagttcttatggaggagtatattcgtctctgcacagaccttgcaaggaaaattatgcgtggaattgctttgggattaggtggatcacctgatgaattcgaaggtcaaagagctggggatccattttgggtaatgcggctcattggatacccaggtgtatcaactgtgaatggaacacatgttcttaaaaatgacattggatgtggagctcacactgattacggtttattgacattggttaaccaagatgaggatacaaacgcacttcaggtgagaaacctatcaggcgaatggatatcagcacctccagttcctgggacttttgtgtgcaacattggtgacatgctaaagatatactccaatggattgtacgagtcaacttttcatcgggtgataaacgacaactcaaaatacagagtcagcgtagcatacttttacgagacaaacttcgatactgcggtagagccgttggacacacataaaacgagggcaaatggcaacacgaagttcgaaagaccagtctatggagagcatttaattgccaaagttctcacaaactttgttttttagtaactttgttttccttgttctggtgtgcaaataagccagccatcttgatcttgtctagcaggcttctagcttgctactagacctacaactgcggatactgtaatattgtaatgcaaatcaagcctgtcatttatcaata

SEQ ID NO: 2373 - DNA, 2528 bp, Setaria italica
atatggacgagccgtgaagcggaggaagatgcattaaaggcgcgagcagtggagtcgtcgccaaacaagccatcgtcggccagcactgcgagctcgaggtttcttgcaagtaaccgccggttccttgcgacggccggcaggggtggccggcaagccaaccctgacccaggcctctgtgccgccggctggataaatagacagacaagtgtcgcccaaggatcccatacattgtcacttgtccggaggggatcgagttgagctacctcctgcttccattctgtggctctgagctgccaaggacacgtattggagctcgccttcttcttctccgctcggcaggcttcgccggggttatgcgaaggagcaggtcgtgcttgtcttgcgtgcccatgggaacggcggcgctgcccatcgagaagcaattcgttcctccggctgcgctgccgtcatggccggcctcagcagcagtttcagatggaggatttgcaaagggcagcatagaccttggaggcctggaagtgcgccaaatcaccacgttcgccaaggtctggtccaccactcaaggcggcgaggacggcgtcggcgccaccttcttcgagccctcgccggtccctgccggcttctccgtgctcggccactacgcgcagcccaacagccgccctctcttcggccacgtcctcgtcgctcgcgacacctccggcaccggagcgctccttgccgcgcccgtggactacaccctcgtgtggtccagcccggacggcgccggcaatttctggctccccacggctcctgaaggttacaaggcggtgggcgcggtggtcacggccacgtctgacaagccttcgcgcgacgaggtcaggtgcgtccgcgccgacttcaccgacgcgtgcgagacagaggagtcgctgttgagcagcgacaaggacggcttcagcgccgccactctgaggccgtccgtccgtggcatcgacgcccgcggcgtgcacgccggcaccttcctcgcccagagcaacgcggcgagcgcctcgacggtggcgtgcctgaagaacaacagcgcgagttacacgtcctccatgcctgacctggctcaggtgaactccctcctcgcggcctacgcgccgcacgtgtacctgcacccgaacgagccctacttcccttcgtcggtgacgtggttcttcgagaacggcgcgctgctgtaccagaagggcagccagaccgcgacgccggtggccgccgacgggtcgaacctcccgcaaggcggcggcaacgacggcggctactggctcgacctgccggtggacaacaagcagagggagaaggtcaagaggggcgacctcgccagcgcgaaggtgtacgtgcaagcgaagccgatgctgggcgggacggtgaccgacctcgccgtgtggatcttctacccgttcaacgggccggcgcgcgccaaggtcggcctgctcacgatcccgctgggcgagatcggcgagcacgtcggcgactgggagcacgtgacgctgcgtgtgagcaacttctccggcgagctgctccggatgtacttctcgcagcacagcgcggggacgtgggtggaggcgtcgcagctggagtacctggacgcgggggacggcgggagcaggccggtggcgtacgcgtcgctgcacgggcacgcgttgtacccgaaggcggggctggtgctgcagggcgacgcgaggctgggcgtcgggatccggaacgacgccgccagggggagcaggctggacaccggcggcgccgggcggtgcgaggtggtgtcggcggagtacctcggcgtcgcggagccggcgtggctcgggttcgagcgcgagtgggggccgagggtggagtacgacatcgggcgcgtgatcaaccgcgtggcgaggatcctgccgcgctcggcgagggagcggctggccaagctggtggagaaggtgctcgtcggcgatgggccgacggggcccaagatgcacggcaactggaggaacgacgagagggaggcctgacgaggccttgcagagtcaacttcctttcattctttgttatggatcattgtttagattaagcaaaagtttagaatgcttttattagggattcacgagctcccgttacctgaattttgcaccgtccgatctgacgatctgtggtgctccctggcttttctatcagatacagctgctgcgcgctgcctcctgcagagcatctgtgctgctgcagcgctccgaccaggccaaagcagctgcaaagcatctaagcatgcaggcaggcatctgagcaagagagcgacagtcgtgctttgaataggactatgcgtgcgcttccgtatacattaggattcttttacctactaacttacagtgacattgttactgtaatttcaatttgtatattatgtaattttaaatctgtgtaaatttgcatgctgtttattttgaaatctgattggtatttttgcatttgaggggtttctcacggttagaaataatttgttatttgactgattatagaaaaaatttgtttcagtt

SEQ ID NO: 2374 - DNA, 1529 bp, Phaseolus coccineus
gtcgtttggtttgacagaaaacctagacggggggagatggcgaagaagagatcagcgccgatcggcggtcgtcgggaaaaccgagtggaatcatcttcagtacgggtcaactcagctttcagtggcagaaatgttgttgtcttcttcataatatcgtccattattgctactgtcacttaccgcttcagacaatactctccttcgcaatatgaagaatcgtatgtgtatgagcaaggccttgtcacaacccatgctaattaccaacatgtactcaccgaaaattccaaagtatcagaaaatacctctcagcgccattataattatcctgtgcttggctacattactccctggaattctcgaggttatgaattggctaaaaggttcaactctaagtttacacacatatcacccgtttggtatgacctaaagagccaacagactagcttagttctagaggggagacacaatgctgacagaggatggatctcagagcttagaaagacaggagaagctttgattttgcctagagttgttctggaagcatcgccagcagtgctgttgggaaaggaaaagcaaaggaacaaagccattaatcttatagtaacagagtgcaaggaaatgggatatgatggtattgttttagaatcttggtcaaggtgggcagcctatggtatcttgcatgatccaaacatgcggaatttggcactgcagtttgtaaaacagcttggagatgctctgcattctataggctcagagaaaattagtgggcagaagctgcagctagtctatgttataggtccaccatcttctgagaagctgcaagagcatgactttggtcctaaagatcttgaggttttaagtgcagctgtggatggattctcgttaatgacatacgacttctctaatcctcataatcctggtcctaatgcacctttgaaatggattcaaattgttctgaagctgcttcttggtacctctggcaatagagcccaaagcctcgcccccaagatacttctcggcatcaacttctatggaaatgatttctccctttcaagaggtgaaggtggtggtggagctattattgggagagattaccttgcacttttggagaagcataggcctgaactgcagtgggataagaacagtggggaacactttttcttttacaatgacgacaaggatatcaagcatgcggtattctatccatctttgaagtcaatttctttgcggttggaggaagcccgttcatggggatgtggcatctcgatctgggaaattggccaaggtttggattatttttatgatcttctgtgaaagcctaactttcagaagttttgttttgaggaaatttgcagttagttcaactacaacttgcaaagatacgatgatgtcatagcaaaactggtatggtaggattatgctaaaaggacgtatttaattgtttttctattagttgtctcgatgatgtataatatatccttttgaatttttaaaaaaaatatctttatcaatagttttttgaactgaaa

SEQ ID NO: 2375 - DNA, 1524 bp, Cajanus cajan
gccttacacagatataggatacgaagcacaacggtgtcgtttcctactttccggtgttagtaaacctagtcgggcgagatggcgaagaagcgatcaggcccgagtggcggtcgtcgggaaaaccgagtcgaaccatcttctgcacgagtggactcagcttccggtcgcagcaaactcgttgttttgttcatcgtgtcttcaatcattgctatcatcgtcacttaccgcttcaggcgatcctctcagtcggaatataaagattcgaatgtgtatgagcaaggccttgttacaacccatgctaattaccaccatgtactcaccgaaaattctaaggtatcagaaaatacctctcagcgccattatacctatcctgtgcttggctacattactccctggaattctcgaggttatgaattggcaaaaaggttcaactcaaagtttacacatttatcacccgtctggtatgatctaaagagccaacagactagcttagttctagaggggagacataatgctgaccgaggatggatgtcagatcttaaaaagacaggagaagctttgattttgcctagagttgttctggaagcatcaccagcagtgctgctgaggaaggaaaaactaagggacaaagccattaatcttattgtaacagagtgcgaggccatgggatatgatggtattgttttagaatcttggtcaaggtgggcagcttatgggatcttgcatgatccaaacatgcggaatttggcattgcagtttgtaaaacagcttggagatgcactgcattctataagctcagagaaaattagtgggaagcagctacagttgatctatgttataggtccaccatcttctgagaagctgctagagcatgactttggtccaaaagatctcgagactttaagtgaagcagtggatggattctcgttaatgacatatgacttctctaatcctcataatcctggtcctaatgcacctctgaaatggattcaaattgttctccagctgcttcttggtacctctggcaatagagcccaaagccttgcccccaagatacttctcggcatcaacttctatggaaatgatttctccctttcaagggatgcaggtggcggggctgttattgggagagattacctggcacttttggagaagcacaggcctgaactgcagtgggatgagaaaagtggggagcattttttcctttactctgacgacaaggatatcaggcatgcggtattctatccatctttgaagtcgatttctttgcgattagaggaagcccgttcatggggatgtggcatttcgatctgggaaattggccaaggtttggattatttttttgaccttctgtgaaaccccgtttgtgtactacatttattgcccatattagtgtttgttcccaactgttatgtacttgagtataatctaaatgttccttttggttaaatcagaatttctttttcagttgttcagtttgagcaaatgcgcagttagttcagttacaacttgcacagatacgat

SEQ ID NO: 2376 - DNA, 1472 bp, Vigna unguiculata
  misc_feature (27)..(27): n is a, c, g, or t
  misc_feature (31)..(31): n is a, c, g, or t
  misc_feature (394)..(394): n is a, c, g, or t
  misc_feature (441)..(441): n is a, c, g, or t
  misc_feature (503)..(503): n is a, c, g, or t
  misc_feature (530)..(530): n is a, c, g, or t
  misc_feature (552)..(552): n is a, c, g, or t
  misc_feature (584)..(584): n is a, c, g, or t
gggtcgtttgcagtgttagaaaacctngacngaggagatggcgaagaagcgatcagcgccagtcggtgttcgtcgggaaaaccgagtggaatcgtctacaagacgggtcaactcatcttccggtcgcagaaatatcgttttcttcttcgtcatatcgtccattattgctatcgtcgcttaccggttcagaaaatcttctccgtcgcaatatcaagaatcgtatgtgtatgagcaaggccttgtaacaacccatgctaattaccaacatgtactcaccgaaaattccaaagtatcagaaaatacctctcagcgccattataattatcctgtgcttggctacattactccctggaattctcgaggttacgaattggcaaagaggttcaactctaantttacacatatatcacccgtttggtatgatctaaagagccaacagantagcttagttctagaggggagacataatgctgacagaggatggatctcagcgcttagaacgncaggagaagctttgattttgcctaganttgttctggaagcatcaccagnggtgctgttggggaaggaaaaacaaaggaacnaagccattaaccttatagtaacagagtgcaaggaaatgggatatgatggtatcgttttagaatcttggtcaaggtgggcagcctatggtatcttgcatgatccaaacatgcggaatttggcattgcggtttgtaaaacagcttggagatgcactgcattctataggctcagagaaaattagtgggcagaagctgcagctagtctatgttataggtccaccatcttccgagaagctgcaagagcatgactttggtcctaaagatctgagactttaagtgaagctgtggatgaattttcgttaatgacatatgacttttctaatcctcataatcctggtcctaatgcacctttgaaatggattcagattgttctgcagctgcttcttggtaactctggcagtagagcccaaagtcttgctccgaagatacttctcggcatcaacttctatggaaatgatttctccctttcaagagatgcaggtggtggtggagctattattgggagagattacttggcacttttggagaagcataggcctgaactgcagtgggataagaatagtggggaacattttttcacttacaatgacgacaaggatatcaaacacgcggtattctatccatctttgaagtcaatttctttgcggttagaggaagctcgttcatggggatgtggcatctcgatctgggaaattggccaaggtttggattatttttttgatcttctgtgaagcccacgtaccggcattaccttcagaagttttgtttgaggaaatttgccgttagtcagatacaacttgcaaagacacgatgatgtcatatcaaaagtggttgggtagaattatgccaaagaaacatatttacttgttttttattaaagaaaaaaaaa

SEQ ID NO: 2377 - DNA, 1341 bp, Lotus japonicus
agcttcttgggtaagaactccggcgacatggcgaagaaacgagatcaccgatcagccccgagctccggccaccgggaaaaccgattccagccaccttcacggcgaaaccaacggactgactcaacagcttccagtcgcagcaagctcattgctctcttcatcgtgtcgtcagtcatcgccatcgtcgcttactggttgagacaatcttcgccttcgcaatcgaaacacaaggaatcttatgtgtatcaacgaggccttgtcacaaccgatgccaattaccaagacatagtcactgagaattcaaatgtaccagaaaatagctctcaccgccattacacttatcctgtgcttggctacattactccctggaattctcggggttatgaactggcaaaaaggttcaactcaaagtttacacatttgtcacctgtctggtatgatttaaagagccaacagagtagcttagttctagaggggagacataatgcagacagaggatggatctcagaccttagaaaggcaggagaagccttgatcttgccaagatttgttctggaagcatcaccagcagagcttctgggaaagaaaaaacaaaggaacaaagccattaaccttatagtgacagagtgcaaggaaatgggatatgatggtattgttttagaatcttggtcaaggtgggcagcctttggtatcttgcatgatccagacatgcggaatttggcactgcagtttgtacaacagcttggagatgcactccattctataagctctgagaaaaattctgggcagcctttgcagttggtatatgttataggtccgccatcatctgagaagctgcaagagcatgactttggtccaagagatcttgagactctaagtggagctgtggatggattctcgttaatgacatacgacttctctaatcctcataaccctggtcctaatgcaccgttgaaatggattcaaattattctacagctgcttcttgggacctctagcagtagagcccaaagcgtcgcccccaagatacttcttggcatcaacttctatggaaacgatttctccctttcaaagggtagtaattcaggtggcggggcaattactgggagggattacttggcacttttagagaagcacaggccgcttctgcagtgggataataacagtggggagcatgttttcttttacaccgacgacaagggcatcaagcatgcggtattctacccatctttaaagtcgatttccttgcggttagaggaagctcattcatggggatgtggcatctcaatctgggaaattggacaaggcttggattatttttttgaccttctgtgaaagccc

SEQ ID NO: 2378 - DNA, 1521 bp, Glycine max
ttttatctatctacttggacatgaacgaaatcgatgttccttcgttctttctctgccccatttcgctagatatcatgaaggatccagtgacggtctcaacgggcatcacctacgaccgtgaaagcatcgaaacctggctgttctcgaagaaaaacacgacatgccccattaccaaactgcccttgatagattacaccgatctcacaccaaaccacacccttcgtagactcatccaagcgtggtgttccatgaacgcttctcacggcatcgaaaggatcccaacccctaaaccccccgttaacaagaaccaaatttcgaagcttctcaaagacgcttctcattcccctctcacatgcctcagaagactcaaatccatctcttccggaagcgaaacaaataagcggtgcatggaggcttctggcgctgttgagtttctagcatcaattgtaatcaacaccaaccgcaacattgattcttcacatgaggctgactcaaacgacggatctggattcgagttgaaaacaagtgcatgcgatgaagcgttgagtttgcttcataatcttcatttatccgaacaagggttgaagactctcttaagcttcagaaacggcgagtttattgagtctttaacaagagtcatgcaaaaggggttctttgaatcacgcgcttatgctgtgttcttgttgaaatctatttccgaagtggctgaaccagtgcaactattgcatctaagacaagaactttttgtcgaactggtacaagtcctgaaggatcaaatttcacagaagacatcaaaggcgacccttcaaaccctgatccaattctctccttgggggaggaacaggatcagagctgtggaagcagctgctgttcctgttttgattgagcttcttctcgattgcaaggagagaaagccttgtgagatgatgctggtgttgttggagctgctatgccagtgtgctgagggaagagcagaacttttgagccatgcagcaggtcttgccattgtgtccaaaaagattctaagggtttcgactttggcgaatgatagagctgttaagattattctgtctctttcgaggttctctgcgactccacatgttgttcaagaaatgctgaaactcggtgtggtcgcgaaattgtgcttggtgcttcaggtggatagtggaaacagggctaaggaaaaagctagagagatactcaaattgcatgctcgggcgtggaggaattctccatgcataccgaacaatttgcttaattcatacccgaattatgtgtgaaacaaaacgagaattttgaatggtgcctcttttagaaattttaatgtacagaattatttggaaaggatacagttaggtgtaagttataaatatgaggtgcaactaagcattgattgccccacaaaaaaagtataggtgggtagtgagattcaggttttgatttgtatttcctgacaattgtgtaatggatttttgttttgctataagctgacacagaaatgagaagaagaaagggttaatc

SEQ ID NO: 2379 - DNA, 1565 bp, Glycine max
acataaaatttataatttttctccaaaaataaattgggtgtgaaatcccattcagatcctctctcaccggataacttatactaccataaattaagaaaaataagttaacaaaactcagctcaattatttcacaccatataataatcacttggaaacaaccgcgctaaggttggaacttggaggaacttgtgtctgtgtgtccttttttccagagtcatggctatggctttgagtctctcccaattccctgttcgtgggtctgtttctttgcccaaaagaagactacccagaagaagcttttgcattaggggcatgtcagaaacctcttccacttcttctgtgagcacccaacaagaacaaccaacttctgataatgcttcttcagtgacaattgctcctccccctaacttcaagccccctgagcctaaacgctttgcaattaggcctgataagaccagtgaagtgtttggagctttgcttcctttgatctttcgttttgccactggagttttcgtttctgggtattctttttcaattgtttctaaggatgaaattcctacagacgaatatgctttggaacttaatggcgttaccataaaagaaacagcaaaattaggccctcgcccagagaagcctattgaaatatatgaatttgagagctgtccattttgccgaaaggttagagaaattgttgccattttggatcttgatgttcttttctatccttgtccaagaaatggcccaaatttccgtcaaaaggttctagagatgggtggcaaactgcagttcccctacatggttgacccaaacacaggcgcttcaatgtatgaatcagatgacataattcggtatttggttgacaaatatggcgatggaaacgttcctttatctttatcacttggatttttaacgacactaacggctggtcttggtatgcttagtcgtatttcaaaggggactacttatactccagcgaagttccctccaaagcctcttaaattatgggcatatgaggggtctcctttctgcaaacttgtacgtgaagtacttgtggaattggagctgccacacttgcttgtcagttgtgctaggggtagcccaaagagacatatactttatcagaaaactggaactttccaggcaccttttttggaagatccaaacactgggatagaaatgtttgaaagtgcagaaatcatagagtatctaagagcaacatacgctctttagtaagtgatgctatgatagggagaggcttgtaagggtttttaagtctcatgatatgcaccttcatttccttttgtaaatgtaattgctaatggttctaagttctaacgggtaaatcaaattttctctatatagaaatttcaaatagtggaatcaagtgcctcaatatttagcaatggtttgaggtggttaaaaatgtgggttgctaagtagggttctgtttcgttctttttatttgggacccttttcaatttcattcatcattattgcgcctacagctctaataactacataatgcccttgaaaatgatttttcattcttcaagtttgaacaattt

SEQ ID NO: 2380 - DNA, 1188 bp, Cajanus cajan
gcaaaacaagggtgctacaaggttggaggaacttgtccatggctatggctggagctttgagtctctcccaatttccactttgtgggtctatttcgttgcccaaaagagtacccagaagaaggttttgcgtcagagccatgtcagaaacctcttcagtgagcaccaaacaagaaccaacttctgatgcttcttcagtcacaatttctccacctcccaacttcaagccccctgagcctaaacgctttgcaatcagacctgacaagactactgaagtgcttggagctttgcttcctttgctctttcgctttgccactggagttttcgttgatgggtattctttttcatttgtttctaaggatgaaattcctccagaccaatttgctttggaaattaatggcattacggtaaaagaaacagcaaaattaggccctcgccctgagaagcctattgagatatatgaatttgagagctgtccattttgtcgaaaggttcgagaaattgttgctattttggacattgatgttcttttctatccttgtccaagaaatggcccaaatttccgtccgaaggttcttcaaatgggtggaaaactgcagttcccctacatggttgacccaaacacaggcgtttcaatgtatgaatcagatgacatcattcgatatttggttgacaaatatggtgatggaaacgtccctttatctttatcacttggatttataacggcactaactgctggtcttgctatgcttagtcgtatttcaaaggggacaacttatactccagcaaagttccctccaaagccacttaaattatgggcatatgaggggtctcctttctgcaaacttgtgcgtgaagtacttgtggaattggagctgccacacctgcttataagttgtgctaggggtagcccaaaaagacatatactatatcagaaaactggagttttccaggcaccctttttggaagatccaaacactggaatagaaatgtttgaaagtgcagaaatcatagagtaccttaaagcaacttacgctctttagaaagtgatgttatgagagggagaggcttttgggttttttttttttttttttttttttttttttttcttaactcaatcttatgcgccttcatttcctcttgtaaattctaatacgaataaatcattttcttatatggaaagttcaaata

SEQ ID NO: 2381 - DNA, 1260 bp, Phaseolus coccineus
  misc_feature (44)..(45): n is a, c, g, or t
taaaaccacaacaaggttggttttttttggaggaacctgtgtgnngtgtaccttttccaaactcatggttatggctgcagctttgagtttctcccaattccccgtttctgggtatatttgtttccccaaaaggagactacccagtagaagtttttacatacgagccatgtctgaaacctcttcttccacttctgtgagtagccaacaagaacaaccaacatctgattcttcttcagcttcatcctcgtcggtgacaattgctcctccccccaacttcaagccccctgagcctaaacgctttgccatcagacctgacaagaccggtgaagtgttcggagcgctgcttcctctcctctttcgctttgccactggagttttcgtttctgggtattctttttcatttgtttctaaggatgaaattcctccaggccaatatgctttggaacttaatggcattgtgattaaagaaacagcaaaagtaggtcctcgcccagagaaatatattgagatatatgaatttgagagctgtcccttttgccgaaaggttagagaaattgttgctattttggaccttgatgttgttttctatccttgtccaagaaatggtccaaatttccgtccaaaggttcttcagatgggtggtaaactgcagttcccctacatggttgacccaaacacaggtgtttcaatgtatgaatcagatgacataattcggtatttggttgacaaatatggtgatggaaatgttcctttatctttatcacttggatttttaacgacactaactgctggtcttagtatgcttagtcgtattggaaaggggacaatttatactccagcaaagttccctccaaagccacttaaattatgggcatatgaggggtctcctttctgcaagcttgtacgtgaagtacttgtggaattggagctgccacacttgcttgtcagttgtgctaggggtagcccaaagagacagatactatttcagaaaactggacattttcaggcaccctttttggaagatccaaatacagggatagaaatgtttgaaagtgcagaaatcattgagtatctaagagcaacatacgctcttcagtaggtgatgttagagggaaactcactcatcatatgtgccttcatttccttttgtagatgtaactgctaatagctctaacacgctcaaatcaatttttctctatatacaaatttcatacactttgaatcaagtccctcaatattcagcagtgatttaaggtgatt

SEQ ID NO: 2382 - DNA, 1201 bp, Vigna unguiculata
gggaacttgtgtgaagtgtaccttttccaaactcatggctatggcttcagctttgagtctctcccaattcccagtttctgggtatatttgcttccccaaaaggagagcaccaagtagaagcttttgcatacgtgtcatgtctgaaacctcttcttccacttcctcgtcggtgactattgctcctccccccaacttcaagcccccagagcctaaacgctttgccatcagacctgacaagatcggtgaagtgcttggagcggcgcttcctttgctctttcgctttgccactggaattttcgtttctgggtattctttttcagttgtttctaaggatgaaattcctccagaccaatatgctttggatctcaatggaattacgattaaagaaacatcaaaattaggtccccgcccagagaagtatattgagatatatgaatttgagagctgtcccttttgccgaaaggttagagaaattgttggtattttggaccttgatgttgttttctatccttgtccaagaaatggtccaaatttccgtccaaaggttcttcagatgggtggtaaacagcagttcccctacatggttgacccaaacacaggtgtttcaatgtatgaatcagatgcaataattcggtatttggttgacaaatatggtgatggaaacgttcctttatctttatcacttggatttttaacgacactaacggctggtcttggtatgcttagtcgtattggaaaggggacaacttatactccagcaaagtcccctccaaagccacttaaattatggggatatgagtgtctcctttctgcaagattgtacgtgaagtacttgtggaattggagctgccacacttgcttgtcagttgtgctaggggtagcccaaagagacatatactatatcagaaaactggacatttccaggtaccctttttggaagatccaaacactgggatagaaatgtttgaaagtgcagaaatcatcgaatatctaagagcaacctatgctcttcagtaggtgtaggtgatgttagagggagaatcagggtgttaattcacactcatgatatgtgccttcatttccttttgtaaatgtaattgctattggttcaaacactgtaaaatcaaattttctctatatagaaatttcagacagatgaatttgtcctttaattaatactcagcaatgatttaaggtgatt

SEQ ID NO: 2383 - DNA, 1221 bp, Vigna unguiculata
gcggaggaacttgtgtgaagtgtaccttttccaaactcatggctatggcttcagctttgagtctctcccaattcccagtttctgggtatatttgcttccccaaaaggagagcaccaagtagaagcttttgcatacgtgtcatgtctgaaacctcttcttccacttcctcgtcggtgactattgctcctccccccaacttcaagcccccagagcctaaacgctttgccatcagacctgacaagatcggtgaagtgcttggagcggcgcttcctttgctctttcgctttgccactggaattttcgtttctgggtattctttttcagttgtttctaaggatgaaattcctccagaccaatatgctttggatctcaatggaattacgattaaagaaacatcaaaattaggtccccgcccagagaagtatattgagatatatgaatttgagagctgtcccttttgccgaaaggttagagaaattgttggtattttggaccttgatgttgttttctatccttgtccaagaaatggtccaaatttccgtccaaaggttcttcagatgggtggtaaacagcagttcccctacatggttgacccaaacacaggtgtttcaatgtatgaatcagatgcaataattcggtatttggttgacaaatatggtgatggaaacgttcctttatctttatcacttggatttttaacgacactaacggctggtcttggtatgcttagtcgtattggaaaggggacaacttatactccagcaaagtcccctccaaagccacttaaattatggggatatgaggtgtctcctttctgcaagattgtacgtgaagtacttgtggaattggagctgccacacttgcttgtcagttgtgctaggggtagcccaaagagacatatactatatcagaaaactggacatttccaggtaccctttttggaagatccaaacactgggatagaaatgtttgaaagtgcagaaatcatcgaatatctaagagcaacctatgctcttcagtaggtgtaggtgatgttagagggagaatcagggtgttaattcacactcatgatatgtgccttcatttccttttgtaaatgtaattgctattggttcaaacactgtaaaatcaaattttctctatatagaaatttcagacagatgaatttgtcctttaattaatactcagcaatgatttaaggtgattaaaaatctggttgcc

SEQ ID NO: 2384 - DNA, 1326 bp, Phaseolus coccineus
atgtcataatacccatcaaagccacaatattcacccaaaacacaaactcactaaaaccacaacaaggttggttttttttggaggaacctgtgtgaagtgtaccttttccaaactcatggttatggctgcagctttgagtttctcccaaattccccgtttctgggtatatttgtttccccaaaaggagactacccagtagaagtttttacatacgagccatgtctgaaacctcttcttccacttctgtgagtagccaacaagaacaaccaacatctgattctccttcagcttcatcctcgtcggtgacaattgctcctccccccaacttcaagccccctgagcctaaacgctttgccatcagacctgacaagaccggtgaagtgttcggagcgctgcttcctctcctctttcgctttgccactggagttttcgtttctgggtattctttttcatttgtttctaaggatgaaattcctccaggccaatatgctttggaacttaatggcattgtgattaaagaaacagcaaaagtaggtcctcgcccagagaaatatattgagatatatgaatttgagagctgtcccttttgccgaaaggttagagaaattgttgctattttggaccttgatgttgttttctatccttgtccaagaaatggtccaaatttccgtccaaaggttcttcagatgggtggtaaactgcagttcccctacatggttgacccaaacacaggtgtttcaatgtatgaatcagatgacataattcggtatttggttgacaaatatggtgatggaaatgttcctttatctttatcacttggatttttaacgacactaactgctggtcttagtatgcttagtcgtattggaaaggggacaatttatactccagcaaagttccctccaaagccacttaaattatgggcatatgaggggtctcctttctgcaagcttgtacgtgaagtacttgtggaattggagctgccacacttgcttgtcagttgtgctaggggtagcccaaagagacagatactatttcagaaaactggacattttcaggcaccctttttggaagatccaaatacagggatagaaatgtttgaaagtgcagaaatcattgagtatctaagagcaacatacgctcttcagtaggtgatgttagagggaaactcactcatcatatgtgccttcatttccttttgtagatgtaattgctaatagctctaacacgctcaaatcaatttttctctatatacaaatttcatacactttgaatcaagtccctcaatattcagcagtgatttaaggtgattaaaaacgtggttgc

SEQ ID NO: 2385 - DNA, 1634 bp, Glycine max
accttaaaaaatttctcggtggcgttttgacttgaaacagtcgctgctgcgtcttcttcttcttcatccgtggcgttagggttttggtcggagtagccgttccccatggacgccgaagctgaccctcctcaaaaccctatcacaagacacaaatgcttggcatgctataagcaatataagaagaaagagcatcttattgagcacatgaaaacttcgtatcattctgttcatcagccaagatgcggggtctgtcaaaagcactgcaaatcttttgagtctctgagggaacatcttactggtcctttgccaagaggaatttgttcaaagattttctctcaacagggctgtcaactttgtctggcactatttgatagtcccgggtctctcattggtcatagagaaacatgtcgcttatctgcccctacttgtccaggaacaagtgcattgccctatatagattcccagtttgattgtcaagattcttctgatgaaaaccatgctggggagggccctggaggagcagttgcaatagactgtgaaatggttggtggtggaagtgatggttctctggaactttgtgctagagtgtgtttggttgatgaagatgagagattaatctttcatacatatgtacagcctgaaatacctgttactaattacagatatgatataactggattgacagaagagcatctcaaaaacgccattccacttaagaaagttcgagaaaagctactgcaaattctacagaatggggaatccattggcaaagttagactggatggtggaaaggccaggcttcttgtggggcatgacttagcacacgatttagattgcttaaaaatgaattatcctgatcatatgctgagagacactgcaaagtatcgtcctttgatgaaaacaaatttggtcagccattcgctcaagtatctcacccgaacatatcttgggcaatattattgttctttggtttacagttatgatatccaatccggcactcatgacccttatgaagattgtatttctgtcatgagactatacaagagaatacgatctcaacttcatccggaggaagaccatggaacaatgactctgagtaacaacattgttggcatgcctgatagctggatatctagggaacttgacaacctcacaccagatgaactttatgccatgtcaagatcagattataagtgttggtgcttggatttgataccaagattgtcagcctgaattattgatctttgcatttgtccataacatatcataagcatatttcttcaagaaccatgggaatggagcatttgcaatgatattctctgtgcatatctttctatgcatcgagttatcttccggacaagaaaattatgagaaaagataggggtgcttaatgatggagcttttgtaaatatttagaacgctttgttcaaatcacatgcccttgtttagaatgaagacttacctaccttctcattataatataggctcgaactaccgacaaaaaaacataaatggatgcaaggcttgttcttgatccaatttaaacggagccacttagatctaaattgctgattggtggtacaaggagctttcgttgtcaaaaaaattgatttcaaatacaaaatgtgttaagt

SEQ ID NO: 2386 - DNA, 1726 bp, Cajanus cajan
atgaaaacttgaagcagtggttgggtttagggttttcagagtagccgtttagcttgtttgtttcgatggaattcttctaaaaactcctttctctaacacacgaattacaaattaatcaatcgatcgtatcttcactacacgaaacgaagctttgctttaccattcctcatggacgctgaagcgggccctcctcaaaaccctacctcaagacacaaatgctcggcatgctataagcaatataagaaaaaagagcatcttattgagcacatgaaaacctcgtaccattctgtccatcagcctagatgtggggtttgtcaaaagcactgcaaatcttttgagtctctgagggaacatcttactggtcctctgccgaaaggaatttgttcgaagcttttctctcaacagggctgtcaactctgcttggcactatttgatagtcccaggtctctcaatgatcatagagaaacatgttgcctttctgcccctacacggctaggaacaagcactgtacctgatatggattcccaatttgattgtcagtactcttctgatgaaaaccatgctggggggttccctggagcagttgcaatagactgtgaaatggttggtggtggaagtgatggttcactggaactttgtgctagagtatgtttggttgatgaagatgagaacttaatcttccacacatatgtaaaacctggaattcctatcactaactatagatatgatataactggattgacagaagagcatctcagagatgccatgccacttaaggaagttcgagaaaagatattgcaaattttacacaatgcagaatcaatcagcaaagttagactggatggtggaaaggccaggcttcttgtggggcatgacttagcacatgacttatattgcttgaatatgcattatccagatcatatgctgagagacactgcaaagtaccgtccattgatgaaaacaaacatggtcagccattcgctcaagtatctaacaagaacctatctcggttatgacatccaatccggcactcatgacccgtatgaagattgtatttctgtgatgagactatacaagagaatacgaggtcaaattcatgcagaggaagatcatagaacattgactccgagaaacaacattgttgccatacctgatagctggaaatccaaggaacttgaaaacctcaccccagatgaactttatgccatttcaaaatccgactacaagtgttggtgcttggatttgaggccaagattggcagcctgagttactctcattgcaatgatcttttttgtatatacattatctttctatgcaccgtgttatcctctggacaagaaaacaatgagaaaagataggtgcttagttatggagcttttgtagatatctacaccgcgttgttcaacttcttgtccttgttcatcataaattataacgaaaacacaccttctctttatgatgaaggctctaactaccgacactaacataaatagatgtaagcctttgttcttgatccagtttcaacggagctactcttggatcgaagttgctgattggtacaaggaactttcgttttcaactaaattgtttttgtgagatttttaggaataaggcttttgagaaaaaaaatatatagtacgtgtatagttattattttactttattcaaaatactgtttatctgtaattacttgggaaaaaaaattagtaacttgagtaattaatta

SEQ ID NO: 2387 - DNA, 1730 bp, Phaseolus coccineus
gctgcttgcacagtagcacggtgcgttttgactcaaagcagtggttgcatcttcttccttcgtggggttagggttttggggtagctgaatttttcgtgtacccgacgatacgagaaaatgttgggattcttctattgacgttccatcgtatatgcgccacaccaaaccacgctttgcatgcgtttgatttaccatttgatatggacgccgaagcggactcaactcaaatccctaatataagacacaaatgcccggcatgctataaacaattcaagaagaaagagcatctaactgagcacatgaaaacctcaaaccattccgtccatcagcctgcatgtggggtctgtcaaaagcactgcaaatcttttgagtctctgagggaacatcttactggtcctttgccaaaaggagtttgttcaaagattttctctcagcggggctgtcaactttgcttggtactatttgatagtcccgggtctctcgtttctcacagagaaacatgtcgcttatctgcccctactcgtctaggaacacgaaaactgccctgtatagattcccaatttgactgtctagattcttctgatgaaaaccatgctggctggggccccggaggagcagttggaatggactgtgaaatggttggtggtggaagtgatggttctctggaactttgtgcaagagtatgcttggttgatgaagatgagaacttaatctttcattcatatgtacaacctcaaatacctgttaccaattacagatatgatataactggattgacagaagaacatctcagaaatgccatgcccctttatgaagttcgagaaaagattttgcaaatgctatacaatggagaatccattggcaaagttagactaaatggtggaaaggccaggcttcttgtggggcatgacttagcacacgatttagattgcttgaaaatgaattatcctgatcatatgctaagagacactgcaaagtaccgtcctttgatgaagacaaacttcgtcagccattcgctcaagtatctcacccgaacatatcttggttatgatatccaatccggcactcatgatccgtatgaagattgcatttctgtcatgagactatacaagagaatacgagctcaaattcatccagaggaagcccatgaaacaccgagtcacaacattgtttgcgtgcctgatagctggagatccagggaacttgagaacctcactccagatcagctctatgccatgtcaaaatcggattacaagtgttggtgcttggatttgaggcctagattggcatcctgaattgttttatcattgcatttctccacagcatcatatcataatatgcatatttcttcagacactttgaaaatggggtggtaaaatgttttgcagtgatattttcagtgcttatcgcatagtctggtcctcggatcaagaaaaatattgagcaaagacaggtgtttgattatgatgcttttgtaaatatatctaactgtttgttcaaaccaaataaaggctaccctttttagaatgaagacttgcctaccataataaaggctaccgacacaaacataaatggatgtaaggtttgttctagatccaatttcaacggagccacttagatctaagttgctgattggaacaaaaggacttttcattttcaaatataaacatgtttagttatcattattttttctttaaaacaatataccttctttctttacgacctgaaaa

SEQ ID NO: 2388 - DNA, 2608 bp, Glycine max
gcgaagcccaatgtcctcatccccataaacccctcggtgacggtggagaaaggaaagtacagctacgacgtggaaaccctaatcaaccgcctcaccgcgcttccgccacgtggcagcatcgcgcgctgccttgaccccttcaagaacaagctctccctcaacgacttcgccctcgtcttcaaggagttcgcgcagcgtggcgactggcagcgctccctgcgcctcttcaagtacatgcagcgccagatatggtgcaagcccaacgagcacatacacaccatcatgatcacgctattgggcagagagggtcttctcgacaagtgccgcgaggtgttcgacgaaatgccctccaacggcgtcgtccgcaccgtctactcctacaccgccatcatcaacgcctacggccgcaacggccagttccacgcctcgctcgaactcctcaacggaatgaagcaggagagggtttcgccgagtattttgacttacaacactgtgattaatgcttgtgctaggggtgggttggattgggaagggttgctagggttgtttgctgaaatgaggcatgaagggattcagcctgatgttattacttacaatactttgcttggtgcttgtgctcatagggggttaggtgatgaggctgaaatggtgtttaggaccatgaatgaaagtgggattgttcctgatattaatacttatagttatcttgttcagacgtttgggaagttgaataggcttgagaaggtttcggagcttcttagggagatggagtgcgggggtaatttgccggatattacttcttataatgtgttgttagaggcttatgctgagttggggtctatcaaagaggcgatgggtgtgtttaggcagatgcaggctgcggggtgtgtggcgaacgcggccacttatagtgttttgttgaatttatatgggaagcatgggaggtatgatgatgttcgcgatctttttcttgagatgaaagtgagcaacacggatcctgatgcggggacttacaacattctcatacaggtctttggggagggtgggtactttaaggaggtggtcactttgtttcatgacatggcggaggagaatgttgagccgaacatgcagacttatgagggcttgatatttgcctgtgggaagggagggctctatgaagatgccaagaaaattttactgcatatgaatgagaaaggagtagtgccgagttccaaggcttatactggggtgattgaagcgtttgggcaggctgctttgtatgaagaggctcttgtcatgtttaacactatgaatgaagttggaagcaacccaactgttgagacctacaattcgttaattcatgcatttgcaagggggggactgtacaaagaagcagaagcaattttatccaggatgaatgagtctggtttaaaacgggatgtacattcgttcaatggtgtgattgaagcttttaggcaaggaggtcagtatgaagaggctgtaaaatcttatgttgaaatggaaaaagcaaattgtgaacctaatgagctgacacttgaagcggtgttaagcatatactgctccgctggtcttgttgatgagggcgaggagcagttccaagaaattaaagcttcaggaatactgcccagtgtcatgtgctactgcatgatgctagctctttacgcaaagaatgacaggttaaatgatgcctataatttgattgatgcgatgatcacgatgagggtgtcagatattcatcaagtaattggacaaatgatcaagggagattttgatgatgagtctaattggcagattgtggagtatgtctttgacaaactcaattctgaagggtgtggattgggaatgaggttctacaatgcactgttagaagctctttggtgcatgttccagagagaaagggctgctagagtgctcaacgaagcatcaaagcgagggctgttccctgaactttttcgtaaaagtaaacttgtgtggtctgtggatgtacacaggatgtcggaaggtggtgcattaacagcactgtcagtttggctgaacaatgtgcatgaaatgtccatgaccggcgatgatcttcccgaggttgcaacagttgttgtggtccggggtcacatggagaaaaccacagatgcccaagatttccctatcgcaaaggctgccatttcattcttgcaggataatgtaccatcgtcctttgctttccctggatggaacaaaggtcgcattgtttgtcagcagtcacaactgagacgaattctgtcgggcactgaatcatcatctagtagaaaaaaaatggataaattaatatctttaagtaataccccattgactactgcaggagccataacatccaaatctgatgcgcaaagtggtaaagctaatggtgttgattctagaaccgatagtacaagaacagagcttctaacgagtgcaatttagattagattagaaagtatagaatttacattcatcactttcccatgccctgttttggtctatttgaaattaagattggggcttatttgttacacttccacgaaatattcccaagtgggactggctttttcaggtcgccgaaattttggtatatatattctcaaggtataat

SEQ ID NO: 2389 - DNA, 3007 bp, Cajanus cajan
atccacaaagaacaccacgtggccttttctcacttccgttaccaactcactctcttcttccaccaccacctcctccatttcccattcattccacaccaacaacaacatgccactgcgtaaccgtttccccaactaactcctcaaaacgaccgcgtcgcacaaaatgaccctttcacttttactttcacctgcaccctctctctccgtgcccaacccttcgccattcccccccgcgctcctcaacgcaaccaccaccaccctccgccagctcctcttcccgaggcggcggctccacctccaactccgagcgcgcgcggcgaagtccaaggacatcatcccggtgaacccctcggtgacggtggagaaaggaaagtacagctacgatgttgaaaccctaatcaaccgcctcaccgcgctcccgccacgtggcagcatcgcgcggtgcctcgaccccttcaagaacaagctatccctaaacgacttcgctttggtcttcaaggagttcgcgcagcgcggcgattggcagcgctcgctgcgcctcttcaagtacatgcagcggcagctatggtgcaagcccaacgagcacatatacaccatcatgataactctcttgggccgagagggccttctcgacaagtgccgcgaggtgttcgacgaaatgccggcaaacggcgtggttcgcagcgtctacgcctacaccgccatcatcaacgcctacggccgcaacggtcacttccaaacttcgcttgaactcctcagtggaatgaagcaggagagggttgctccgagtgttttgacttacaacactgtgattaatgcttgtgccaggggcgggttggattgggaggggttgttggggttgtttgctgaaatgaggcatgaagggattcagcctgatgttatcacttataacaccttgcttggtgcgtgtgctcataggggattaggtgatgaggctgagatggtgtttaggaccatgaatgagagtgggatagttcctgatatcaatacttatagttatcttgttcagacatttgggaagttgaataggcttgagaaggtttccgagcttcttagggagatggagtccgggggtaatttgccggatgttacttcttataatgtgttgttagaggcttatgctgggttggggtccatcagagaggccatgggcgtgtttcggcaaatgcaggctgccggctgtgtgcccaatgcggccacctatagtgttttgttgaatttgtatgggaagcatgggaggtatgacgatgttcgcgatctttttcttgagatgaaagtgagcaatgcggatcctgatgctggtacttataatattctcatacaggtgtttggggagggagggtattttaaggaggtggttactttgtttcatgacatggtggaggaaaatattgagccgaatatggagacttatgagggcttgatatttgcttgtgggaaggcagggctctatcaagatgccaagaaaattttactgcatatgaatgagaatgggatagtgcctagttccgaggcttatactggggtgattgaagcgtatgggcaggcttcactgtatgaagaggctcttgttgcgtttaacactatgagtgaagtcggaagcagcccaactgttgagacctataattcgttcgttcatgcatttgcaagggggggattgtacaaagaagtggaagcaattttattcaggatgaatgaggctggtttaaaacgggatgtgcattcgttcaatggtgtgattgaagcttttaggcaaggaggtcagtatgaagaggctgtaaaagcttatgttgaaatggagaaagaaaattgtgaacctaatgagctgacactagaagaggtgttaagtgtatactgctccgcaggtcttgttgacgagagtgaggagcagttccaagaaataaaagcttcaggaatactgcccagtgtcatgtgctactgcatgatgctcgctctttatgcaaagaatgacaggttaaacgatgcctataatttaatcgacgagatgaccacgatgagggtgtcggatattcatcaagtaattggacaaatgatcaagggagattttgatgatgagtctaattggcagattgtggagtacgtatttgacaaactcaattctgaaggatgtggattgggaatgagattctacaatgcactgttagaagctctttggtggatgttccagagagagagggctgctagagtgcttaatgaagcatcaaaacgagggctgttccctgaactttttcgtaaaagtaaactcttgtggtctgtggatgtacacaggatgtcggaaggtggtgcattaacagcattatcagtttggctgaacaatatgcaggaaatgtgcttgaccggcgatgatcttcctgagcttgcaacagttgtcgtggtgcggggtgacatggagaaaaacacagatgcccaagatttcccaatcgcaaaggctgcgattttattcttgcaggacaacgtcccatcatccttcactttccctagatggaacaaaggtcgccttgtttgtcagcagtcacaactgaaacgaattctgttgggcactgaatcatcttcaagtagaaaaaaaaccgataaattaatatctttaagtaatgccccattgactaccgcaggagttataacatccaaatctgatggtaaagctaataatgttgattctagaaccgatagtaccagaacagagcttctaacgagtgcagtttagattagaaaatatagaaattacattcatcactttcccatgccacgttttgatcggtttgaaatcaacattttggcacgtatttgttacacttgcactcattattcccatttcccaattgggctggctttcaagtcgccaaaattttggtatacatattctcaaggtatctgaatagttttctattggctccaatattttaacatgtgtatttgatttcctgattctgcataggagacaccacgaaaaatactctcttttttt

SEQ ID NO: 2390 - DNA, 3142 bp, Phaseolus coccineus
atccacgaaaaacaccacgtggcgtttcctcaattctgttaccatcgtcaacctcagtctcctcactccaacttcttccacctccattttccatttactctacattgctcttgttgatatgaacacgccactaggtaactgttttcccaactaggttcgcaaaacgaccgcgtcgcataaaatgaccctttctctttcatctcctatctctgtacccaacccttcacctttctcccccacgctcctcaacccaaccaccgccctccgccaactcttcttcgcaacctcccccaaacgaattttcaagttccaatcacgcgccaccaagttcaaggagctcatccccataaacccctccgtgacggtggagaagggaaagtacagctacgatgtggaaaccctaatcaaccgcctcaccgcgcttccgcctcgtggaagcatcgcgcggtgccttgaccccttcaaaaacaagctctccctcaacgacttcgccctcgtgttcaaggagttcgcgcagcgcggggattggcagcgctcgctgcgtctcttcaagtacatgcagcgccagctgtggtgcaagcccaacgagcacatatgcaccatcatgatcacgctcttgggtcgcgaaagcttgctcgacaagtgtcgcgaggtgttcgacgaaatgccaagcaacggcgtggcgcgcaccgtctacgcttacaccgccatcatcaacgcttatggccgtaacggccagttccaggcctcgcttgaactcctcgatgcaatgaagcaggagagggtttcgccgagtattttgacttacaacactgtgattaatgcttgtgctaggggtgggttggattgggaggggttgttaggattgtttgctgaaatgagacatgaggggattcagcctgatgttatcacttataatactttgctttgtgcttgtgctcatagagggttaggtgatgaggctgaaatggtgtttaggaccatgaatgaaagtgggatagttcctgatatcaatacttatagttatcttgttcagacgtttgggaagttgaataggttagagaaggtttcggatcttcttagggagatggaatctgggggtaatttgccggatattacttcttataatgtgttattagaggctcatgctgaattaggatctatcaaagatgcgatgggcgtgtttaggcagatgcaggctgcagggtgtgtgccgaatgcggacacgtatagtattttgttgaatttgtatgggaagcacgggaggtatgatgatgttcgtgaactttttcttgagatgaaagtaagtaacacggatcctgatgtgggtacctataacattctcatacaggtctttggggagggagggtacttcaaggaggtggtcactttgtttcatgacatggtggaggaaaatattgagcccaacatggagacttacgagggcttgatatttgcttgtgggaagggagggctttatgaagatgccaagaaaattttaatgcatatgaaagagaaaggaatagtgccgacttccaaggcgtacactggggtgattgaagcgtttgggcaggctgcactgtatgaagaggctcttgttgcatttaacactatgaaagaagttggaagcaacgcaacccttgagacctacaattcgtttgttcatgcatacgcaagagggggattgtacaaagaagcggaagcaattttatccaggatgaatgagtcaggtttaaaacgggatgtgaattcattcaacggtgagattgaagcttttaggcaagcaggtcagtatgaagaggctgttaaagctcatgttgaaatggaaaaagcaaattgtgaacctaatgagctgacacttgaagcagtgttaagtgtatactgcactgctgggcttgttgacgagagtgaggagcagttccaagaaatcaaagcttcaggactacttcccagtgtcatgtgctactgcatgatgctagctctttatgcaaagaatgacagatcaaaggatgcctataatttaattgatgaaatgatcaaaataagggtgtcggatgtccatcaagtgattggacagatgatcaagggagattttgacgacgagtctaattggcagattgtggaatacatctttgacaagctcacttccgaagggtgtgggttggggatgaggttctacaatgcactgttagaagctctttggtggatgtttcagcgagaaagggctgctagagttctcaatgaagcatcaaagcgagggctgttccctgaactttttcgtaaaagtaaactagtatggtctgtggatgtacacaggatgtcagaaggtgctgcattaacagcactatcagtttggctgaacaatatgcaggaaatgttcatgattagcgaggatcttcctgtgcttgcatcagttgttgtggttcggggtgagatggagaaaaccatagatgcccaagatttccctatcgcaaaggctgccatgtcattcttgcaggataatgtcccatcatcatcctttactttccctgaatggaacaaaggtcgcattgtttgtcaacagtcacaactgagacaaattctgagtggcactgaatcatcttctagtaggaaaaaaatgggtaaattaatatctttgagtaattccccattgactactgcaggtgctaaagcatccaaatctgatcgtaaagctaacgatgttgattctagaaccgatagtacgcgaactgagcttctaaccagtgcagtttagattagagaattaagaatttccattcatcactttcccatgctctgttttggtcgttttgaaattaagatagactggggacgtgtatttgttccacttccactaaatattcccttagtggtctgcattcaggtggccaaaattttggtatatataatattctctagctattcatctcagtacttgtctctcggcaccagtatatactttgaaaggatacaaaaattttaggcaagcgggcctgcaggttgagtttacatttttttagtttctattggtcactcctctttacctgcccactctactaacaacctgggggtcaaagatggagtggccgctgaccttcttttcgattaacaaaattatagattatttcaattttttttcttc

SEQ ID NO: 2391 - DNA, 793 bp, Nicotiana tabacum
  misc_feature (129)..(129): n is a, c, g, or t
  misc_feature (362)..(362): n is a, c, g, or t
gcccattacggccggggaacgcagttatctctatcagtcgcttaattttcccctctgtaaaagactctaaacatgagccgacaccctgctgtcaagtgggcccagaggtccgacaagctgtttatcacngtggagttgccggatgccaagaatgtgaagctgaaactggaaccagaaggaaaattcttcttttctgcaattgcaggagctgataatgtaccgtatgaagtggatctcgatctctttgataaaattaatgttgatgagagcaaaactagtactacttccagaagtatcgtgtatcttgtgaagaaggcagaagacaagtggtggagcagactgataaagcaggaaggtgtacntccagtatttttgaaagttgactgggacaaatgggttgatgaagatgaagaggacactaaacctgggacagatatggattttggtgacattgacttttcgaaactcaacatgggaggaggtcctagtgattttgatgctgatgtgcccgagggagacgatgacagtgacaccgaggaagaagaagtcaaggaggaagaagatagtgcacataatgaacctaaggcagcagtgcctccaagcacagaacccgaagcaaaagcttgatgcgttgtaatatctgaaaagcgttttaaccgcatgagttttactgtagtactgttagttgtggttagagcagttgtgtaggaattgatgttagtttatgttatatttgaaggattagacgttccatgtgattgaattttgttatcatatagctcttgttatttgg

SEQ ID NO: 2392 - DNA, 1391 bp, Solanum phureja
aaaacgcgtttacttttaacaaacattctttgcttttcttctttcatcttcttcttcccttcgattcaaatttcttttgctatgattctttctaaaaaactcatctttgttctgtttttgtcgatttctctatttctagttccagccagtgctatcagaggttttgttgacaagcccagaaatataaaaattgatgggcatttgaattatgttgaatctccagagtatcgtaatagcgaagaatgtccaattttagattctaatttgttgatttgtgacccaagtttgatacatgtagctatgactcttgatgtcaaatattttagaggatcagtagcagcagttcactctgttctcaagcattcatcttgtccagaaaatgtttatttccattttgtggcttcgaagaataaagattttcaagaactgagacagatggtgaagtccatatttccatctctgagttacaaagtttacagttttaatgaatttcgagtgaagaaattgatatcatcttcgattcgtcaagctcttgataatccattgaactatgctaggacttatttagctgagatcatccagccctgtattgaaagggtaatttatcttgattctgatgttgttttggttgatgacatccaaaagttatggtcgatttctttaactggttcgagaattattggagctccagagtactgtcaagcaaatttcagaacatattttaccaacaatttttggtctgacccgaaattatcgaatgtgtttcaagggaaaaaaccttgttatttcaatacaggggtgatggttatggatttagggaaatggagaaaaggggattatactgtaaagattgagaaatggatgaagatacagaaggagaaaaggatttatgaattgggatcattaccaccatttatgttggtatttggaggggaaattgaaggaattgatcatagatggaatcaacatgggcttggtggagataatttggtgaatagttgtagaacattgcatccaggtccagttagtttgttgcattggagcggtaaagggaaaccttgggtcaggcttgataaagggaatccttgtcctgttgatcttttatggatgccttatgatctgtatagacttagctcaattgattcttttgacgatcaagagcgaagagcgatgatttgattgtttaagcatcagtgtatagaagttaaaaccctatatcgataatttttttattcttttcctacattgggaaaaagtgagaacttagatccaggggatgattttgttcagtcccccctttgagttatttcttttgtgtataagagcaaattatttttgtaaagctattattctttcattttatttgtgataatcagagtattcatttgata

SEQ ID NO: 2393 - DNA, 1668 bp, Solanum phureja
ttcttatgcttatttctctttcctattttgttagcgcaatattcccttttagaaaatctgaattgaaagagacgagcataactagcgaggtgtttctcgaagctagagcttccagcattaaattaatgccctttgctaaactcactgttgataacacatagatcactgcgggatgaagaatacttcaagattttgagttttttgtataccctttttggtttttgtttgcttctttgcaactaggagctaagatggctgaggatatttgtttctttgccaaggatagtatcatcataaaacctcccaagaaatctccagcattgttaaggatggtggttgtagcgtttacgctgatctttggtatttatatctgttcaatttgtcttaaacaaactagcttggagaatacaagtaaatacttgaacattgaagtcatagaaaagccttgccataactatgacatggatcaatcccaaattccgtatgtgcattatccgaagccaaaaacctttagccgggctgaatgtagctgtaatgctgtacggcgctttgccattctctcaatgcaaaggtctgggagtggatggtttgagacactattgaatagtcatatgaacgtaagctccaatggtgaaatattctctgtcaaatataggagagaaaatgcttcttcaatcctgaggacattggacacagtttacaatttggacttctttacgagtgcttccaaaaatcactgctcagctgcagtgggcttcaagtggatgcttaatcaggggttaatagaacaccataaggaaattgttgagtacttcaataggaagggtgtttctgtgatatttctctttagaaagaatctactgcgacgtatggtttccattctttcaaattcccatgatcgatatgccaaactcttgaatggaacacataagtctcatgtgcactcacatgaagaggctggtactcttgctaagtataaaccagaaatcaatacaacattgttgatcacagatttgaaaagaatggaggtttctgccacggaggcactggactacttcaatagcactcggcatatgattctgtattacgaagatattgtcagaaatcaagctaaattggtagatgttcttgagtttctaagattgcctaacatggatctaagtagccggcaagtcaagatacataacgggccattgtggaagcatatcaagaactgggatgatgtgaacaagaccttaagtggaacagcttacgagaagttcctccgagctgattattaattctgacttctcactttcattgatcgatgaaggaggtgtagatatcaactgtgttttcttgtaaaagctgactggtatactctcaacttggaaaagcttcctgctgcatttgcctctgaagatcagtcgaaattcagcatagtaccaagtttcactctcatgtatctctagtattttttcttcttcctattttattccacattgaagtgtgtatatatagtgaagtagctaaagttgggagtagtcatagatttgtaggcaatatttctctctttcgttcttttcctttttgtaatttaataaagtagtcagtgagaggttattttctacttaaaattgtactaaatgattttgatggcactatttaagggtccaacaaaaaaatttc

SEQ ID NO: 2394 - DNA, 1428 bp, Solanum melongena
agggagtagcatggctccatttagattacggcattaattaagagtaaagagaagaagctccacatttccaagaagagaatcaatttcactcaaaaaaagctccttcttttaggttcacaattcccaaatgaagattctgtagaaacacccttttgatttatagcatggctgaagaaatttgtttctttacaaaggatgctctcatcataaagcctcccaagaaatctccagcattgttacggatgatagttgtagtgtttgcaatggtctgtggtgtttatatctgttcaacctgtcttaaacaaactaacaccgagacaacaagcaaactcttgaacattgaagttgtagaaaggccttgtcatgaatatgacactgaccgattgcagataccgtacttgcattatcctaaaccgaaaacctttagcagggctgaatgtgcctgtaatcctgtacggttgtttgccattctgtcaacacagaggtctgggagtggatggtttgagacactattaaatagtcatgttaatgtaagctccaatggtgaaattttctctgtcaaagagcggagagaaaatgcttcctcaatccttaggacgttagacatggtttacaatttggatttgttcaccagtgcttccaagaatcactgttcagctgcggttggcttcaaatggatgcttaatcaggggctaatacaacatcacaaggaaatcgttgagtatttcaataacaaaggtgtctccgtgataattctttttagaaggaatctgctgcgccgtatggtttcagtgctcgcgaattcctacgatcgttatgctagactcttgaatggaacacacaagtctcatgtgcattcatatgaggaggcttccactcttgcgaagtataaaccggaaatcaatacaacattattaatcacagatttaaagaaaatggaggtgtcaaccaaggaggcattggagtatttcaacagcactcggaatatatttttatattatgaagatcttgtcagaaaccacactaaactggtagacattctagagtttttaagattgccccaaatgaatctaactagtcgccaagtcaagatacaccgcggaccactgcaggaacatatcaagaactgggatgatgtgaacaagacattaaaaggaacaacttacgagagtttcctccgatctgactattaaattttccgcctttgtttattgatggaggaggaggtgtagatataaagagaaatccagtttagctccagttttcctttttgtttttccttattgcaagtgtaactaagctgagtatcaaatagtagtgtcttcttgtctcctttctttcaatgttcctggtttctaatcttttctgtaagttaactatggaaggcctaaatgtgccaattggtgcaatgatagcttatttacttct

SEQ ID NO: 2395 - DNA, 1430 bp, Solanum phureja
aaatggctccatgtagattacggcattaatacaagtaaagaagacaagctccatacttccaaaaacacttgttctcactataatttcattcaaataaagcttccaatttcactaaatgaaggggtcgctgtatatttgaggattctgtagaaagacagacccttttgatttatagctcaactataatggctgaagaaatttgtttctttacaaaggatgctctcatcataaaacctcccaagaaatctccggcattgttaaggatgatagttatagtgtttgcaatggtttgtggtgtttatatctgttcaacctgtcttaaacaaactaacactgagacaacaagaaaactcttgaatattgaagttatagaaaggccttgtcatgaatatgataccgatcgatctcagattccgtacttgcattatcctaaaccgaaaacctttagcagggctgaatgttcctgtaatcctgtacgtctgtttgccgttctgtcagcacagaggtctgggagtggatggtttgagacactattaaatagtcatattaatataacctccaatggtgaaattttctctgtcaaagagcgaagagaaaatgcttcctcaatcctgaggactttggacatggtttataatttggatttgatcaccagtgcttccaagaatcactgttcagctgcggttggcttcaaatggatgcttaatcaggggttgatacaatatcacaaggaaatcgttgagtacttcaacaacaaaggtgtctccgtaatatttctttttagaaggaatctgctgcgccgtatggtttcagtgcttgcgaattcctatgatcgttatgctagactcttgaatggaacacacaagtctcatgtgcactcaactgaggaggcttccactcttgcaaagtataaaccagaaatcaatacaacattattaattacagatttgaagagaatggaggcgtcaaccaaggaggcattggattacttcaacagtactcggagcataattttgtattatgaagatcttatcaaagaccacacgaaattagaagacgttatagagtttttaagattgccacaaatgaatttaactagccgccaagttaagatacacagcggaccactgcaggaacatatcaagaactgggatgatgtgaataagacattaaaaggaacagcttatgagagtttcctccgatctgactattaaatttttcgcctttgttttttgatgaagggggagatgtagatataaagggaaatatagtttagctccagtttttcttttctttccacattgcaagtgtaagtatcaaatagttgtcttcttcttttatcatccaatctttcaatgttgctggtttctaatctcctgtaagttaactatgaaaagactaaatgtgccaattggtgcatgtgatgaaag

SEQ ID NO: 2396 - DNA, 1787 bp, Solanum phureja
ggtgtagatcaacaaacaaattcagaaggaggaataaggagaagagtatgttcatgcacgaaagacgattttcttcctgaggaatcgttcaaaagctggggaaactacgcgaatgcactcatacaaacgccaacaagactaatcgataggatcctaacacgttctgaagacgaggaagagttggaatcaaagtcgcggagccagaatgaaatgaagaagacacttacttggtgggatttgatatggtttggaatgggagctgttattggagctggaatatttgttcttacaggccttgaagctaatcaagaagctggtcctgctgttgttttatcatatgttgtatctggtgtctctgctttgctctctgttttttgctacacggagttcgcggttgagattcctgtagcaggtggttcatttgcctacttgagggtggagttaggtgactttgttgccttcattgctgctggtaacatacttcttgaatatgtcattgctggtgctgcagtagctcgtacgtggacttcctatttcgcgactctactaaacttcagctcggataaattcctcatcaaagtggatagtttagcagaaggatacaacgagttagatccaattgctgttggagtttgtatcatcatctgtataattgcaattcttagtacaaagggctcgtctcgtctcaattacattgccactattgttcacattttcgtgatctttttcatcatcatttgtggcctaataaagtcggataccaagaactacaccccctttgctccatttaaagttcgcggaattttcaaagcttctgcagttctgttcttcgcgtatgttggattcgatgctgtttccactttggctgaagaaactaaaaatccaggcagagatattccaattggactaattggttctatggtgatcacaacttttctgtactgtttactagccataactttgtgcctgatgcagccatatcagatgattgatactcaagcaccattctccgtggcgtttaaatctgttggatggaattgggcacagtatattgtagctgcaggggcgttgaaaggaatgacatcggtgttgctggtgggtgcagttggtcaggctcgttatctaactcatatatcacgaactcacatgatgcctccttggttttctcaagtaaatgccaagacaggtacaccagtcaatgccacagctgtcatgtcatgtgcaacagcaatcattgccttattcacgaaactcgatatcctctccaacctcctatcaatctccactctctttattttcatgctcgtggcccttgctctcctcgttagacgttactatgttcatggtgagacaactatagcaaatcgcaacaaacttatcacgtttctcttgatcattcttgcatcctcagtcgccacggctacttattggggactaagtaaagatggatggattggctattgcattactttgccaatatggttactagcaacaattggactatggtattttgttcctcaagctagaaaaccaaagctttggggtgtaccactagtgccatggttaccatcagcttcaattgctattaacatttttctattaggttcactagatagagcttcattcatgagatttggtgtctggactggctttttgttggtgtattacttgttttttggacttcatgcttcttatgacactgcaaaagagtttgaaaggggtagaggatggaagaatattgaagagggaaaaggtgtagatagcaaagatattgttcctagtgcacc

SEQ ID NO: 2397 - DNA, 4294 bp, Solanum lycopersicum
aatgggtgttgagggtgtagatcaacaaacaaattcaggagtaaggagaagagtatgttcatgcacgaaagacgattttcttcctgaggaatcgttcaaaagctggagaaactacgcgaatgcactgatacaaacgccaacaagactaatcgataggatcctaacacgttctgaagacgaggaagagttggaagcaaagtcgcggagccagaatgaaatgaagaaaacacttacttggtgggatttgatatggtttggattgggagctgttattggagctggaatatttgttcttacaggccttgaagctaatcaagaggctggtcctgctgttgttttatcttatgttgtctctggtgtctctgctttgctctctgtattttgctacaccgagttcgcggttgagattcctgtagcaggtggttcatttgcctacttgagggtggagttaggtgactttgttgccttcattgctgctggtaatatacttcttgaatatgtcattgctggtgctgcagtagctcgtacgtggacttcctatttcgcgactctactaaacttcagctcggataaattcctcatcaaagtggacagtttagcagaaggatacaacgagttagatccgattgctgttggagtttgtatcatcatctgtataattgcaatacttagtacaaagggctcgtctcgtctcaattacatagccactattgttcacattttcgtgatcttttttatcatcgtttgtggcctaataaagtcggataccaagaactacacccccttcgctccatttaaagttcgcgggattttcaaagcttctgcagttttgttcttcgcgtatgttggattcgatgctgtttctactatggctgaagaaactaaaaatccaggcagagatattccaattggactaattggttctatggtgatcacaacttttctgtactgtttactagccatgactttgtgtctgatgcagccatatcagaagattgatactcaagcaccattctccgtggcgtttaaatctgttggatggagttgggcacagtatatcgtagctgcaggggcgttgaaaggaatgacatcggtgttactggtgggtgcagttggtcaggctcgttatctaactcatatatcacgaactcacatgatgcctccttggttttctcaagtaaatgccaagacaggtacaccagtcaatgccacagctgtaatgtcatgtgcaacagcaatcattgccttattcacgaaactcgatatcctctccaacctcctatcaatctccactctcttcatcttcatgctcgttgcccttgctctcctcgttagacgttactacgttcatggtgatacaactatagcaaatcgcaacaaacttatcacgtctctcttgatcattcttgcatcctcaatcgccacgtctacttattggggactaagtaaagatggttggattggctattgcattaccttgccaatatggttactagcaacaattggactatggtattttgttcctcaagctagaaaaccaaaactttggggtgtaccactagtgccatggttaccatcagcttcaattgctatcaacatttttctattaggttcactagatagagcttcattcatgagatttggtgtctggactggctttttgttggtgtattacttgttttttggacttcatgcttcttatgacactgcaaaagagtttaaaaggggcagaggatggaagaatattgaagagggaaatggtgtagatagcaaagatattgttcctagtgcacctatgatgacccagatggataaagggattgaaaatttgatgtcagcaagaaaatgtttgagggcaaattttgaaaagtcaaaagctttaggtttatctattgaaaaagctgggcctagattttatgagattattcagagattaccagctttggaggctgctataaggccaattagggctcagaaagatgctcttggtgctgttgggggacatattaatcgtgctgttgtccctgcgacggcggtgttaaaagtgtttgatgcaattcatggactagagaagtcgttgtctgatcctcaatcggacctcccggggtaccttggtgtgcttaagaggcttgaagaggcattaagatttttaggggagaattgtgagatggcaattcagtggttggcagatattgtagagtatctagaggatcatgcagttgctgatgacaggtttactttaagtatgaaggaggcattgacttctcttagggaattgcacagtggggaggaaaagggtcggcttgatggagggcttcttgaggttgcgttggacagattggaaagtgaatttcgacggctcttggttgaaaatactattccactgccaatgtctgatccagccttgccaggtgaacaagcatgcattgcgccctcgcctttgccagtgatcgttatccagaagctacaggctatactcggaagattgattgctaataacagactcgataagtgcatatctatttatgttgaggtgaggagttctaatgtccggacaagtttgcaggctcttaatttggattatttagaaatttcggtctccgagttcaatgatgtgcagagcatagagggtcacattgctcagtggggtaagcatttagaatttgctgtaaaacatctttttgaagctgaatataaactttgtaatgatgtgtttgagagaatcgggttggatgtgtggatgagctgtttcgctaagatagctgcccaagcaggcattcttgcattccttcaatttggaaaaacagtgacagagagtaagaaggatcctatcaagctgttgaagctgttggacatatttgcatctttaaacaagttaagattggatttcaatcggctctttggtggaactgcgtgtttggaaatacaaaatttgactagggatttgatcaagagtgtgattgaaggtgctagtgagatcttttgggaacttctggttcaagttgagttgcaaaggcaaatgccacctccacctgatggtactgttccgaaacttatcattttcatcaccgactattgcaataagttgctcggggatgattataagtctatcctcacccaagttctgattattgaaagaagttggaagcaggaaaaatttcaagagcggcttctcattactgagctactgaatataatgagagctgttgacgtgaatttagagacatggtcaaaggcctatcaagatgttattttgtcatatgtgttcttgatgaataatcattggcatctatataagcatttgaaaggaactaagcttggaggtctgttgggagattcttggttgaaggagcatgaacagtacaaggagtactattctgcctttttcttgaaagaaagttggggaaagcttcctgctttattaagcagggaaggtcttattttgttttcaggtgggcgcgccaccgctcgtgatcttgtcaagaaacgattaaaagcttttaacgaagcgtttgatgaaatgtataagaaacagtctaattgggtaatgctggacaaagacctacgggataagacatgccagtcaatcattcaagcaattgtgcctgtttaccgaagttacatgcagaactatggaccattggttgaacaagaaggaagtggcaaatatgtgaaatatacagctcaatctttagaaaaagtgttgaacggtctgtttcattcaaaacctgtgaaacatggtagttttaaagttcgacatcctagtggaaaattcagcaatgttgtaacagatcagaatcagacctctcctactgttaagtaatcgttagattattatcattaaggcaacagttaaacttgacaggtcttctggtgttcatctgtcactctgtgtatagtaagtttctgaaggattcattcactaccatttagcaaggtcgtatttacaagcataaagaagcacatcgtcgccacacaaaactgttgacacactgggatgcagctatcctcaacgtgcctcttagttagagctaagcctattcaatttgtctcgcatacttactgattagttcagcgacaaagtaagaagcagtactgtcacctggatcgttgtcgcagctgtcttgtacaatataggtaattttcatttctagaggtttaccaattcttatatgtatccttacataatatgcaacctgttatttattcctgttagatggaaatgtcagttgaagtagagctctgagcgttagccggaacgttgtttatcaataaagacaatatgttgtcttct

SEQ ID NO: 2398 - DNA, 762 bp, Solanum phureja
ccattctccaccaagtgactcaaagaatttacttccattccatggccaaactaatactccaaatcttcaccatttccatcttcctttctctggtggcctttccggccaccggagaagaagatacttatagttttggaaaatctataaacaaaaaacccacaaggttaaaaaaggaaaaattcagtcattttcgattttattggcatgatattctaagtggttcaaaaccaacatcaatgatgattattccaccatctaaaaacacaacaacaggttttgggcaaatgaatatgatagataatgccttaaccttaggaccagaattaagttccaagattgttggaagggcgcaagggttttatggtgctgcttcacttaatgatgttggtttaatgatggttatgaattttgcttttattgaagggaaatataatggaagtacttttactatacttggtcggaatccggtgttcgagaaggtgagagagatggcggtgatcggagggagtgggcttttccgatttgctagaggatatgttgaagctagtactcattcatgggatttcaaaactggagatgctactgttcagtatgatgcttatgtcttgcattattgaggttttactaattttatatattttcatcgtgtcaatttatgagatgtagtctacacgaattttaagaattgtataagaatatattttgtattattgttccaaaattattcataaaaagggtagacatttgttgactttttactaa

SEQ ID NO: 2399 - DNA, 716 bp, Solanum phureja
aaagaatttacttccattccatggccaaaataatactccaaatcttcaccatttccatcttcctttctctggtggcctttccggccaccggagaagaagatacttatatttttggaaaatctataaacaaaaaacccacaaggttaaaaaaggaaaaattcagtcattttcgattttattggcatgatattctaagtggttcaaaaccaacatcaatgatgattattccaccatctaaaaacacaacaacaggttttgggcaaatgaatatgatagataatgccttaaccttaggaccagaattaagttccaagattgttggaagggcgcaagggttttatggtgctgcttcacttaatgatgttggtttaatgatggttatgaattttgcttttattgaagggaaatataatggaagtacttttactatacttggtcggaatccggtgttcgagaaggtgagagagatggcggtgatcggagggagtgggcttttccgatttgctagaggatatgttgaagctagtactcattcatgggattttaaaactggcgatgctactgttcaatatgatgcattattgaggttttactaattttatatgttttcgtcgtgtcaattttataagatatagtttaattggatacaaaatttatgaaatatcatattttgttcatccttttgatatatatcaagcattatgtttttcggataa

SEQ ID NO: 2400 - DNA, 771 bp, Solanum melongena
ttataaaaaacgagtatccgcacatatggtttcattcttcaccaagtgactctacttccatggccaaactatcactccaaatcttcaccatctccattctcctttttctggttgcctttccggcaaccggagaagaagataattatacttttggaaaatccataaataaaaagtctatgaggttaagaaaggagaaactcagccatttcagattttattggcatgatgtcctaagtggctcaaaaccaacatcaatgatgattattccaccacctaaaaacaccacaacaggttttggacaaatgaatatgatagataatgccttaaccttaggagcagagttgagttccaagattgttggaagggcacaagggttttacgctgctgcttcacttaatgatgttggattaatgatggtaatgaattttgcttttattgaagggaaatataatggaagcactttcactatacttggacggaatccggtgtttgagaaggtgagggagatggcggtgatcggaggaagtggacttttccgatttgctagaggatatgttcaggccagtactcattcatgggattacaaaactggagatgctactgtgaagtatgatgcttatgtgttgcattattgaggtttaattaataattttatgtatttctttctttgcttatgagatataatttaattagatacggaatttattaaatatgagaagattctactatcaatgtttcaaaattatacttagaaaagtatattttttgggc

SEQ ID NO: 2401 - DNA, 2006 bp, Solanum phureja
atattcatttgagagagaataaaaaaattataaacacacaaaaaaaattcatcttccgccgcccaccgttgcatggccaataaagttttttgtccgaaactccttaagaacctcggatttcatgtccgccgtttaaactcagctccgtcacctctttccgccgtcccaccgttaaatttcactggcgattttaacgccgtggaacccgcaccacagattaacacaaaccaccacgaccatcataatactaataacattatcaatttcgatgatgttaaggagctattctacggcgttccgaccaagaaactgattcgatcatcgatgacgttacaaatggctgctattgatcccatggttgatttgggtatgtggataatgaattctaaacttatggaaatgcctgtttttagggaggttatgcttggatttgttaaaaatacattttatgagcatttttgtgccgggaaagacttaacggaagttagacggaccgttaccaatctatctgattctgggttaaaagccatgcttgattatggggtggaacatgccaccgataatgaatcttgtgaacagagtacggcggcctttattcaaacgattgaatcaaccgaatcacttcccgaatcttcagcaagctttgtggtagcaaagataactgcaatttgtacaccaaggcttctaaaaagaatgagtgatttgttaagatgggaacagaaagatccatcattcaatcttccgtggaagcaagagtcgcttccacttttcgccgaatcgagccctatttatcacacttggagcaaaccagagcctctaacggtagaggaagaacgtgatcttcaattagctcatgaaagacttaggaaaatttgcgagaaatgtttggaacatcaagttcctttactaattgatgcggaagacacaacaattcaacctgcaattgattactttgcgtattctgcagcaattaagtaccataaagatgatcagcctttgatattcggaacaattcaagcttacttgaaggacgctaaggaacgaatggttatcgctaaaaaggctgcagagaaaatgggagttccaatgggatttaagcttgtgaggggtgcttacatgtgtagtgaaaaggaattggcttctactttaggattcaagtctccgattcacgatagcattgagcaaacacacgcttgcttcaattcgtgtgcggagtttatgattgaagagattgctaatggatctggtgcagttgttctcgccactcataacattgagtcaggaaaacttgctgcaaccaaagctatagatttgggaataaaaaatgagaggcaaaatctccaatttgctcagctatatggtatggcagatggtctttcatttgggctgagaaatgcaggatttcaagttagcaagtatttgccatttggtcctgtagagcagattatgcattaccttatgaggcgtgctgaagaaaacagaggcatgttgtcaacatcggcattcgataggcaactcatgaggaaggaattgagcaggagactggaagtggcaacttcttaaattaatattgagaatgtgaaatctatattagtaagtaagaataataaacgaggaaacatcaccgactattgtaaataattcaatgatgtgagggcaaaaattgatgatgatgataatgaagatcaaagcaaccatggatgggtaaaatgcatgaggaggaagtcagtttatcttcttgtgtgttatggaaaataaaaaaatgtacatatttattttaggtccacttgttgtatctttctccatgtgctattttaggttctattatattactatatataatgtagtagcaccttaagttggttatatttggtatcgtgttttagaaatagaagtggaagaaggtactccctagagtggagccaaaatgttgaaattacaaagtgtgtatctgtttctctctctctctctatcgagacattatgaaataaatcagatttactgga

SEQ ID NO: 2402 - DNA, 2002 bp, Solanum tuberosum
tgagagagaataaaaaaatataaacacacaaaaaaaattcatcttccgccgcccaccgttgcatggccaataaagttttttgtccgaaactccttaagaacctcggatttcatgtccgccgtttaaactcagctccgtcacctctttccgccgtcccaccgttaaatttcactggcgattttaacgccgtaccaaatttggtggaacccgcaccacagattaacacaaccctccaccaccacgaccatcataatactaataacattatcaatttcgatgatgttaaggagctattctacggcgttccgaccaagaaactgattcgatcatcgatgacgttacaaatggctgctattgatcccatggttgatttgggtatgtggataatgaattctaaacttatggaaatgcctgtttttagggaggttatgcttggatttgttaaaaatacattttatgagcatttttgtgccgggaaagacttaacggaagttagacggaccgttaccaatctatctgattctgggttaaaagccatgcttgattatggggtggaacatgccaccgataatgaatcttgtgaacagagtacagcggcctttattcaaacgattgaatcaaccaaatcacttcccgaatcttctgcaagctttgtggtagcgaagataactgcaatttgtacaccaaagcttctcaaaagaatgagtgatttgttaagatgggaacagaaagatccatcgttcaatcttccatggaagcaagagtcgcttccacttttcgccgaatcgagccctgtttatcacacttggagcaaaccagagcctctaacggtagaggaagaacgtgatcttcaattagctcatgaaagacttaggaaaatttgcgagaaatgtttggaacatcaagttcctttactaattgatgcggaagacacaacaattcaacctgcaattgattactttgcgtattctgcagcaattaagtaccataaagatgatcagcctttgatattcggaacaattcaagcttacttgaaggacgctaaggaacgaatggttatcgctaaaaaggctgcagagaaaatgggagttccaatgggatttaagcttgtgaggggtgcttatatgtgtagtgaaaaggaattggcttctactttaggattcaagtctccgattcacgatagcattgagcaaacacacgcttgcttcaattcgtgtgcggagtttatgattgaagagattgctaatggatctggtgcagttgttctcgccactcataacattgagtcaggaaaacttgctgcaaccaaagctatagatttgggaataaaaaatgagaggcaaaatctccaatttgctcagctatatggtatggcagatggtctttcatttgggctgagaaatgcaggatttcaagttagcaagtatttgccatttggtcctgtagagcagattatgcattaccttatgaggcgtgctgaagaaaacagaggcatgttgtcaacatcggcattcgataggcaactcatgaggaaggaattgagcaggagactggaagtggcaacttcttaaattaatattgagaatgtgaaatctatattagtaagtaagaataataaacgaggaaacatcaccgactattgtaaataattcaatgatgtgagggcaaaaattgatgatgatgataatgaagatcaaagcaaccatggatgggtaaaatgcatgaggaggaagtcagtttatcttcttgtgtgttatggaaaataaaaaaatgtacatatttactttaggtccacttgttgtatctttctccatgtgctattttaggttctattatattactatatataatgtagtagcaccttaagttggttatatttggtatcgtgttttagaaatagaagtggaagaaggtactccctagagtggagccaaaatgttgaaattacgaagtgtgtatctgtttctctctctctctctatcgagacattatgaaataaatc

SEQ ID NO: 2403 - DNA, 1310 bp, Solanum phureja
aagagaaagagagagagagagagaggtttagagagagaaaaaagagggagttttagagagagaaagtaaaagagagagaagtgcggctaatgggagattcgagcgactccgtttcggtggatatggaaacaatctccgtcgccggaaaggagcaccttgtaaaaactggccgtggttatgtctctgttgctgtttttggggaccaggacaagccggctcttatcacctatcccgatttagctttaaattatatgtcctgtttccaaggagtattctattgtccagaagcattttcattgctgctccataacttctgtatttaccacataagtcctcctggtcatgagttgggagctgctgtcatgagtcttgatgatcctgtcttatcggttgatgatttagcagaccagattgtggaggtgcttgattacttcaggcttggtaaagtaatgtgtatgggtgtaacagctggagcatatattcttactttgtttgcgataaaatacacacaaagggttatgggtttgatactcgtttcccccttgtgcaaagcaccctcttggacagaatggttgtgtaataaggtgatgacaaatctgctttacttttgtggcatgtgtactttggtgaaggagttactgctgttgcggtactttagcaaggaagtccgcggcagtgttgaagttccagaatcggatgtagttcaagcatgccgaagattgctaggtgagagacagagtccaaatgtattgcggttgctcgaagctatcaatgagagaccagacataacccaaggcttgcggaaactaaaatgtcgttctttaatatttgttggagagagctctccttttcattccgaggctctccatatgacatcaaagttagatagaaggttcagcgctctagttgaggttcaagcatgtggttcaatggtgactgaagagcagccagatgcaatgttgatcccactggaatactttctaatgggatttggattttatcgaccgtctcagtgcaatgtcagcccaagaagcccgttaagtccaaccagcatctctccggagcttttctcgccagaaagtatggggttgaagttaaaaccaattaaaaccagattttctgaagaagtatgagtctgggctcaaagttaaaataagtttttgtaaaatttgtaagcatacattgaagatccactttgattgaagacagttaggaatgtgaatttataggagggagggagggttgtagataagagagttggaaaatagaaagtggaagaaaaaacaaaaggaaaaaagagtttttttttt

SEQ ID NO: 2404 - DNA, 1450 bp, Ipomoea nil
aggagatagggagattcgtatatatatgagtatggctcccaaatccaacgcatttcaagagagagagagagagaaagagagagagagagagagagagagacatagcgcgatagagtgcggcggcaatgggagactcaagcgactctgtgtcggtcgacattgataccatctccctcgccggaaaggagcatattgtaaaaactggccatggttccctctccgttactgtttttggagaccaggacaagcccgctcttattacctaccctgatctggctttgaattatatgtcgtgtttccaaggattgttcttttgtcccgaagcattttctttgctacttcataatttctctatataccatataagtcctcctgggcatgagttgggagctactacaattagtcctgatgaggcagtattatccgtagatgatttagcagaccagattactgaggttcttgattacttcggacttggtgcagtggtgtgtatgggagttacagctggagcttatgttcttactctgtttgcgataaaatacacgaaacgtgttatgggtctgattcttgtttcccctctgtgcaaagcgccctcatggacggaatggctatgtaataaggttatgtcaaatctgctttacttttgcggcatgtgtagtttggttaaggagttgttgctcatgcgctactttagcaaggaagttcgtggtagcgtagaagtacctgaatccgatgtagttcaaacatgccgaagattgctgggtgagagacagagcccaaatgtctggcggtttcttgaagctatcaatgagagaccggacattacagaaggcttacggaggctgcattgtcgttcattattattcgtgggcgaaaactctccattccatttcgaggctctccacatgacttcgaagctcgacagaaggtttagcgctttagttgaggttcaagggtgcgggtcaatggtaacagaagagcaacccgatgcaatgttgataccgttggagtacttcctcatggggttcgggttttacaggccatcgcagtttagcgtaagcccaagaagtccgttaagtccaactagcatctcccccgagcttttctcaccggagagcatggggttgaagttgaaaccgattaaaacgaggatttctatagaggtatgagacaagcagaagaagatgaaagcagggtaaaggggggtgggtgattttgtgtaagatatgtaacaaaatcccagatttgaagatttaaggtcagggtagaaaaaagttacacgtggattgtagataagagaaatagaaggtgagagaaatgatagagagaataatatatatatttttttcccccttttttttttttcaacgtttgtaatcgaaataattagtcataatcttgtacatcccagaataatttattgttttgatgatgatgagaaaggaatacc

SEQ ID NO: 2405 - DNA, 1332 bp, Amsonia hubrichtii
acggcggcaaaatgggggactcgagcggcgaatcggtttcaattgatatggagaccatgtcatttgccggaaaggagcacctcgtcaagactagccgtggttctgtctctgttgctgtctttggggaccaagacaagccggctctaatcacatatcctgatttggctttaaattatatctcatgtttccaaggattgttcttttgtccggaagcattttctttgctggtccacaacttctgtatttaccatattagtccccctggccatgagttaggagcccttgcaatgagccctgatgagccacccttatccgttgatgatttagctgatcagattgccgaagttcttgactattttggtcttggcactgtgatgtgtatgggggtaacagctggggcttacattctcaccctttttgctataaaatattcacggagagttatgggtttgatactcatttcccctctatgtaaagctccatcttggacagaatggttgtgtaataaggtgatgtcaaatttgctttacttctgtggtatgtgtaccttggtgaaggaattattgctaatacggttctttagcaaggacgttcgcggcagtgctgaagtaccagagtctgatattgttcaagcatgtagaagacttctgggagagagacagagtccaaatgtgttgcggtttgttgaggcaatgaatgagagaccagatattaccgatggcttgagaaaattgaaatgtcgctctttaataattgttggagagaactctcctttccactcagaagcactccatatgacttcaaagctggatagaagattcagtgccttagttgaggttcaagcatgcgggtcaattgtgacagaggaacaaccagatgcaatgttgataccaatggaatatttcctaatgggatatggcttctatagaccccctcaactcagtgcaagcccgagaagccccttgagtccgactagcatctccccagagctcttttcaccagaaagtatgggattgaagttaaaaccgataaagacaagaatggctctataagtttgagaagagtgaagaatgggagacaaatttttgttcctttgtaatctatgcaagccaaagggagacttcaatagtgggcagggcaacctagaatagaactgtagatagaattgaaaagataggagtggaaagcaacatttgagtagaaagtatttcaattttttcttaaattttccacaagatttgtaatcacagtttgtagtggcaggtttctcgacattatctgtacatctcagaataattatttgttacaacagatcaataaagtataataaaa

SEQ ID NO: 2406 - DNA, 1438 bp, Tabernaemontana elegans
aaattggtatataagctatgaagaccttgaaacaaatgtgtctcctaccttcatcttgaaagaaaaagagagagaggtttcgaggggagagaacagcagcaaaatgggggactcgagcggcgaatcggtttcaattcatatggagaccatgtcatttgccggaaaggagcaccttgttaagactggccatggctctgtctcagttgctgtctttggagaccaagacaagccggctctaatcacgtatcctgatttggctttaaattatatctcatgcttccaagggttgttcttttgtccagaagcattttctttgctggtccataacttctgtatttaccatattagtccacctggccatgagttaggagcccttgcaatgagccctgatgagccagccttatctgtagatgatttagctgatcagattgctgaggttcttgactattttggactcggtactgtgatgtgtatgggggtaacagctggagcgtacattctcaccctatttgctataaaatatacacacagagttatgggtttgatacttatttcccctctatgcaaaggaccatcttggacagaatggttatgtaataaggtgatgtcaaatttgctttatttttgcggtatgtgtaccttggtgaaggaaatattgctagtacggttttttagcaaggaagttcgcggcagtgctgaagtaccagagtctgatatagttcaagtgtgtagaagattgctgggagagagacagagtccaaatgtgttgcggtttgttgaggcaatgaatgagagaccagatattagtgacggtttgagaaaattgaaatgtcgctctttaatatttgttggagaaaactctcctttccactcagatgcgctccatataacttcaaagctagatagaagattcagtgccttagtcgaggttcaagcatgcggatcaattgtgacagaggaacaaccagatgcaatgttgataccattggaatatttcctaatgggatatggcttctacagaccacctcaactcagtgtaagccctagaagccccttgagtccgactagcatctccccagagctcttttcaccagaaagtatgggattgaagctaaaacctataaagacaaaaattgctctctgagtatgagaagatgagaaagtgaagatggaagacaatttttgttcctttgaaatctatgcaaagccaaagggagacttccaactatagtgggggaggaaaatctagaccagaactgtagatagaaatgaaaagatagaaagtggaaatcaacaatagaatagaagagatttgagtttttttcttaaattttccacaagatttgtaaccacaagttatatagtgcacgtgtgtaaacactttatgtacatctcagaataatttatttgttacaatagagcaataaaatgaaaaatg

SEQ ID NO: 2407 - DNA, 1562 bp, Lippia dulcis
gagagagaggggtggattggtatgtaagctgtggatgccaaatccaacgcgtcttgaatttgagaaaaggaaataataatagagagagaaagagagatttctagtgagaagaagtgcaatggcggattccagcgattccgtctccgtcgatatggagtccattcctctcgccggaaaggagcatattgtgaagactagtcaaggtgcagtctctgttgctgtctttggtgaccaggacaaacccgctctaattacgtatccggatttggctctaaactatatgtcatgttttcaaggattgtttgattgtccagatggattttctcttctcctccacaacttctgcatctaccacataaatcctccgggtcatgagttaggagctgctgtagctgcccatgatgagcccttgttgtccgttgatgatttggctgatcagattgctgaaatcctcaattattttagacttggtcctgtgatgtgtctgggtgtaacagctggagcttatattcttaccctgtttgctataaagtactcacaacgtgtgatgggtctgattcttgtttcccctctatgcaaagctccatcttggacagagtggttatgtaacaaggtgatgtcaaatttgctttacatttgtggtatgtgtggcgtagtaaaggagctgctgctcatgcgctacttcagcaaggaagttcgtggaagtgtcgatgtacaagaatcagatattgtccaatcgtgtagaagattgctgggtgagagacagagccctaatgtgttgcggtttcttgaagctatgaatgggagaccggacatcacagacggattgaggaaattgcagtgccggtccttgatatttgttggagaaaactctccattccactatgaagctcttcatatgacttcaaagctagataggagattcagtgccttggttgaggttcaagcgtgtgggtcgatggttacagaagaacaaccagatgccatattgataccactagaatatttcctaatgggatacggctttttcagaccgtctcagtatagcgcaagcccgagaagcccattaagcccgaccagcatttcgcccgagctcttctcacccgaaagcatgggcttgaagcttaaaccaataaagacaaggattcaagaacaagtttgagagcacaactaaggaaagggcaagtttttgtaaactatgtaacattggaagagttacaggaggcttgtagataaagataaagacacgattaagttagcaagatttggaagcagagaaaataggggagggagaaaaatatatgcatacgggaaagagatggtccacaagtttaatttttggtatttctgttttcttttttttgggttcttccacttgtaatgtaaagaagtgttagttgaggattagtgagtgatctgtgtacatcattcgaataattaaattattagagaccttcaaacaggaaataaagaattgaataataaactgtaggtgaagttttgtgttttatttgttgtcgtcgtgttcatggttttcattgatgaggtgtaaaagaaactaa

SEQ ID NO: 2408 - DNA, 1315 bp, Vaccinium corymbosum
tggcggattcaagcgattctgtttccattgacatggaaacaatctctcttggcggaaaggaattcctcgtaaaaactggctgtggccccgtatctgttgttgtgtgcggagatccggataagccagctcttgttacttatccagatttagcattgaatcatatgtcctgctttcaagggttattcttttgtccagaagcattttccttgctgctccacaacttctgcatctaccatataagtcctccagggcacgagttgggtgcggctataattaaccctgatgacccggtgctatctgcggatgacttagcagatcagattgcagaggttctagactattttggacttggtgcagtgatgtgtatgggggtgactgctggtgcttacatcgtaactttgtttgcgatcaaatatccacaacgaactcttggtttgatactcatctctcctctatgtaaagcaccatcatggacagaatggctgtgcaacaaggtgttgtcaaacatactttactattatggcatgtgtagcttggtgaaggatttgttgcttatgcgatacttcagcaaggaagttcgtggtagtttgcaagtaccagaatcagatatagttcaagcgtgcagaagactactggatgaaaggcagggtccaaatgttttacagttccttgaagctattaacgggagaccagacattactgaaggactcaagaaactaaaatgccggtctctaattattgttggggagaactctcctttccacgcagaggctcttcacatgacttcaaaactagatagaagattcagtgcgttagttgaggttcaggcatgtggttcgatagtgacggaggagcagccccatgccatgttaataccattggaatacttcctcatgggattcggcctctaccggccgtctcagttcaacgtcagcccaaggagcccattgagcccgacatccatttcaccggagcttttctcaccggagagcatgggcttgaagttaaaaccaataaaaacacgaatgtcagttcaggtttgaaagaagatcgaaaggtaggagcaagaattttgtaatctatgtatcacgaaccattgtatttctcgctttgattggattgggcaagttgtaaagaaggaaatccctggaggatttgtagataagagatcgggaaaaaggaatgtagaaggagagatggaaattctttcattttgtacatcataaattttagttgagggccgagtaagttgtacatcctcgaaataattactgtttatgatggcagaacattataatatgatttggcgggcgaa

SEQ ID NO: 2409 - DNA, 1573 bp, Mimulus guttatus
atatagagagagaaagaatggggggagagagagaaaagagacgtggattggcatataagctgtgaatgccgaatccaacgcgtttcaatttggctgaaggaaaataaaaaaaaaaacataatcagaaaagagggaaaacaagaattgtagtgagtaaaagagcaatggcggactccagcgattccgtctccgtcgatatggagtccatttctctcgccggaaaggagcatattgtgaaaaccggtcatggatgtgtctcggtttctgttttcggtgaccaggaaaaaccggctcttattacttatcctgatttagctttaaactatatgtcctgttttcaaggattattcttttgtccagaagcattgtctcttcttctccacaacttctgtatctaccatatcagtcctccgggtcatgagttaggagctcctgtagctgaccctgatgaaccctcattatctgtcgatgatttagccgatcagattcctgaaatcctcgactattttgggcttggtgcagtgatgtgcctgggcgtaacagctggagcttatattattacactctttgctataaagtactcgcagcgtgctatgggtctgattcttgtttcccctctgtgcaaagcaccatcctggacagagtggttatgtaacaagatgatgtcaaatttgctttatatttgtggtatgtgcggtatagtgaaggagctgatgctcatgcgctacttcagcaaggaagttcgtggcggcgttgatgtaccagaatcagatattgtccaatcatgcagaagatttttgggtgagagacagagccctaacgtgctgcggtatcttgaagctattaacgggagaccagacatatccgacagcttaagaaaattgaaatgtcgatccttgatatttgtcggagaaaactctccattccactatgaatctcttcatatgacctcaaagctagatcgcagatttagcgccttagttgaggttcaagcatgcgggtcgatggttacagaagaacaaccggatgcaatgttgataccgttggaatatttcctcatgggttatggattcttcaggccatgtcagttcaatgtcagcccaaggagtccgttgagtccgactagtatttcgccggagcttttctcaccggagagcatgggattgaagttaaaaccgataaaaacaagaatccaggctcaagtgtgagtatggcctttttcatagtttttgtagtagatatatatttatgtgtgtgtgtatgaatggaggagttatgccagtggttgaaagaaagttactgcagggttgtagataaaagataaaaaaagcacacaaatataatttagcaaaatggaagaagataatatacagcaaaggagggttatatatatacatatatatatatacatgcatatatatatgtgtgtgtatatataattattgtttttgccacttgtaatctagagtgttagttgagactatagcgtgttgatctgtgtacatcgtttggatttatttatgctgattaaacaggaaataatgataataaatggcgggagaagtgttttatt

SEQ ID NO: 2410 - DNA, 1450 bp, Triphysaria pusilla
ttttttttattaatagcgatgtataagctatggatgccgcatccaatgcctctctaatttgagagagcggcgagttatggcggattccggcgactctgtctccgtcgatatggagtcggctccgttcgccggaaaggagcatattgtgaaaacaggttgtggttctgtgtcggtgactgttttcggagaccaggacaagcccgctctaattacctatcccgatttagctttaaactatatgtcctgctatcaaggtctcttatattgtccagaagcatttcccctttttctccacaacttttgcatctatcacatcagtcctcctgggcatgagctcggagctgctgttgctgggcctgacgaaccgtcattatccgtcgatgatttagctgatcaggttgctgaaatccttgattacttcggagttggtgaggtaatgtgcttgggggcaacagctggagcttatattcttacattgtttgctatcaaatattcacaacgtgttatggggttgattcttgtttcccctctatgcagaacaccatcttggacagagtggctatacaataaggtactgtccaatttgctttacatgtgtgggatgtgtggtttggccaaagagttgttgctcatccggtacttcagcaaggaagtgcgtggcagcgtgaatgtaccagaagaagatatcgttcaatcatgcagacgattgttaggagagaggcagagcccaaatgtgctccggtttcttgaagctattaatgggagaccagatatttctaaaggcttgaggaaactaaagtgtcggtcattaatttttgtcggagaaaactctccgttccacagtgaggctctccatatgacatctaagctagataggagattcagcgctttgattgaggttcaaacatgtggatcaatggttactgaagaacaaccagatgtgatgttgataccattagaatactttctcatgggctatggcttttacaggccatctcaattcagtgtcagcccaagaagcccattgagcccaactagcatttcgcccgagcttttctcaccggaaagcatgggcctgaagttgaagccaatcaaaaccaggatcctgagagaattgtgagtctgagaaaaagatcaaaggcaagcattttcttgtatcatatgaaaacaaaaggtgtttacataaataagggaatattgttgatataataaataaataaattagcaaaaaagtaagaagggatataaatacgggattggtacacagaagggatctagattttcttatttatgtttatctttataatatgaaagttagtcgaaaagtagtgattagtctctgtataataattggattatttatgattatataccgggaagttatagtataaggcgaagaattgttttttttaaataatatagcaattcatattgttaaattgttcattgc

SEQ ID NO: 2411 - DNA, 1840 bp, Theobroma cacao
tttttttaaaaaaagggttagtttttaataaattaaaataaaaatagctaaacaggcttgaggttaactagtgaattgtgaaatgaagagagggtaataatgtaaaattgaagaaactgtcggcctcttaactagggttcaatagacccgagacccaggttaaggcccgcttgtgcgggacccttgtgagttttgtctgtctgtctctctctctctcataaatcgagcgtcggtgactcggtccgagttaaccacgagttaaacttgtagttttagagatagacattttttttggtggaaaagggatagacaaatttaaaatatatagattctatttttctcgttattatttttattttaatagagagagaaatctgaaaaggagggaccgagagggaggtttggtatataagacatggaagccaattctaaaagtgcgtcttcagtttgagagagagaaagggggaaaatggcagattctagcgattccgtttccatcgatatggaaacgatctctcttggcggcaaggagtaccttgtgaaaactcgccatggtacggtttctgttgctgtgtttggagaccaagataagccagctctcatcacctatccggatttagcactaaaccatgtctcctgttttcaaggcttgttcttttgtccagaagctagttccatacttctccacaatttctgcatatatcatataagtcctcctgggcatgagttgggagctgccccaatcggttctgatgaccttatgccttctgttgatgacttggcagatcagattgttgaggttctcaatttttttgggcttggtgctgtaatgtgtatgggtgttacagctggagcatacattcttaccctatttgctatgaaatacaggcaacgtgtccttgggttaatacttgtttcacccctctgcagagcgccctcatggacagaatggttgttaaataaggtgatgtcaaatttactttatttctatggcatgtgtggagtggtgaaggagttattgctcaagcgctacttcagtaaggaagttcgtggtagtgctcaagtaccagaatcagatatagttcaggcgtgcataagattgctagatgaaaggcagagtataaatgtttggcaattccttgaagcaatgaacgggagacctgaccttagcgatggattaagaaaattgcattgccgttcactaatatttgtcggggagaactctccgttccattctgaggctcttcacatgacatcaaaattagatagaagatatagtgccttagtggaggttcaggcatgtgggtcaatggtaacagaggagcagcctcatgccatgttgataccaatagagtactttcttatgggatacggcttatacaggccaaccctaagcgtcagcccaaggagccctttgagtccatcttgcatctcgccggagcttctatcaccagaaagcatgggcttgaagttaaaaccgattaaaacccgtatctctgttgaagtttgagagaagatgaaagagaaagggggcaagatcacctttttgtaatctatatatgtgaggtgtttgtaacatcttttgaccggttggtgacgatcagagaggattaccagagggttgtagatagagaaaaaaagtacagacagaaaaggagatattgtcattcttttatttgtaaccataaatcttagctgaggtgaagacgtgaagtcatctgtaaatggtcggaataattatttactagagaagagccaataatgataataacagtgggtggaaggtgcatttacactttgcctttttctttatgttatgaaatataattacaaaagaaac

SEQ ID NO: 2412 - DNA, 1360 bp, Cirsium arvense
cgcagatttctatataaaccggatgccaaaatccaatgttccaaatttgagaaaatagggtgaggttttgtttgaacgagaggagagagaggagagaaaatggcggattcaagcgattctgtctccattgacatggaaatgagctctcttgccggaaaggagcacattgtaaaaacttcctacggatttgttaatgttgccgtatttggggaccaggacaagccagctttgattacatatccagatatagctttaaatcatatgtcctgtttccaaggtcttttcttatgtccagaagcattttctctattggttcataacttctgcatataccatataaacccccctggccatgagttaggagctgctgcaatgtcttatgatgatccaatgttatctgttgatgacttagccgatcaggttgctgagattcttgattattttggacgtggcgcagttatgtgcatgggagtaacagccggtgcatacatactcaccttgtttgctataaaatatacacgacgtgtgcttggtctcatacttgtttcacctctatgcaaaacaccctcttggacagaatggttgtgtaacaaggttatgggaaatgtactttattactatgggatgtgtggtcttataaaggagttactgctaatccgttatttcagcaaggaagttcgtggaggtgctataattccagaaacggaaatagttcattcatgtagaagattgcttggtgaaaggcagagtccaaatgtactcaactttcttgaagctattaacgggagaccagatatcactgatggactgaagagactgcagtgtcgttccctgatcttcgtgggagagaattctccgttcaattctgactctctccacatgacttcaaaactagatagaagattcagtgcattggtagaggttcaaggatgtggatcgatggtaacggaggagcaacccgatgctatgttgataccactcgaatatttcctgatgggattcggattctataggccctctcagatgaatgtaagcccaagaagcccgttaagcccgacttccatctccccagagctttatacaccagaaagcatgggcttaaagctaaagcccattaaaacccgactttcgcaaatctgaaaggacggcggtatgtttttttgtttttttttgtaagtctatgcatctgtcatgagaattagtagtttccagttgcatattatagaaggggaagaaagtatggaggtatatagatgatataggagagaaaaaaaatgatatgatagattgaaatttattaaactagataagggaggatagtgatgtataataaatgatgttttattcttatgatggtaaa

SEQ ID NO: 2413 - DNA, 1465 bp, Lippia dulcis
aataagagagaaaattttaaaacagaaagagtgtaagaggaaattggagtggaattttagagagagaaagcggcagagggagagttctagagagggcgtggactaatggcggactccgccgattccgtctccgtcgatatggagtccgttcctctcgccggaaaggagcatattgtgaaaacaggccatggtactgtgtcggttgctgtttttggagaccaggacaagcctgctttaatcacttatcctgatatagcattaaactatatgtcctgtttccaaggactgttcttttgcccagaagcatgctctcttcttctccacaacttctgcatctatcacatcagtcctcctggccatgagctaggagctgctgtagctgacccagatgacccctcattagcagtcgatgatttaactgatcagattgcggacatccttgactactttgggcttggtgcagtgatgtgctttggggtaacagctggagcttatattcttaccctgtttgctatgaagtactcacaccgtgtgatggggttgattcttgtttcccctctatgcaaagcaccatcttggacagagtggctatacaataaggggatgtcaaatttagtttatatgtggggcatgtgtggtttagtgaaagagatgttgcttgtgcgatacttcagcaaggaaatccgtggctgtgtggatatactagaatcggatatcgtgcaatcatgcagaagattgttgggagaacggcagagccctaatgtgctgaggtttcttgaagctatcaacaggagaccagatattactgaaagcttgagcaaactcaggtgtcgatccttgatttttgttggagaaagctctcctttccatcacgaggctctccatatgatgtccaaactagacaggagattcagcgccctagttgaggttcaagcatgtggatcaattgtcactgaagagcaaccgggtgcgatgttgataccgttagaatattttctgacgggctacggcttccacaagccatcccaattcaacgtcagtccaagaagcccgttgagtccaaccagcttttcgccggagcttttctcaccggaaagcatgggcttgaagttgaagcccatcagaaccagaattcaagaagtgtaagtctgagaagatcaaaggtgagtttttgtaaacatattgcacaaagttgcaagagaactatatgcttgcaaatatcatgattcatgaggcttgtacatataatgggcaaagtcaaataatttagctagaaggaagaaagagaaatagaattggggaatggtacacagagaggaagggggtttacatattattttctttattttgttaatttcaagagttagtcgaggattagcttttgatcactgtacattcttggaataattagattgtttatgatggaggaaataataaataataatataagggtggcgaaggtatt

SEQ ID NO: 2414 - DNA, 1350 bp, Valeriana officinalis
atatacacacacacaattatctcatattatactatacttgctctacattcatacattaaaaccctcaaacccaatgcttctcaaattcctcacccagacttgacttcagtaaagtctgtaatggcggattcaagtgattctgtctccattgatatggactcgatctctctcggcggcaaggaacaccatataaaaactagccatggatctgtttctgttgttgtctttggggaccaggacaagccggctctaattacatatcctgatgtagctctgaattatatgtcctgttttgaaggaatattctcatgtccggaagcattttctttacttctccataacttttgtatttaccatatcagccctcctgggcacgagttaggagctgccatattgagctctgaaaatccagttttatctgttgatgacttggcagatcaggttgccgagattcttgactattttggccttgatgctgtgatgtgtatgggagtaactggtggtgcttatattcttgccttgtttgcgataaaatatacaagacgtgtactgggtttgatacttgtttctccactatgccaagcaccatgttggactgaatggttatataataaggttatgtcaaatttactatattattacggcatgtgcggtttagtaaaggatttattgcttatgcgctactttagtaaggaagtacgtggtggtgttgtacaagtaactgaatcacatattgttcaagtttgcagaagattgctggatgagaggcaaagtccaaatgttctgcggtttcttgaagctcttaacgagaggccaaacattaccgaaggactaaaaaagctgaaatgccgatcgcttatatttgtgggtgagaattcacctttccataatgaggctctccacatgacgtcaaaactcgatagaagatacagcgctttagttgaggttcaagcatgtggttcaatggtaacagaagagcaacccgatgcaatgttaataccgatagaatactttctaatgggatatggatactatagaccatctcaattcaatgcgagtccaagaagcccattaagtccgacgtgtatctcgccggagcttttctcaccagaaagtatggggctaaagctaaaaccaatcaaaacacgaattcatatggagtgttagaaagaaagaaagaaagaaagaaagaaagaaagaaagatagatagatagatacaagtagtgatagtgtaaggattttttgtaatattgtgtaccattttgttgtgtacatggtttgattagattggatttataggccgcgtgggtgaaatttgaagagagatgcatcggaccggagtagataat

SEQ ID NO: 2415 - DNA, 1371 bp, Prunus persica
agagagagaaagagagattgatatatacatatataaatatataatacatggaaaccaagcccaatgcctcagccatttgagacttgagagagagagagaaagagagagagggaaatgggggattcaagtgattcagtgtcggtggatatggagggggtttctcttggtggaaaggagcatcttgtaaaaacctgtcttggctatgtgtctgtcgctgtgttgggagatcaggacaagccagctcttgtcacttatccagatttagccctaaaccatatgtcctgctttcaaggactattattttgtccagaagcatgttccttgctgctccacaacttttgcatatatcatatcagtcctcctggccatgagttgggagcttctgcaatcagccttgatgattctgtgtattctgttgatgatttagtagatcagattgccgaggttcttgatttttttggacttggtgcagtgatgtgtatgggggttacagctggagcttacattctcacccggtttgctatgaaatatagatcacgtgtcatgggcttgatacttgtgtctcctatatgcaaagcagcctcttggactgaatggttgtataataaggtgatgtcaaatttactgtacttctatggcatgtgcggggtggtaaaggagatactgcttaagcggtacttcagcaaggaagttcgtggtggtgttcacataccagagtcagatatagttcaggcatgcagaaggtcgcttgatgaaaggcaaagttcaaatgtttggcgatttcttgaagcaatgaatgggagacctgacatttccgaaggattgcgaaagctacaatgccgttcactaatatttgttggggatagctctccgtttcactcagaagctctgtacatgacttcaaaactagacagacgatatagtgccttggttgaggttcaggcatgcgggtcaatggtgacagaggagcagccccatgcaatgttgataccaatagagtacttcctcatgggatatggcttatacaggccttctcagtctagtgtcagcccgagaagccctttaagtccgtcctgcatcgcaccggagcttctttcaccggaaagcatgggcttgaagttgaaaccaataaaaactcgggttcgggatcctcatgagagaagttgaaaaaaagggtttgcagggaaaatcgggttttttttggtaatgtattcgagccatctgagtctgagctctcacttgattggttggggattaagaaaagagaggggttattagcggttctgtagataaagagagaaagagaaagatacaagggaaaattgataaggaaagcagacatcattttttcatttgtagtccacaaatgtt

SEQ ID NO: 2416 - DNA, 1092 bp, Sarracenia psittacina
ttggctttggcgtttcaggtacagagagccatcggccatggcagattcaaacgattctgtttctgttgatatggaaacaatctatctcggcggagaggaacatactgtacgaactggccgcggtcctgtgtctgttattgtgtatggagaccaagacaagccagcacttgttacctatcctgatttagctctaaatcatatgtcatgtttccagggattgttcttttgtcctgaagcagcttctttgttgcttcacaacttctgcatttaccatatcaatcctcctgggcatgagttgggagctgcagcaatttgtcccgatgaccctgtgccttctgttgatgacttggcagatcaaattattgaggttctcaactattttaggcttggtgcagtgatgtgcatggggtaacagcgggtgcttacattctcactctttttgctatgaaatatagaaagcgggttcttggtttgatacttgtatcccctttgtgcaaggctgcctcttggactgaatggctctataataaggtgatgtcaaatttgttatatttttatggcacgtgtggcttgctgaaagagttgttgctccagcggtacttcagcaaggaagttcgtggtagtgcagaagtcccagaatcagacattgttcaagcttgtagaagattactggatgaaaggcagagcataaatgttttgcggtttcttcaagcaattaataggagaccagacattactgacgggttgaagaaacttaaatgtcggacactcatattcgttggggagaactctcctttccattcggaggctgttcacatgacttcaaaactcgatagaagatatagtgccttagttgaggtccaggcttgcggatcagtagtaacagaagagcaaccacatgcaatgttggtacccatggagtacttcctcatggggtacggtttgtatcggccatgccagctcagcggcagcccgaggagccccctcagtccgtcttgcatctctcccgagcttctctctccagaaagcatgggcttgaagctgaaaccgattaagactcgagtttcttcccacgccaaaggcgcagagaga

SEQ ID NO: 2417 - DNA, 1620 bp, Solanum phureja
cctttcaacagccaatgctgaccaaaaaaactctccaagaaactccttccacctctaccaaaactccattttctttacaattaactaatcatcactaaaaagggtaccaataaacatgactgaactaaaaaaagatcaagaaaatcatcagcagcagcagcaagagccacaaaggcgacatctttgtgatttttgtggaaacaacacagcacttttgtattgcagagcagattcagctaagctctgttttacctgtgaccgtgaagttcattctactaatcagcttttcactaaacatactcgttggttactctgtaatctttgtgattcttctccagcttctatactctgttgtacagagagctctgttttgtgtcaaaattgtgattgggaatctcataataaacaattgtctctacatgaaaggaggccacttgaggggtttagcggatgtccttctgtctctgagctgttgtctattcttggatttgaagatttggggaagaaggaacttttgtatggcggtgatggaagttatggtttctctgattgggttatttgggatactccttctgttgttagtcttgatgatctgattgctaataatgattctgaacataattttcaagctattggggttcctcctctacctaagaaccgaaatgctgcttgtggaaaacacaaggaagaaatacttagtcagcttcgcgaattatcaaagttggaaccaaattctggtgatgatcaagatgaaactgtaccaactataggatttcaatctatggaacctgtccaaaattgtccgttgagatttaaaggtttgggatttatgcagaattcagatcaacatgtagttccttcatctgagggaagtgcctttcattggcacggtgatactggtgaattcgcagatcaaggcttttcttcttctttaatggactgcttcattgagacgaagtgcttacttcccaacagagattcagatgtttgtgatgcttcgggtggagcaaatgaagaacaatctcataatcctcccactactgaaacatttcaaatggtacctaaagttgttcatcgcgagttaaacagccaagaaagagaaactgctgtgtcacggtacaaggagaagaagaaaacaaggagatatgagaagcatattaggtacgagtcaaggaaggctcgtgcagaaactagaacgcgaatcaagggacgttttgccaagatggattacagggattcctccgtgcatcagtaatgtcaaaggttgttttttttttccgaaatccaggacattctgcttgaagatcatcggtatactgtaatgaaaaacgtgttgtcaattctgttatgtggactgcaaatctgttattagctcgatcgtaggatctatagaggcaattaggaagtctttttccttttttcagcatgtatttatagactatagtaatttgtaaagctaaaaaagttgataaaaacatgtagcatagaaaaggggtaaaaaaaagtgagatttttagtatagttgtttttgtgtagcttgttgtgatgtaggcttttgcagttcagcttatattatacctcattcaagtgtctatcaaattagtgaacttttgcagttct

SEQ ID NO: 2418 - DNA, 1576 bp, Solanum tuberosum
ctctccaaaaaactccttccacctctaccaaaactccactttctttacaattaactaatcatcactaaaaagggtaccaataaacatgactgaactgaaaaaagatcaagaaaatcatcagcagcaggagcaggagccacaaagtcaacatctttgtgatttttgtggaaacaacactgcacttttgtattgcagagcagattcagctaagctctgttttacctgtgaccgtgaagttcattcaactaatcagcttttcactaaacatactcgttggttactctgtaatctttgtgattcttctccagcttctatactgtgttgtacagagagctctgttttgtgtcaaaattgtgattgggaatctcataataaacaattgtctctacatgaaaggaggccacttgaggggtttagcggatgtccttctgtctctgagctgttgtcgattcttggatttgaagatttggggaagaaggaacttttgtatggcggtgatggaagttatggtttctctgattgggttatttgggatactccttctgttgttagtcttgatgatctgattgctaataatgattctgaacataattttcaagctattggggttcctcctctacctaagaaccgaaatgctgcttgtggaaaacacaaggaagaaatacttagtcagcttcgcgaattatcaaagttggaaccaaattctggtgatgatcaagatgaaactgtaccaactataggatttcaatctatggaacctgtccaaaattgtccgttgagatttaaaggtttgggatttatgcagaattcagatcaacatgtagttccttcatctgagggaagtgccttccattggcacggtgatactggtgaattcgcagattcttcttctttaatggactgcttcattgagacgaagtgcttacttcccaacagagattcagatgtttgtgatgcttcgggtggagcaaatgaagaacaatctcataatcctcccactactgaaacatttcaaatggtacctaaagttgttcatcgcgagttaaacagccaagaaagagaaactgctgtgtcacggtacaaggagaagaagaaaacaaggagatatgagaagcatattaggtacgagtcaaggaaggctcgtgcagaaactagaacgcgaatcaagggacgttttgccaagatggattacagggattcctccgtgcatcagtaatgtcaaaggttgtttttttttccgaataaggttgcataagcaaacaatccaggacattctgcttgaagatcatcggtatactgtaatgaaaaacgtgttgtcaattctgttatgtggactgcaaatctgttattagctcgatcgtaggatctatagaggcaattaggaagtctttttccttttttcagcatgtatttatagactatagtaatttgtaaagctaaaaaagttgataaaaacatgtagcatagaacaggggtaaaaaaaagtgagatttttagtatagttgttttggtgtagcttgttgtgatgtaggctttggcagttcagcttatattatacctcattcaagtgtctatc

SEQ ID NO: 2419 - DNA, 1633 bp, Solanum phureja
ttgtgttatttatcaatcaacatgactgttgagatgcaatgtgaggcaactcaagtggctgaagtagttgttccacaagaggaattagtggctgctaacaaggttgaggtgaatgagaaagtaaaaaaagatgaagaagaggaatccaagcctaatacaattgaaaagagctcttcttatagagaagagagcaacttcctctctgatctcaaagagaatgagaaaaaggcattgaatgagctgaaatctatagttgaggaggccattcttggaaacactctcttcaaaaaagaagagaccaacaagtctcctgaggaagagggaaagaatgaggaaaatcgcgatacggtagaggggaaagaagaggagaaggagggtgatttggatgttgttgaagtggatagagagatttctatttggggtgtaccccttttgcctagcaaaggggatgagaaaaccaatgtggttctattgaaattcttgagagcaagggattacaaagtgaatgaatctttcgaaatgctcaagaaaacactccaatggaggaaggattttaacatccaatcaatcttggaggaagatttgggctcagatcttgctccagctgcttacatgagtggggttgataaccaaggacaccctatttgttacaacatttttggggttttggatgatgaagagatttataacaaaacttttgggacggaggagaaacggaaccagttcttgaggtggagagttcagttaatggagaagggcattcagcagcttgatttcaaggctggaggtgttagttcactgcttcagataaatgatctgaagaactcccctggaccgtctaagaaagaagtccgggttgctaccaaacaagccgttgatcttcttcaagataactatcctgaattcgtcgccaaaaatatattcatcaatgttccattttggtattacgccgtccattctctgctgtcgcctttcctaacgcaaagaaccaaaagcaaattcgtatttgttcgccctgctaaggtcactgagaccttgctcaagtacattccaatccatgaaatccctattcaatatggtggactcaagagggagaatgagtttgagttttcagtctccgactgtgaagctttggagattctccttaaagctggatcaactgaaactattgaaatacctgcagtagatgtggaaagtacatttatctgggatgttacgattgtgggcggagaagtgagctataaggaggaatttgtgccagaggatgagacttcttacactataatcattcagaaggacaagaaggtgagctcgacaattcacaacacattcaagaacactgaagcaggaaaggttgtgctgacaatcaagaactcttctagcaagaagaagaaggcgttttaccgacacaagatcaataagtcagcaatttgagatgagcaagtttctgttttgagtgaagatggagttctttttctctgtttttaaaaatatatatataatgtagtagtaacctttttgtggttcatatactttttactattatttttggtcctacattcatattgtatatgttgattcattcttttttctctccctataaaggaagaatatgatctctctattttttacc

SEQ ID NO: 2420 - DNA, 1400 bp, Solanum tuberosum
atatatttacaattacagatagtcgatctcttttgcattatttaccatggataacgataccccaagcatgattcatgatccattgattgattccacaggagaaggaggctatgcattaagtggcaaaattatgttaagtgctattgttatcttattcgctgttgttgttttcatggtgggtcttcatttatatgctcgttggtaccttctatctcaacgccgccgtgaactccttcgccgccgtagggtccaccatcgacggacccatattgttttctacgttgataatcctggttccgggttgtctgatgctaaccggggtttggaaccggtagttctcaattccttgccggtttttgtttattccgacaagactcacccggaaccgctggaatgtgctgtttgtttatcggaattcgaggagaatgaaaagggtcgggttttacccaagtgtaatcactcatttcattcggaatgtattgatatgtggtttcattctcattctacttgccctctttgtcggtctccggtggaggcagtacttatcgaaccgaataataaccgggttgaggtagcagtaacagtgaatgaaccgactgaaccgggttccagttccggtttatgcagctcttgtgaggaaaatagtagtcattctaatatgacgccgttaggttgccggcgaaaaggattggatctgaccggagttagaatagaggtgccaagaaggaacgatttcgaagccgatttggaaatgggagtgagagtgagttcaccggcgattcaatcgagatcaccagcgactcgtttaatgtctttgagaagaatactgagtatgaacagaaaaacacccaccggaactagccattcccctagtgggagttgcgccgccgagttggatttagaaagcggcggtagtaatggtggtggaaaaattcaagtcggcggcgaacgcatcacaactccgtgagtgacaaactccggcacacatccctaggtaatattgagtcacgccgattgtgtgaaaacaggagcaacagtgacttgaccgatagaaaattcaatattcgatgtcctatgacacgtggcaatttatgatggtgacgtggcggtattggaatggagggattcccttttattaggcagtcacggctgactttgaggggggaatgtttgacttgtaaactaatggtaggattagaaaaatgcaacttgtacagcgttacgtgcaagagtcaattacaatgtatctattttctaaattcgttgaattatttttccctattataaagtatttgaaaagcgttggttcctaatttatgactcatacttgtgtagttggtaagtggaatagttcaatagtgttaaaatattacaattcaatttgcaatatcattattcgg

SEQ ID NO: 2421 - DNA, 1433 bp, Solanum phureja
atatatatagatatatatcttcgccaataatttctctatatttacaattacagatagtcgatctcttttgcattatttaccatggataacgataccccaagcatgattcatgatccattgattgattccacaggagaaggaggctatgcattaagtggcaaaattatgttaagtgctattgttatcttattcgctgttgttgttttcatggtgggtcttcatctatatgctcgttggtaccttctatctcaacgccgccgtgaactccttcgccgccgtagggtccaccatcgacggacccacattgttttctacgttgataatcctggttccgggttgtctgaagctaaccggggtttggaaccggtagttctcaattccttgccggtttttgtttattccgacaagactcacccggaaccgctggaatgtgctgtttgtttatcggaattcgaggagaatgaacagggtcgggttttacccaagtgtaatcactcatttcattcggaatgtattgatatgtggtttcattctcattctacttgccctctttgtcggtctccggtggaggcagtacttatcgaaccgaataataaccgggttgaggtagcagtaacagtgaatgaaccgactgaaccgggttcgagttccggtttatgcaactcttgtgaggaaaatagtagtcattctaatatgacgccgttaggttgccggcgaaaaggattggatctgaccggagttagaatagaggtgccaagaaggaacgatttcgaagccgatttggaaatgggagtgagagtgagttcaccggcgattcaatcgagatcaccagcgactcgtttaatgtctttgagaagaatactgagtatgaacagaaaaacacccaccggaactagccattcccctagtgggagttgcgccgccgagttggatttagaaagcggcggtagtaatggtggtggaaaaattcaagtcggcggcgaacgcatcacaactccgtgagtgacaaactccggcacacatccctaggcaatattgagtcacgccgattgcgtgaaaacaggagcaacagtgacttgactgatagaaaattcaatatccaatgtcctatgacacgtggcaatttatgatggtgacgtggcggtattggaatggagggattcccttttattaggcagtcatgatagactttgagggggaatgtttgacttgtaaactaattgtaggattacaaaaaatgcaacttgtaaagcgttacgtgcaagagtcaattacaatgtatctattttctaaattcgttgaattatttttccctattataaagtatttgaaaagcgttggttcctaatttatgactcatacttgtgtagttggtaagtggaatagttcaatcgtgttaaaatattacaattcaatttgcaatatcattattc

SEQ ID NO: 2422 - DNA, 1804 bp, Solanum phureja
ctacattttctcaaactctttacttttaccctatatatgaacccccttctttcccagaaaattcctatatcttcctctcaaatcatgaatcataacagtttacccaataaacgccgtagaagaaggaaagaaaccccaactaatagtactggtggagctgaaaataatgatgattttgggtcggaaaatcaaggtgctgtgaaaacaaaggagttgaaacagatattaacatctttgttgttacttgaagaacaagaaaagtctgaacaagaggaatttgcaaaggaagaagaagagaacaaacacctattcgaagcgaatcataagaaaacaactaaggtgatgtgggattattattcaaatgttcaacaacatcattctgacttagaacagctagatggtgttcgaaaacggaaagggagaggaaattctgctgctgttactgctactgcttctgcttgtgcccttgcttctgccgcagaggaagaagtcgtttcgagtaataaatctagtgaaaaaggtgcgcctcataggcgattgtgggtgaagaatagatcaaaagcttggtgggatctatgtaacagtcctgatttccctgaagaggagtttaagaaagcgtttcgaatggggaaagatacgtttgaattgatatgtaatgaattgagctctgtggttgcgaaagagaatactatgctaagagatgctgtacctgtgaagcagcgtgttgctgtttgtatatggagattggctactggagagcctttgagattggtttcgaagagatttggattggggatttcgacttgccataagcttgtgctagaggtttgtactgcaattaggactgtgttgatgcctaagtatcttcaatggcctgatgaaaagaaaatgagggatataaaggatgagtatgaggatatgtcagggatcactaatgttgtgggatcaatgtatacaactcatatacctataattgctcccaaaattagtgttgcagcttattttaataagaggcatacagagaggaatcagaagacatcgtattcgattacagtccaaggtgtggttgatccaagaggggtgtttactgatgtgtgtatcggttggcctggttcgatgcctgatgatcaggtactggagaaatctgcgcttttccagagggcgaatacagggttactgaacaatgtttggattgttgggagttctggataccctttaatggattggattttagtgccttatacacagcagcagctgacttggactcaacatgctttcaatgagaagattggtgaggttcaacgggtcgcgaaggaggcgtttgtgagattgaaaaggagatggtcttgtttgcagaaaagaacagaagtgaaacttcaagatttgccagtggtgctaggggcgtgctgcgtgttgcataatatttgccagatgaggaatgaggaaatggatccagaactcaatttcgagctcattgatgatgaaatggttcctgagattcaattgagatcgaccaatgctaggcttgcaagggatgccattgctcataatcttctgcaccataaccatgctggtacttctctcctttaatcaaaggagttaaaactttgatgtgttgttcttgattcaagttattattatattttcacatttgtttttcttaattaaagttagtccaaacggatgaaaatgttgcttttctagcatacactgcagacaaatattgtatttcatacttgaattagagattgatagaaaaaattgacttggcaaaaacataaatttctcttcttttacatattgt

SEQ ID NO: 2423 - DNA, 1406 bp, Solanum phureja
agctggcagttgaggagtgggtagttagctcagctaatagtacaccaccctattatatttcaagcaaatttttcattgtaccttgttagatagccaacattctttcacaattcttctttggaggtatactatatttccaaaattttcaaccccatttcaagattttccctatactcaaaccccattatcataaagtttcaatttttatcaagaaaatgagagctgcttcagtatttggtggtgtgttccttgtgttggcagtgtattgtgggttggacccttttaagcatagtgcaatttctgagttcccaaattttgagtcttttaaggttgagatgccagcttggtctgaaatcccagttgaaaaagattcacaaaatttgcttcagaaatctgaaattaagttcttggatcaaattcaggggccagaaagtattgtttttgatcctcagggtagaggaccttatacagggatagctgatggaagagttgtgttttgggatggtgaaaaatggaatgattttgcttatacctcagctaataggtcaggcttgtgtgatccaaaaccatcgccgttgagctatatgaagaacgagcacatctgtggtaggcctttggggttacggtttgacaaaagaacaggtgacttatatattgcagatgcatatttggggttaatgaaggtaggccctgaaggtggattagcagaatctttgacaactgaggctgaggggatacctataggatttgcaaatgacttggatgttgatgatgaagggaatgtttattttacggatagcagcacaaagtaccaacgcaggaattttgtacagctggttttctcagcagaagatagtgggaaggttctcaaatacaatcctaggacgaaagaaaccactgttcttattcgcaaccttcaattcccaaatggtctatcactaagcaaggatggttccttctttatattttgcgaaggttccaagggcaggttacgaaagtactggctgaaaggtgagaaagccgggacatcagaggtaatagcaatcctcccaggatatccagacaacgtaagagcaaacgaaagaaacgagttttgggtagcaatccactgtcgtcgtaccatttacagttacataaacgccatataccctcaactccgtcaattcttgctgaagcttcctatctctgcaaagctccaatacctcatccacattggtggcaggttcactgcagttgttgtgaggtacagctccgagggcaaactgttgcagatattggaagatcgacaagggaaagtcgttagagctgtcagcgaggtagaggagagggatgggaagctttggatgggaagtgttctgatgtctttcatttcagtttatcaactagaatgaactcttgagcttttg

SEQ ID NO: 2424 - DNA, 2135 bp, Solanum phureja
ttttctctctgcatttctttgccttttaccttctcagaaagagaaacaatggcaaaaacggtcagcccagatgctatttcaactattttagcgaacccatcgccggattcttcttcagatcttcctgaaattattgttcaagtagtggatctcaagcccaccggcaacagatacatgttttcagccaatgatgggaaaatgaagattaagggcattcttcaatctagtttgtcttctgaagttatatctgggtctatacagaacctgggtcttattcggattattgattacaccctcaatgatatcccaactaagaatgaaaagtacttgattgtaactaaatgtgagtcagtgtctcctgctcttgaagctgagtacaaggctgaagtgaaaagtgaagacactggcattgtcttgaagccaaagcaggaagagactgggattcttttgaaaccaaaacaggaatatcaaactaaatctgctgctcaaattgtacatgaacaaagtggaaacatggcaccgtctgctcgaatggcaatgacaagaagaattcagccacttgtctctttgaatccctaccaaggaaattggaccattaaggttcgagtaactagcaagggtaatatgcgaacttacaagaatgctcgtggagaaggctgtgtgttcaatgttgaattgactgatgaggatggtacccaaatacaagctacaatgtttaatgaagctgcaaagaagttttttgacaagtttgaattggggaaagtatattacatttcaaagggaactcttcgagttgcgaacaagcagttcaaaactgtacaaaatgattatgagatgactttgaatgaaacttcccaagttgaggaggcttgcaacgaagaagcttttattccagagacaaaatttaactttgtcccaattgatgaattgggaccatatgtcaatggcagggagcttgttgatgttattggggtggtccaaagtgtatctccaacaatgagcatacggaggaagagtaacaatgagacagtccctaagcgtgatataactattgcagatgagacgaagaagactgttgttgtttctctttggaatgatcttgccacccatgttggacaagaactgctagacatggctgataaatccccagttgttgcaatcaaatcccttaaagttggagacttccaaggagtgtctttatcagcattaagcaaaagcaatattgttgtgaatcctgatttacctgaagccaaaaaattgagatcttggtatgattctgaaggtaaagaaacttcattggcatctattggttctggcatgagcccctctgccaagagtggagcaagatctatgtatactgatagagtttccttgcttcatataaccagtaacctgtcccttggcgaggagaagcctgtgtttttcagcttgaaagcatatataagtttcattaagcctgatcaaaccatgtggtatcgggcttgcaagacatgcaacaagaaagttactgaagcttttgggtctggatattggtgtgaaggatgccagaagaatgaagcagagtgtagtttgagatatataatggcattgaaagtgtctgatgcaagtggtgaagcatggctttctacgtttaatgagcaagcagagaaaatacttggatgctctgctgatgaacttgacaagctgaaatcagaggagggagaaattgcatatcaaatgaaattgaaggaagctacatgggttcctcaccttttccgggtcagtgttgcaccacaagagtacaacaacgagaaaaggcaaaggataacagtcagggctattgctccagttgattatgcagcagaatccaaatacttgctggaagaaatgtctaagatgaacattgctatgtaatgatgctagcctaattcagaatagtagatttatttttgttatatttaagtctgaatgctcactaggattggttagttgaacagttgtaaatatgtctcattgtctttgcttaatagcaattcagcattttgcattttagtgaatgcaccttttgcagtttatcatattttgttgtgtattcactatttaatgatggttctacattttatctaatggagcattccaattcttgttatcacatc

SEQ ID NO: 2425 - DNA, 2055 bp, Ipomoea nil
gggttcttcccctcagagtcttcacacttgacattgctcgagttttcggcattgagggttctaaaaaaatcaagaagagatggaaagatcggtgactccagatgcgatatcggccatactagcaaacccgtcgccggattctgggtcggacctcccggagttaattgttcaagtagtagatctcaaacaagctgggaaccgatacatgttcacagctaatgatgggaagatgaagcttaaggcaattctacaatccagcttatcatctgaagtcatctctggttctattcagaatctgggtctagttcggattcttgattatactcttaatgacatcccaatgaagaatgaaaagtacctgattgtgacaaaatgtgatgctgtatcttctccgcttgaggcagagtacaagacaggtgtgaaaactgaagagaatgggatagtattgaggccaaagcaagaatttgtagccaaatcagctgctcaaattgtacatgaacagaatggaaacattgtgccacctgccagactggcaatgacccggagaattcatccacttgtttccttgaatccttatcaaggaatctggaccataaaggttcgtgtaactagcaaaggaaacatgcggttttacaagaatgctaggggagaaggctgtgtcttcaatgttgaattagcagatcaggatggcacagaaatacaggccacaatgttcaaccaggctgcgaggaagttttatgacaagtttgaattggggaaggtttattacatttcaaagggaactttgagagttgctaacaagcagttcaagacagtgcaaaatgattacgaaatgaccctgaatgagaactctgaggtagaagaggctataaatgaagctgcttttgttcctgaaacaaaattcaattttgttgcaattgatgaactgggttcatatgtaaatggtcgggagctagttgatgttattggcgtggttcaaaatgtatcttctacaatgagtatcaggaggaagagtaacaatgagatgattccaaagcgtgacataaccattgcagatgaaacgaaaaagactgttgtggtgtctctttggagtgatctagccaccaatgtaggtcaagagcttctagatatggctgataaatctccagtagttgcaatcagatcagttaaagttggagatttccaaggtttatctttatctgcaattactagaagtactgtactggtgaacccggatatgcctgaagccaagaaattgagatcttggtatgattgtgaagggaaagaaacctcattgacttcggttggctctggtttgagctcctctgccaaaggcgtattgtggtccatgtactcggatagagtatccctacttcatataaccagtaacccaaacctgggtgaggacaagcctgtgtttttcagtataaaggcaaatattagcttcattaaacctgaacaagcgatgtggtatagagcgtgtaaaacgtgtaacaagaaagtgactgaggccattggatctgggtactggtgtgaaggttgccagaagaatgacacagattgtagcttgagatatatagttgccatgagggtgtctgatacaagtggcgaggcttggctctctgtcttcaatgaacaagcagaaaaaataattggatgctctgcagatgagcttgacaggctgagatctcaggatggagatagtagtgcttaccaaatgaaattgaaggaagcaacatgggttccttatcttttccgggtcagcgttacccctcaagagtacaataacgaaaagaggcaaaggataacagtcagagcggcggctccagttgattttgcagctgaatccagatactttctggaagaaatggctaagatgaacatctgtgtataactggcttttgtaaattaaaacaatcagagtattttctttcactaaatctagattattggttcctttgctgatcagatctgttagatttgcattttgcagtccaatcctattcctatccattaaacaatgctaaataaaactggaaaaaaggcagattcttt

SEQ ID NO: 2426 - DNA, 1736 bp, Solanum tuberosum
atttctttgagcttatcacactttactcctcaatacagaaatggcagcagctaaacgggttttagataactctaatccggatacgaaccaaccgaattacaaacgcatgagatctactacaccttcttttgcttctgttattaaggaagcaatgaaggcgaatttcctagagaacttgtcttctgctttggaaccgatgctccgtcgagtgattcctgaggaagtggagaatggactaaggcgttattcatgtcgttcattagcgagatctccttcactaagaatcaaagcactagaaccatcgaatcttcgtctcattttcaacaaaaagctctcgcaaccaatattcaccggaagcaaagtcgtcgccggcggcgacgacggccagagtcttcaaattcttctggtggatacaagcggcgaaggcatggttccaacgactttaccttaccctatcaaagtagaactcgtcgtacttaacggagatttcccgtccggagatactgaaactaattggtctcgcgaagaattcgacaaacacgtcgttaaggagagaaccggaaagaggccattgcttaccggcgaactgaatttcacgatgcgagacggcgtcgtctctgttggggaaatcgagtttactgacaattcgagctggattcggagccggaaattcagaattggcgcaaaagtggttcaaattggaaacaatcaaactaccgttcgaattacagaagccgttactgaatcgtttgtggttaaagatcaccgcggagaatcgtacaaaaaacattacccaccagcactaggagatgaagtgtggcgtcttgagaagattggaaaagatggaactttccgcaaaaagctttcttcaaaaggcatcaacactgtacaagatttcttgaagttggctactattgacacaccacaaattagaactatactgggaactggaatgtcagataaaatgtgggaagtgacatacaagcatgcaaaaacttgtgagatgggctcaaagttattcatggcccgtggaccaaactacgttttaatccttactccgatttgtcaacttgttagggcagttattgatgggcaaatttaccctactcatgacttaccaggaatacaaaaggcctatatccagaatttggtgaaggaggcttatggcaattggagttctttagaggaagttgatggtctagttaatgagacagcactactaactcaaggagaaccaatggtggatgagtatccaaatgttcatcagcagcaacaaccaatgatacgatcctatcaacaaaacacaattttgacagatgcatctgaacaattagtcgaatacaatgactggattggtaatcctaactacatttgatacacttgctgataataacggtggtagttacttatcagatggatcctctaatagagaattgtgttaaattttacactgtcagcatatagaaattaacttgaattcttgtaaacagaagacaatgaaggaatgaaacttatgcttacaggtaaatgtacatagtgtgtaggaacaaaattttgcccaataaagggctgaaaattgttgtagaagttgcgccacccctttgtaaaagatgtgtggtctggcaatagtatgcaaaagtatatttcaatttctttgtaagattcaaatttgaattgtctattgtagagagtgattgttcatttaattgaatgaacaaattaatgcaaatgtttac

SEQ ID NO: 2427 - DNA, 1750 bp, Solanum phureja
atttcttgagcttatcacactttactcctcaatacagaaatggcagcagctaaacgggttttagataactctaatccggatacgaaccaaccgaattacaaacgcatgagatctactacaccttcttttgcttctgttattaaggaagcaatgaaggcgaatttcctagagaacttgtcttctgctttggaaccgatgctccgtcgagtgattcctgaggaagtggagaatggactaaggcgttattcatgtcgttcattagcgagatctccttcactaagaatcaaagcactagaaccatcgaatcttcgtctcattttcaacaaaaagctctcgcaaccaatattcaccggaagcaaagtcgtcgccggcggcgacgacggccagagtcttcaaattcttctggtggatacaagcggcgaaggcatggttccaacgactttaccttaccctatcaaagtagaactcgtcgtacttaacggagatttcccgtccggagatactgaaactaattggtctcgcgaagaattcgacaaacacgtcgttaaggagagaaccggaaagaggccattgcttaccggcgaactgaatttcacgatgcgagacggcgtcgtctctgttggggaaatcgagtttactgacaattcgagctggattcggagccggaaattcagaattggcgcaaaagtggttcaaattggaaacaatcaaactaccgttcgaattacagaagccgttactgaatcgtttgtggttaaagatcaccgcggagaatcgtacaaaaaacattacccaccagcactaggagatgaagtgtggcgtcttgagaagattggaaaagatggaactttccgcaaaaagctttcttcaaaaggcatcaacactgtacaagatttcttgaagttggctactattgacacaccacaaattagaactatactgggaactggaatgtcagataaaatgtgggaagtgacatacaagcatgcaaaaacttgtgagatgggctcaaagttattcatggcccgtggaccaaactacgttttaatccttactccgatttgtcaacttgttagggcagttattgatgggcaaatttaccctactcatgacttaccaggaatacaaaaggcctatatccagaatttggtgaaggaggcttatggcaattggagttctttagaggaagttgatggtctagttaatgagacagcactactaactcaaggagaaccaatggtggatgagtatccaaatgttcatcagcagcaacaaccaatgatacgatcctatcaacaaaacacaattttgacagatgcatctgaacaattagtcgaatacaatgactggattggtaatcctaactacatttgatacacttgctgataataacggtggtagttacttatcagatggatcctctaatagagaattgtgttaaattttacactgtcagcatatagaaattaacttgaattcttgtaaacagaagacaatgaaggaatgaaacttatgcttacaggtaaatgtacatagtgtgtaggaacaaaattttgcccaataaagggctgaaaattgttgtagaagttgcgccacccctttgtaaaagatgtgtggtctggcaatagtatgcaaaagtatatttcaatttctttgtaagattcaaatttgaattgtctattgtagagagtgattgttcatttaattgaatgaacaaattaatgcaaatgtttactttgattatgcattc

SEQ ID NO: 2428 - DNA, 2423 bp, Solanum phureja
aaaaccctgtccaaattggaaccagccgcttctaacaaacaatttcaccgtgccgctgccggctgtcaccaccgaaccgaccggcgtccggcgacacttcaaaaagggcattactctgtctgccaattgaattacaatggcataccaagggggaaacttgaagtccactgccataaatggagtgaagatgtatactgttgctggccaacaccgttctgtggctacatggcttgctcccaagaagctcagagctcttcgtaaagatccaggttatatgcaaagagtggatctgattcaagatttgagatttgaaactgcaacaacaagaattaaagtgactcctgatggggagtatctcattgcatcaggtatttacccaccacaagttaaagtgtatgagctgcgggagctgtcgttgaagtttgaaaggcatttggtgtcagagattgttaactttcaagtcttgggtgatgactactcgaaaatagcatttctttgtgctgatcgttctgtttgcctccatgcaaaatatggaagtcaccataaattgcggattccaaggatgggaagggatattatatatgatagctggtcttgtgatttgctttgtgctgcctcatcaccagatctctacagaataaatttagagcagggacgctttctttcctcactgagcacacaatccccagcacttaatgtggtttcacggagcaaggtccatggactagttgcttgtggaggggaggatggtgccctcgaatgctttgacatgagagcaagatcttcagttggtaggataaatgctgttgcacctgctggggatggggaccaggaggttactgcaatagagttcgagggagatggaggttacctcatggctgttggaagtagtgatggaaaggttctgatttatgatttgcgttcttctcaacctatgcggataaaggatcatatgtatgggagcccaatactgaacattaagtggcataaaacgctcaacactgaacgaacaaagttaataactgctgacagccacattgttagggtttgggaccccgagacgggagaaggcatgacaagcattgaaccgacaggtgggagaatcaacgatttgtgtgcattcactggcagtggattgatgttgttggctcttgactctagtcaaataccttcatatttcataccttctctgggacctgcgcccaagtggtgttcttaccttgaaaacctgacggaagagcttgaggagcaaccccaaacaactatttatgatgattataaatttctgacaaaggaagatctggaaaagttgaatttgaccaatttgattggaaccaatcttctaagagcttatatgcatggttacttcatcgattatcggctgtataaaaaggcacacgcagcgtcaaatccgtttgcttatgatgagtatatagagcagcggaagaaggaaaaattcgaaaaagagcgtgatagtcgtatcacgattaagaggaggcttcccaaagttaatcgcactctggttgaacaacttcttgagaatgaggaagctgagaatgtgaaggaggatgttgatgacgttgatgcgaagaagacatcaaagaagaagaaaggactgaccatggacgttcttgaagatgaacgtttcaaacgcatcattgaaaataaggactttgaaattgaagaagattctcacgagtatcgggcattgcaccctatgccttccttaaaacgaccatctttagtggaagaacattttgagcctgtgatggaaggtgaggaggctagtgattctgatgcacaatcatcagaagatgaacaagttaatgacaaaaattctagaaagaaggccagagttccgagaatgtatgaagtcaaggatgataggcatgcagaagcattctcaaaccatctttcacttgcaaaagaggatgctctttcactaggtgaaagggttgcaggattgtcaaatggcagagcttctcatgatatgaacaatattaaggttggtcccggaggttcgagagaagtttcatttttttccaggagctcagccaagtatgtggaagatgatggagagaaggaaacacgaaccgaaaagagaagaggggtccagtccttaaaactgaagcctgagagatcaggttttcaggggtcgggttctcgaggccgggggagaggaggaagaggtcgtggaatgggcagaggaagaggcacaggaagaggtagaggaagagggagaggataattttttcatacagtattaacaatttttgtgtcaaagggatgctatttctttttccttgatggtgtatttttattagtaactagtttctcgacacgtgtatcgctcctgtagtgattgtacaatataaatcgatcatcaaacattaaatcaaaaagttcaacaaaattgtgtgaaa

SEQ ID NO: 2429 - protein, 583 aa, Arabidopsis lyrata
MGKSEKTSLGRSLVKHHNHMIQESKDKGKYYKNLQKKVLESVTEVSDIDAIIEQAEEAERLYTINHSSSTPLSINLDTNSSSSVIAPEEWREQQKIEEALHASSLQVPRRPPWTPEMSVEELDANEKQAFLNWRRMLVSLEENEKLVLTPFEKNLDIWRQLWRVLERSDLIVMVVDARDPLFYRCPDLEAYAREIDEHKKIMLLVNKADLLPTDVREKWAEYFRLNNILFVFWSAIAATATLEGKVFKEQWRQPDNFQKTDDPDIMIYGRDELLNRLEFEAQEIVKVRNSRVASTVEYQRDQAVVGFVGYPNVGKSSTINALVGQKRTGVTSTPGKTKHFQTLIISDELMLCDCPGLVFPSFSSSRYEMIASGVLPIDRMTEHREAIQVVADKVPRRVIESVYNISLPKPKTYERQSRPPHAAELLRSYCASRGYVASSGLPDETKAARLILKDYIGGKLPHYAMPPGMTQGDEADIEDTEELEDILEGSESEDSTVGDETESEQVPGIDAVLDDLSSFDLANGLKSSKKVTAKKQTASHKQHKKPQRKKDRTWRVQNTEDGDGMPMVKVFQKPANTGPLTMR

SEQ ID NO: 2430 - protein, 588 aa, Eutrema parvulum
MGKSEKTTLGRSLVKHHNHMIQESKDKGKYYKNLQKKVLESVTEVSDIDAILEQAEEAERLFTINHSNTTPLPINLDTISSSSTIAAEEWREQQKIEEALHASSLQVPRRPPWTPEMSVEVLDANEKQAFLNWRRMLVRLEENEKLVLTPFEKNLDIWRQLWRVLERSDLIVMVVDARDPLFYRCPDLEAYAREIDEHKKIMLLVNKADLLPLDVREKWAEYFRHNDILFVFWSAIAATAVLEGKVLKEQWRKPENFQKTDDPEVVIYGREELLGRLQFEAQEIVRARNSRAASSSQSVTVESQRDNAVVGFVGYPNVGKSSTINALVGEKRTGVTSTPGKTKHFQTLIISDELMLCDCPGLVFPSFSSSRYEMIACGVLPIDRMTEHREAVQVVADRVPRRVIESVYNISLPKPKPYERQSRPPHAAELLRAYCASRGYVASSGLPDETKAARLILKDYIGGKLPHFAMPPGMTEGDEQKIDDTTRETGDVEGSDSEDSTIGDEKEREQVPGIDDVLDDLSSFDLANGLASSKKVTVKKETASHKHHKKPQRKKDRNWRVKNTEDGDGMPLVRVFQKPANTGPLTMR

SEQ ID NO: 2431 - protein, 577 aa, Eutrema halophilum
MGKTEKTTLGRSLVKHHNHMIQESKDKGKYYKNLQKKVLESVTEVSDIDAIIEQAEEAERLFTINHSNTTPLPINLDTNSSSSTVAAEEWREQQKIEEALHASSLQVPRRPPWTPEMSVEELDANEKQAFLSWRRMLVRLEENEKLVLTPFEKNLDIWRQLWRVLERSDLIVMVVDARDPLFYRCPDLEAYAREIDEHKKIMLLVNKADLLPPYVREKWAEYFRLNNILFVFWSAIAATAALEGKVLKEPWRKPDNFQKTDDPEVVIYGRDELLSRLQYEAQEIVKVRNSSESQRENAVVGFVGYPNVGKSSTINALVGQKRTGVTSTPGKTKHFQTLIISDELMLCDCPGLVFPSFSSSRYEMIASGVLPIDRMTEHREAIQVVADKVPRHVIESVYNISLPKPKPYERQSRPPLAAELLRAYCASRGYVASSGLPDETKAARLILKDYIGGKLPHFAMPPGMSLGEESKIDESQGTGAVEGSDSEDSDVGDETESEQAPGIGEVLDDLSSFDLANGLASSKKVTVKKQTASHKQHKKPQRKKDRNWRVQNTEDGDGMPLVRVFQKPANTGPLMMR

SEQ ID NO: 2432 - protein, 576 aa, Brassica rapa
MVKSEKTTLGRSLVKHHNHMIQESKDKGKYYKNLQKKVLESVTEVSDIDAILEQAEEAERLFTINHSNTTPLPINVDTQSSSSTIAAEEWREQQKIEEALHASSLQVPRRPPWTPEMSVEELDANEKQAFLNWRRMLVRLEENEKLVLTPFEKNLDIWRQLWRVLERSDLIVMVVDARDPLFYRCPDLEAYAREIDEHKKMMLLVNKADLLPPEVRAKWAEYFRRNDILFVFWSAIAATAVLEGKVLKEQWRKSDNFQNTDDPEVVIYGRDELLARLQSEAQEIVRARNSRSPVDESQRENAVVGFVGYPNVGKSSTINALVGQKRTGVTSTPGKTKHFQTLIISDELMLCDCPGLVFPSFSSSRYEMITCGVLPIDRMTEHREAIQVVADKVPRSVIESVYNITLPKPKTYERQSRPPLAAELLRAYCASRGYVASSGLPDETKAARQILKDYIGGKLRHFAMPPGMTEEKIEDDTGRETGSDSEEGEGDEKESDEQVPGIDDVLEDLSSFDLANGLASSKKVTVKKETASHKQHKKPQRKKDRNWRVKNTEEGDGMPLVRVFQKPANTGPLTMR

SEQ ID NO: 2433 - protein, 575 aa, Brassica napus
MVKSEKTTLGRSLVKHHNHMIQESKDKGKYYKNLQKKVLESVTEVSDIDAILEQAEEAERLFTINHSNTTPLPINVDTQSSSSTIAAEEWREQQKIEEALHASSLQVPRRPPWTPEMSVEELDANEKQAFLNWRRMLVRLEENEKLVLTPFEKNLDIWRQLWRVLERSDLIVMVVDARDPLFYRCPDLEAYAREIDEHKKMMLLVNKADLLPPEVRAKWAEYFRRNDILFVFWSAIAATAVLEGKVLKEQWRKADNFQNTDDPEVVIYGRDELLARLQSEAQEIVRARNSRAPVDETQRENAVVGFVGYPNVGKSSTINALVGQKRTGVTSTPGKTKHFQTLIISEELMLCDCPGLVFPSFSSSRYEMITCGVLPIDRMTEHREAIQVVADKVPRRVIESVYNITLPKPKTYERQSRPPLAAEVLRAYCASRGYVASSGLPDETKAARQILKDYIGGKLPHFAMPPGMTEEKIEDDTGRETGSDSEEGEGDEEGSEQVPGIDDVLDDLTSFDLANGLASTKKVTVKKESASHKQHKKPQRKKDRNWRVKNTEEGDGMPLVRVFQKPANTGPLTMR

SEQ ID NO: 2434 - protein, 460 aa, Brassica napus
MSVEELDANEKQAFLNWRRMLVRLEENEKLVLTPFEKNLDIWRQLWRVLERSDLIVMVVDARDPLFYRCPDLEAYAREIDEHKKMMLLVNKADLLPPEVRAKWAEYFRRNDILFVFWSAIAATAVLEGKVLKEQWRKADNFQNTDDPEVVIYGRDELLARLQSEAQEIVRARNSRAPVDETQRENAVVGFVGYPNVGKSSTINALVGQKRTGVTSTPGKTKHFQTLIISDELMLCDCPGLVFPSFSSSRYEMITCGVLPIDRMTEHREAIQVVADKVPRSVIESVYNITLPKPKTYERQSRPPLAAELLRAYCASRGYVASSGLPDETKAARQILKDYIGGKLPHFAMPPGMTEEKIENDTGRETGSDSEEGEGDEKESDEQVPGIDDVLEDLSSFDLANGLASSKKVTVKKETASHKQHKKPQRKKDRNWRVKNTEEGDGMPLVRVFQKPANTGPLTMR

SEQ ID NO: 2435 - protein, 754 aa, Arabidopsis lyrata
MAEDFARAVDDGLKLAKRIYFGKDRAVAAPRPPAPMERSSTTQSYLPTAPMVYAVIPDPGIVDNPDLPSYQPHVHGRCDPPALIPLQMNSIELDVDCYLDTALVTVTGSWRVHCVMGSKRCDCRIAIPMGEQGSILGVEVEIPRKSYTTQLITAEDGNEFEKTALPETGGFLKPNIFILTIPQVDGGTNLSIKMTWSQKLTYNEGQFFLDIPFNFPEYVTPAVKKISKREKIYLSVNAGTGTEVLCKGCSHQLKEKLRSAGKLRFVYEADVLKWSNTDFSFSYTASSSNIVGGLFLQSAPVHDDDQRDVFSFYLFPGKQQKTKAFKREVVFVVDISKSMTGKPLEDVNNAISTALSKLSPGDSFNIITFSDDTSLFSTSMESVTSDAVERGIEWMNKNFVVADGTNMLLPLEKAVEMLSNTRGSIPMIFFVTDGSVEDERHICDVMKKHLASAGSVCPRIHTFGLGIFCNHYFLQILANLSCGQHESVYNTDHIEERMDKLFTKALSTILVNITIEPLQSLDEVEVYPSNIPDLTSASPLMIYGRYRGKFPENVIAKGLLGDLSSFSTDLTVRSAKDMPLDKVFAKNVIDLLTAEVWLSEDKQLKEKIAKLSIQTGVPSEYTRMIQLENTEELKPSETGVKKKTTSNGEKQKMISRTIPLQSLGIGFGDKTATRENVPPGFGEQKAPDAAEKFVKAASSCCVSLCNKCCCMCCVQCCSKLNDQCVLVFTQLFTAIACIACFECCSTVCCAGDDG

SEQ ID NO: 2436 - protein, 755 aa, Eutrema halophilum
MAEDFARAVDDGLKLAKRIYFGNDRAVAAPRLAAPMERSSPAQAYLPSAPMVYAVIPDPGIVDNPDLPSYQPHVHGRCDPPALIPLQMNAIELDVDCYLDTALVTVTGSWRVHCVMGSKRCDCRIAIPMGEQGSILSVEVEIPRKSYTTQLISAEDGNELEKSAQPQNAGFLKPNIFTLTVPQVDGGTNLSIKMSWSQKLTYNEGQFFLDIPFNFPEYVTPAVKKISKREKIYLSVNAGTGTEVLCKGCSHQLKEKMRNAGKLRFSYEADVLKWSNTDFSFSYTASSSHIVGGLFLQSAPVHDVDQRDIFSFYLFPGKQQRTKAFKREVMFVVDTSKSMTGKPLEDVHNAISTALSKLNPGDSFNIITFSDDTSLFSTSMELVTPDAVERGIEWMNKNFVVADGTNMLPPLEKAVEMLSNTRGSIPMIFFVTDGSVEDERHICDVMKKRLASAGSVCPRIHTFGLGVFCNHYFLQMLANLSRGQHESVYNTDHIEERMDKLFTRALSTVLVNITIEPLQNLDEVEVYPSNIPDLTSASPLMIYGRYRGKFPENVKANGLLGDLSSFSADLTVQSAKDMPLDKVFAKNVIDLLTAEAWFSEDKQLKEKIAKLSIQTGVPSEYTRMIQLEHTEEALKPSDTGGKKKTASNGEKQKMISRTIPLQNLGIGFGDRTATTENVPPGFGEQRAPDAAEKFVKAASSCCVSLCNKCCCMCCVQCCTKLNDQCVLVFTQLFTALACIACFECCTNVCCTCGDD

SEQ ID NO: 2437 - protein, 756 aa, Eutrema parvulum
MAEDFARAVDDGLKLAKRIYFGNDRAVAAPRLTAPMERSSTPPAYLPSAPMVYAVIPDPGIVDNPDLPSYQPHVHGRCDPPALIPLQMNAIELDVDCYLDTALVTVTGSWRVHCVMGSKRCDCQIAIPMGEQGSILGVEVEIPRKSYTTQLITAEDGNELEKTAQPQTGGFLKPNIFTLTIPQVDGGTNLSIKMSWSQKLTYNEGQFFLDIPFNFPEYVTPAVKKISKREKIYLSINAGTGTEVLCKGCSHQLKEKMRNAGKLRFSYEADVLKWSNTDFSFSYTASSSNIVGGLFLQPAPVHDVDQRDIFSFYLFPGKQQRTKAFKREVVFVVDISKSMTGKPLEDVNSAISIALSKLNPGDSFNIITFSYDTSLFSTSMELVTSNAVERGIEWMNKNFVVADGTNVLPPLEKAVEMLSNTRGSIPMIFFVTDGSVEDERHICGVMKKHLASAGSVCPRIHTFGLGVFCNHYFLQMLANLSRGQHESVYNTDHIEERLDKLLTRALSTVLLNITIEPLQNLAEIEIYPSNIPDLTSSSPLMIYGRYRGKFPENVKANGLLGDLSSFSADLTVQSAKDIPLDKVFAKNVIDLLTAEAWFSEDNQLKEKITKLSIQNGVPSEYTRMIQLENTEDVLKPSDTGGKKKTASNGEKQKMISRTIPLQNFGIGFGDITATRENVPPGFGEQRGPDAAEKFVKAASSCCVSLCNKCCCMCCVQCCTKLNDQCVLVFTQLFTAIACIACFECCTNVCCACGGDE

SEQ ID NO: 2438 - protein, 256 aa, Brassica napus
MAEDFARAVDDGLKLAKRIYFGHDRAVAAPRLTAPMERSSTSQAHLPSAPMVYAVIPDPGIVDNPDLPSYQPHVHGRCDPPALIPLQMNAIELHVDCYLDTALVTATGSWRVHCVMGSKRCDCRIAIPIGDQGSILGVEVEIPRKSYTTQLITAQDGTELEKTAQPQSGGFLKPNIFTLTVPQVDGGTNLSIKMTWSQKLTYNEGQFFLDIPFNFPEYVTPAVKKISKREKIYLSVNAGTGTEVLCKGCSHPLKEK

SEQ ID NO: 2439 - protein, 754 aa, Brassica rapa
MAEDFARAVDDGLKLAKRIYFGHDRAVAAPRLTAPMERSSTSQAHLPSAPMVYAVIPDPGIVDNPDLPSYQPHVHGRGDPPALIPLQMNAIELHVDCYLDTALVTATGSWRVHCVMGSKKCDCRIAIPIGDQGSILGVEVEIPRKSYTTQLITAQDGTELEKTAQPQSGGFLKPNIFTLTVPQVDGGTNLSIKMTWSQKLTYNEGQFFLDIPFNFPEYVTPAVKKISKREKIYLSVNAGTGTEVLCKGCSHPLKEKMRNAGKLRFAYEADVLKWSNTDFSFSYTVSSSNIVGGLFLQSASVQDVDQRDIFSFYLFPGKQQSTKSAKREVVFIVDISKSMAGKPLEDVKNAISTALSKLNPEDSFNIITFSDDTSLFSTSMEAVTSDAVERGIEWMNKSFVVADGTNMLPPLEKAVEMLSNTRGSVPMIFFLTDGSVEDERHICNVMKKRLANAGSVWPRIHTFGLGVFCNHYFLQMLANISRGQHESVYNTDHIEERLDKLFIRALSTVLLNITIEPLQNLDEVEVYPSNIPDLTSSSPLMVYGRYRGKFPESVKANGLLGDLSSFSVDLTVQSAKDMPLDKVFAKNVIDLLTAEAWFSEDNQPKEKITRLSIQTGVPSEYTRMIQLENTEEASKPINTGGKKKTETNGEKQKVISRTIPLQNFGIGFGDTTATKENVPPGFGEARAPDAAEKFVKAASSCCVSLCNKCCCMCCVQCCTKLNDQCVIVFTQLFTAIACIACFECCSHVCCGGDD

SEQ ID NO: 2440 - protein, 757 aa, Brassica rapa
MAEDFARAVEDGLKLAKRIYFGNDRAVAAPRLASPMERAASAAHAHLPTAPMVYAVIHEPGIVDNPDLPSYQPHVHGRCDPPALIPLQMNAIELDVDCYLDTALVTVTGSWRVHCVMGSKRCDCRIAIPMGEQGSILGVEVEIPRKSYTTQLITAEDGHELEKTAQPQSGGFLKPNIFTITIPQVDGGTNLSIKMSWSQKLTYNEGEFFLDIPFHFPEYVTPAVKKISKREKIYLSVNAGTGTEVLCKGCSHPLKEKMRKAGKLRFSYEADVLKWSNTDFSFSYTASSSNIVGGLFLQSAPVQDVDQREIFSFYLFPGKQQRTKAFKREVVFVVDISKSMTGKPLEDVKNAISTALSKLSPGDSFNIMSFSDETSLFSTSMEPATPDTVERGIEWMNKNFVVADGTNVLPPLEKAVEMLSNTRGSLPMIFFVTDGSVEDERHICDAMKKRLASAGSVCPRIHTFGLGIFCNHYFLQMLANLSRGQHESVYNTDHIEERLDKLFTRALSTVLLNITIEPLQNLDEIEVYPSNIPDLTSVSPLMIYGRYRGKFPEKVKANGLLGDMSSFSADLSVQSAKDIPLDKVFAKNVIDLLTAKAWFSEDKQLIEKITKLSIQTGVPSEYTRMIQLENTEEALKPSDTGGKKQTGSNGEKQKLISRTIPLQNFGIGFGDTTATRENVPPGFGEQRAPDAAEKFVKAASSCCASLCNKCCCMCCVQCCTKLNDQCVLVFTQLFTALACIACFECCSNVCCACGGDE

SEQ ID NO: 2441 - protein, 257 aa, Brassica napus
MAEDFARAVEDGLKLAKRIYFGNDRAVAAPRLASPMERAASAAHAHLPTAPMVYAVIHEPGIVDNPDLPSYQPHVHGRCDPPALIPLQLNAIELDVDCYLDTALVTVTGSWRVHCVMGSKRCDCRIAIPMGEQGSILGVEVEIPRKSYTTQLITAEDGHELEKTAQPQSGGFLKPNIFTITIPQVDGGTNLSIKMSWSQKLTYNEGEFFLDIPFHFPEYVTPAVKKISKREKIYLSVNAGTGTEVLCKGCSHPLKEK

SEQ ID NO: 2442 - protein, 756 aa, Brassica napus
MAEDFARAVEDGLKLAKRIYLGNDRAVAAPRLAAPMERTSTAQAYLPSSPMVYAVIPDPGIVDNPDLPSYQPHVHGRCDPPALIPLQMNAIELDVDCYLDTALVTVTGTWRVHCVMGRKRCDCRIAVPMGEHGSILGVEVEITRKSYATQLIAAQDGNELEKTTQPQSGGFLKPNIFTLTVPQVDGGTNLSIKMSWSQKLTYNEGEFFLDIPFHFPEYVTPAVKKISKREKIYLSVNAGTGTEVLCKGCSHPLKEKMRNAGKLRFSYEADVLKWSNTDFSFSYTASSSSIVGGLFLQSAPVQDVDQREIFSFYLFPGKQQRTKAFKREVVFVVDISKSMTGKPLENVNNAISAALSKLNPGDSFNIMTFSDDTSLFSTSMEPATPDTVERGIEWMNKNFVVADGTNVLPPLETAVEMLSNTRGSLPMIFFVTDGSVEDERHICDAMKKRLASAGSVCPRIHTFGLGIFCNHYFVQMLANLSRGQHESVYNTDHIEERLDKLFTRALSTVLLNITIEPLQNLDEIEVYPSNIPDLTSASPLMIYGRYRGKFPENVKANGLLGDMSSFSADLTVQSAKDIPLDKVFAKNVIDLLTAKAWFSEDKQLIEKITKLSIQTGVPSEYTRMIQLENTEEALKPSDTGGKKQTGRNGEKQKLISRTIPLQNFGIGFGDTTVTRENVPPGFGEQRAPDAAEKFVKAASSCCVSLCNKCCCMCCVQCCTKLNDQCVLVFTQLFTALACIACFECCSNVCCACGGDE

SEQ ID NO: 2443 - protein, 757 aa, Brassica rapa
MAEDFARAVEDGLKLAKRIYLGNDRAVAAPRLAAPMERTSTVHAYLPSSPMVYAVIPDPGIVDNPDLPSYQPHVHGRCDPPALIPLQMNAIELDVDCYLDTALVTVTGTWRVHCVMGSKRCDCRIAVPMGEEHGSILGVEVEITRKSYATQLIAAQDGNELEKTTQTQSGGFLKPNIFTLTVPQVDGGTNLSIKMSWSQKLTYKEGEFFLDIPFNFPEYVTPAVKKISKREKIYLSVDAGTGTEVISKGCSHQLKEKVRNAGTLRFSYEADVLKWSNTDFSFSCTASSSNIVGGLFLQSAPVHDVDQRDVFSFYLFPGKQQKIKAFKREVVFVVDVSKSMTGKPLEDVNNAISTALSKLSPGDSFNIITFSDDTSLFSTSMELVTPDAVERGIEWMNKNFAVSDGTNMLPPLEKAVEMLSNTRGSVPMIFFVTDGSVEDERHICNVMKKRLASGGSVSPRIHTFGLGVFCNHYFLQSLANLSRGQHESVYNTDHIEERLDKLFTRALSTVLLNITIEPLQVLDEVEVCPSNIPDLTSSSPLMIYGRYRGKFPENVKANGLLGDFSSFSVELTVQSAKDMPLDKVFAKNVIDLLTAEAWFSEDKQLIEKVTKLSIQTGVPSEYTRMIQLENTEEASKQSDTGGKKKTASNGEKQKLISRTIPLQKFSIGFGDITATRENVPPGYGEQRAPDAAEKFVKAASSCCVSLCNKCCCMCCVQCCTKLNDQCVLVFTQLFTALACIACFECCTNVCCACGGED

SEQ ID NO: 2444 - protein, 490 aa, Arabidopsis lyrata
MENGSGKVLKPMDSEQLREYGHRMVDFIADYYKTIEDFPVLSQVQPGYLHKLLPDSAPDHPETLDQVLDDVRAKILPGVTHWQSPSFFAYYPSNSSVAGFLGEMLSAGLGIVGFSWVTSPAATELEMIVLDWLAKLLNLPEQFMSKGNGGGVIQGSASEAVLVVLIAARDKVLRSVGKNALQKLVVYSSDQTHSALQKACQIAGIHPENCRVLKTDSSTNYALRPELLQEAVSQDLDAGLIPFFLCANVGTTSSTAVDPLAALGKIANRNEMWFHVDAAYAGSACICPEYRQYIDGVETADSFNMNAHKWFLTNFDCSLLWVKDQDSLTLALSTNPEFLKNKASQANLVVDYKDWQIPLGRRFRSLKLWMVLRLYGSETLKSYIRNHIKLAKEFEQLVSQDPNFEIVTPRIFSLVCFRLVPVKNEEKKCNNRNRELLDAVNSSGKLFISHTALSGKIVLRCAIGAPLTEEKHVKEAWKVIQEEASYLLHK

SEQ ID NO: 2445 - protein, 490 aa, Brassica rapa
MENGSRNVLKPMDSEQLREYGHRMVDFIADYYKTIETFPVLSQVQPGYLHNLLPDSAPDQPETVEQVLDDVKTKILPGITHWQSPTFYAYYPSNSSVAGFLGEMLSAGLGIVGFSWVTSPAATELEMIVLDWLAKLLNLPEQFLSKGNGGGVIQGSASEAILVVMIGAREKVLRRVGKNALGKLVVYSSDQTHSALQKACQIAGIHPENCRVLKADSSTNYALRPELLQEAVSKDIEAGLIPFFLCGNVGTTSSTAVDPLAALGKIAKSNEIWFHVDAAYAGSACICPEYRQYIDGVETADSFNMNAHKWFLTNFDCSLLWVKDQYVLTEALSTNPEFLKNKASQANLVVDYKDWQIPLGRRFRSLKLWMVLRLYGAETLKSYIRNHIKLAKDLEQLVSQDPNFEVVTPRIFSLVCFRILPVDNDEKECNNRNRNLLDAVNSSGKLFLSHTALSGKIVLRCAIGAPLTEERHVKETWKVIQEEASRLLGK

SEQ ID NO: 2446 - protein, 479 aa, Eutrema halophilum
MDSEQLREYGHRMVDFIADYYKTIEDFPVLSQVQPGYLHNLLPDSAPDQPETLEEVLDDVKGKILPGVTHWQSPSFFAYYPSNSSVAGFLGEMLSAGLGIVGFSWITSPAATELEMIVLDWLAKLLNLPEQFLSRGNGGGVIQGSASEAELVVLIAARDKVLRSVGKKALEKLVVYSSDQTHSALQKACQIAGIHPENCRVLKADYSTNYALRPETLQEAVSKDLEAGLIPFFLCANVGTTSSTAVDPLAALGEIAKSNEMWFHVDAAYAGSACICPEYRQYIDGVETADSFNMNAHKWFLTNFDCSLLWVKDQYALTEARSTNPEFLKNKASQANLVVDYKDWQIPLGRRFRSLKLWMVLRLYGSENLKSYIRNHIKLAKDFEQLVSEDPNFEIVTPRIFSLVCFRIVPAENDEKKCNNQNRNLLDAVNSSGKLFLSHTALSGKIVLRCAIGAPLTEEKHVKEAWKVIQEEASYLLRK

SEQ ID NO: 2447 - protein, 482 aa, Eutrema halophilum
MDSEQLREYGHRMVDFIADYYKTIENFPVLSQVQPGYLHNLLPDSAPDHPETLEQVLDDVKAKILPGVTHWQSPSFFAYYPSNSSVAGFLGEMLSAGLGIVGFSWITSPAATELEMIVLDWLAKLLNLPEQFLSKGNGGGVIQGSASEALLVVLIAARDKFLRRFGKNSVEKLVVYSSDQTHSSLQKACQISGIHPENCRVLKTFSSTNYALPPELLQETISRDLEAGLIPFFLCANVGTTSSTAVDPLAALGKIAKRNEMWFHIDAAYAGSACICPEYRQYIDGVESADSFNMNAHKWFLTNFDCSLLWVKDKYALTEALSTNPEYLKNKASQANLVVDYKDWQIPLGRRFRSLKLWMVLRLYGSETLKSYIRNHIKLAKDFERLVSQDPNFEIVTPRIFSLVCFRIVPSKNDEKKCNNQNRNLLDAVNSSGKLFITHTALSGKIVLRCAIGAPLTEEKHVKEAWKVIQEEASYLLRKEKT

SEQ ID NO: 2448 - protein, 494 aa, Brassica rapa
MENGSSNKALKPMDSEQLREYGHRMVDFIADYYKTIETFPVLSQVQPGYLHNLLPDSAPDQPETLEQVLDDVKEKILPGVTHWQSPSFFAYYPANSSVAGFLGEMLSAALNIVGFSWVSSPAATELEMIVLDWFAKLLNLPEQFLSRGNGGGVIQGTASEAILVVMIAARDKVLRSLGKKALEKLVVYSSDQTHSSLLKACQIAGIHLENCRMLKTDSSTNYALRPESLQEAVSGDLEAGLIPFFLCGTVGTTSSTAVDPLAELGKIAKSNEMWFHVDAAYAGSACICPEYRQYIDGVETADSFNMNAHKWFLTNFDCSLLWVKDRYALTEALSTNPEFLKNKASQANLVVDYKDWQIPLGRRFRSLKLWMVLRLYGAETLKSYIRNHIKLAKDLEQLVSQDPNFEVVTPRIFSLVCFRIAAVDNDEKTCNNLNRSLLDAVNSSGKLFISHTTLSGKFVLRLAIGAPLTEEKHVMDAWKVIQEEASFLLASQVK

SEQ ID NO: 2449 - protein, 491 aa, Brassica rapa
MENGRSNNALKPMDSEQLREYGHRMVDFVADYYKTIETFPVLSQVQPGYLHNLLPESAPDHPETVEQVLDDVKAKILPGVTHWQSPSFFAYFPINGSIAGFLGEMLSAGLNTMSFSWVASPAATELEIVVVDWVAKLLNLPEQFLSKGNGGGVIQGSACEAILVVMIAARDKVLRSVGKKALEKLVVYSSDQTHSSLQKACQLAGIHLENCRVLKTDSSTNYALRPESLQEAVSKDLEAGLIPFFLCGTVGTTSSTAVDPLAALGKIAKSNEMWFHIDAAYAGSACICPEYRQYIDGVETADSFDMNAHKWLLTNFECSLLWVKDQSALTEALSTNPEYLKNKASQANLVVDYKDWQIPLGRRFRSLKLWMVLRLYGAENLKSYIRNHIKLAKIFEQLVSKDPNFEVVTPRIFSLVCFRIAAVDNDEKKCNNLNRSLLDAVNSSGKLLFSHTILSEKFVLRFAIGAPLTEEKHVKEAWKVIQEEASFLLSK

SEQ ID NO: 2450 - protein, 494 aa, Raphanus sativus
MENGSSNNALKPMDSEQLREYGHKMVDFIADYYKTIETFPVLSQVQPGYLQNLLPESAPDHPETVEQVLDDVKAKILPGITHWQSPSFFAYFPINGSVAGFLGEMLTAGLNTMSFSWVASPAATELEIIVLDWFAKLLNLPEQFQSKGNGGGVIQGTASEAILVVMIAARDKVLRRVGKKALEKLVVYSSDQTHSSLQKACQIAGIHLENCRVLKTDPSTNYALHPESLQEAVSQDLEAGLIPFFLCGTVGTTSSTAVDPLAALGEIAKSNEMWFHVDAAYAGSACICPEYRQHIDGVETADSFNMNAHKWLLTNFDCSLLWVKDQYALTEALSTNPEFLKNKASQANLVVDYKDWQIPLGRRFRSLKLWMVLRLYGAETLKNYIRNHIKLAKDFEQLVSQDPNFEVVTPRIFSLVCFRIAPVDNDEKTCNNLNRNLLEALNSSGKLFISHTILSGKFVLRVAIGAPLTEEKHVMEAWKVIQEEASNILASQVN

SEQ ID NO: 2451 - protein, 490 aa, Eutrema parvulum
MDSEQLREYGHRMVDFIADYYKTIESFPVLSQVQPGYLHNLLPDSAPDHPETLEQVLDDVKAKILPGVTHWQSPSFFAYYPSNSSVAGFLGEMLSAGLGIVGFSWVTSPAATELEMIVLDWLAKLLNLPEQFLSKGNGGGVIQGSASEAILVVMIAARDKVLRSVGKNALEKLVVYSSDQTHSALQKACQISGIHPENCRVLKADSSTNYALRPELLQKAVSQDLEAGLIPFFLCANVGTTSSTAVDPLAALGKIAQSNEMWFHVDAAYAGSACICPEYRQYIDGVETADSFNMNAHKWFLTNFDCSLLWVKDQYALTEALSTNPEFLKNKASQANLVVDYKDWQIPLGRRFRSLKLWMVLRLYGAESLKSYIRNHIKLANDFEQLVSQDPNFEIVTPRIFSLVCFRIVPAENDEKKCNNRNRSLLDAVNSSGKLFISHTVSSVWKNRTTLRHRSTIDRGEAREGGMEGYPGRSIILASQVNKIKKEKTI

SEQ ID NO: 2452 - protein, 471 aa, Brassica rapa
MDSEQLREYGHRMVDFIADYYKTIETFPVRSQVQPGYLHNLLPDSAPDHPETLEQVLDDVKVKILPGVTHWQSPSFFAYYPSNSSVAGFLGEMLSTGLNVIGFSWVASPAATELEIIVLDWLAKLLNLPEQFLSKGKGGGVIQGSASEAILVVMIAARDKVLRTAGKNALGKLVVYSSDQTHSALQKACQVKVLKADTSTNFALRPELLQEAVSLDLEAGLFPFFLCGNVGTTSSTAVDPLADLGKIAKSNEMWFHVDAAYAGNACICPEYRQYIDGVETADSFNMNAYKGLLTNFDCSLLWVKDQYAVTEAFSANPEYLKNKASEANLVVDYKDWQIALSRRFRSLKLWMVLRLYGAETLKSYIRNHIKLAKVFEQLVSQDPNFDVITPRIFSLVCFRMVPIDDDEKKCNSRNLELLEAVNSSGKLFISHTALSGKMVLRFSIGAPLTEQKHVKEAWKVIREEASYLLGK

SEQ ID NO: 2453 - protein, 754 aa, Arabidopsis lyrata
MARFPNSPAPNLLLRLFSSNKRSSSPTAALLTGDFQLIRHFSAGTAARAAKDDKEPWWKESMDKLRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLNQARAKLRHHSAAVQVPIGLEENFQGLVDLIHVKAYFFHGSSGENVVAGDIPADMEGLVAEKRRELIETVSEVDDVLAEKFLNDEPVSAAELEEAIRRATIAQKFVPVFMGSAFKNKGVQPLLDGVVSYLPSPNEVNNYALDQMNNEERVTLTGSPDGPLVALAFKLEEGRFGQLTYLRVYEGVIKKGDFIINVNTGKRIKVPRLVRMHSNDMEDIQEAHAGQIVAVFGIECASGDTFTDGSVKYTMTSMNVPEPVMSLAVQPVSKDSGGQFSKALNRFQKEDPTFRVGLDPESGQTIISGMGELHLDIYVERMRREYKVDATVGKPRVNFRETITQRAEFDYLHKKQSGGAGQYGRVTGYVEPLPPGSKEKFEFENMIVGQAIPSGFIPAIEKGFKEAANSGSLIGHPVENLRIVLTDGASHAVDSSELAFKMAAIYAFRLCYTAARPVILEPVMLVELKVPTEFQGTVAGDINKRKGIIVGNDQEGDDSVITANVPLNNMFGYSTSLRSMTQGKGEFTMEYKEHSAVSNEVQAQLVNAYSASKATE

SEQ ID NO: 2454 - protein, 754 aa, Arabidopsis thaliana
MARFPTSPAPNRLLRLFSSNKRSSSPTAALLTGDFQLIRHFSAGTAARVAKDEKEPWWKESMDKLRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLNQARAKLRHHSAAVQVPIGLEENFQGLIDLIHVKAYFFHGSSGENVVAGDIPADMEGLVAEKRRELIETVSEVDDVLAEKFLNDEPVSASELEEAIRRATIAQTFVPVFMGSAFKNKGVQPLLDGVVSFLPSPNEVNNYALDQNNNEERVTLTGSPDGPLVALAFKLEEGRFGQLTYLRVYEGVIKKGDFIINVNTGKRIKVPRLVRMHSNDMEDIQEAHAGQIVAVFGIECASGDTFTDGSVKYTMTSMNVPEPVMSLAVQPVSKDSGGQFSKALNRFQKEDPTFRVGLDPESGQTIISGMGELHLDIYVERMRREYKVDATVGKPRVNFRETITQRAEFDYLHKKQSGGAGQYGRVTGYVEPLPPGSKEKFEFENMIVGQAIPSGFIPAIEKGFKEAANSGSLIGHPVENLRIVLTDGTSHAVDSSELAFKMAAIYAFRLCYTAARPVILEPVMLVELKVPTEFQGTVAGDINKRKGIIVGNDQEGDDSVITANVPLNNMFGYSTSLRSMTQGKGEFTMEYKEHSAVSNEVQAQLVNAYSASKATE

SEQ ID NO: 2455 - protein, 753 aa, Eutrema halophilum
MARFPSSPTPNLLLRLFSSNKRSSSPTAALLAGDFQLRQFSAGSAARAAKDDKEPWWKESMNKLRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLNQARAKLRHHSAAVQVPIGLEEHFKGLIDLIHVKAYFFHGSSGENVVAGDIPADMEDLVGEKRRELIEIVSEVDDVLAEKFLNDEPVSAAELEEAIRRATIAQKFVPVFMGSAFKNKGVQPLLDGVLSYLPCPTEVNNYALDQNNNEERVTLTGSPDGPLVALAFKLEEGRFGQLTYLRVYEGVIKKGEFIINVNTGKRLKVPRLVRMHSNDMEDIQEAHAGEIVAVFGVECASGDTFTDGSVKYTMTSMSVPEPVMSLAVQPVSKDSGGQFSKALNRFQKEDPTFRVGLDPESGQTIISGMGELHLDIYVERMRREYKVDATVGKPRVNFRETITQRAEFDYLHKKQSGGAGQYGRVTGYVEPLPPDSKEKFEFENMIVGQAIPSGFIPAIEKGFKEAANSGSLIGHPVENLRIVLTDGASHAVDSSELAFKMAAIYAFRLCYSAARPVILEPVMLVELKVPTEFQGTVAGDINKRKGIIVGNDQEGDDSVIQAHVPLNNMFGYSTSLRSMTQGKGEFTMEYKEHCAVSNDVQTQLVNAYTASKATD

SEQ ID NO: 2456 - protein, 753 aa, Eutrema parvulum
MARFPSSASPNLLFRLFSSNKRSSSPTTALLAGDFQLRQFSAGSAAHAAKGEKEPWWKESMNKVRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLSQARAKLRHHSAAMQVPMGLEENFKGLIDLVHVKAYFFHGSSGENVVPGDIPADMEELVAEKRRELIETVSEVDDVLAEKFLNDEPVSAAELEEAIRRATIAQKFVPVFMGSAFKNKGVQPLLDGVLSYLPCPTEVNNYALDQKNDEERVTLTGSPDGPLVALAFKLEEGRFGQLTYLRVYEGVIKKGDFIINVNTGKRIKVPRLVRMHSNDMEDIQEAHAGEIVAVFGVECASGDTFTDGSVKYTMTSMSVPEPVMSLAVQPVSKDSGGQFSKALNRFQKEDPTFRVGLDPESGQTIISGMGELHLDIYVERMRREYKVDATVGKPRVNFRETITQRAEFDYLHKKQSGGAGQYGRVTGYVEPLPADSKEKFEFENMIVGQAIPSGFIPAIEKGFKEAANSGSLIGHPVENIRIVLTDGASHAVDSSELAFKMAAIYAFRLCYTAARPVILEPVMLVELKVPTEFQGTVAGDINKRKGIIVGNDQEGDDSVIQAHVPLNNMFGYSTSLRSMTQGKGEFTMEYKEHCAVSNEVQTQLVNAHNASKATD

SEQ ID NO: 2457 - protein, 755 aa, Brassica rapa
MPRFPPSPSPNLLQRLFSSSNKRSSSSPTAALLSGDFHLRQFSSGNAARAAKGEKEPWWKESMNKVRNIGISAHIDSGKTTLTERVLFYTGRIHEIHEVRGRDGVGAKMDSMDLEREKGITIQSAATYCTWKDYKVNIIDTPGHVDFTIEVERALRVLDGAILVLCSVGGVQSQSITVDRQMRRYEVPRVAFINKLDRMGADPWKVLSQARAKLRHHSAAVQMPIGLEENFKGLIDLVHVKALFFHGSSGENVVAGDIPADMEELVAEKRRELIETVSEVDDVLAEKFLNDEPVTAAELEEAIRRATIAQKFVPVFMGSAFKNKGVQPLLDGVVSYLPCPTEVNNYALDQDNEEAKVTLTGSPDGPLVALAFKLEEGRFGQLTYLRIYEGVIKKGDFIINVNTKKRIKVPRLVRMHSNDMEDIQEAHAGEIVAVFGIDCASGHTFTDGSVKYTMTSMSVPEPVMSLAVQPVSKDSGGQFSKALQRFQKEDPTFRVGLDPDSNQTIISGMGELHLDIYVERMRREYKVDATVGKPRVNFRETITQRAEFDYLHKKQSGGAGQYGRVTGYVEPLPSDSKEKFEFENMIVGQAIPSGFIPAIEKGFKEAANSGSLIGHPVENIRIVLTDGASHAVDSSELAFKMAAIYAFRLCYTAAKPVILEPVMLVELKVPTEFQGTVAGDLNKRKGIIVGNDQEGDDSVIQAHVPLNNMFGYSTSLRSMTQGKGEFTMEYKEHSAVSNDVQTQLVNAHNATKPTD

SEQ ID NO: 2458 - protein, 755 aa, Theobroma cacao
MARFPRSPVQRLLYTFYSAKTTPSSSPSQTAALLLGNFEIRHFSAGNVARAKDDKEPWWKESMERLRNIGISAHIDSGKTTLTERVLYYTGRIHEIHEVRGKDGVGAKMDSMDLEREKGITIQSAATYCTWKDYKINIIDTPGHVDFTIEVERALRVLDGAILVLCSVGGVQSQSITVDRQMRRYEVPRLAFINKLDRMGADPWKVLNQARSKLRHHSAAVQVPIGLEENFQGLIDLVQLKAYYFHGSNGEKVVAEEIPADMEAIVAEKRRELIEMVSEVDDKLAEAFLNDEPISSADLEDAIRRATIARKFVPVFMGSAFKNKGVQPLLDGVLSYLPCPVEVSNYALDQTKNEEKVTLSGTPDGPLVALAFKLEEGRFGQLTYLRVYEGVIRKGDFIVNINTGKKIKVPRLVRMHSDEMEDIQEAHAGQIVAVFGVDCASGDTFTNGSVKYTMTSMNVPEPVMSLAVQPVSKDSGGQFSKALNRFQKEDPTFRVGLDAESGQTIISGMGELHLDIYVERIRREYKVDATVGRPRVNFRETITQRAEFDYLHKKQSGGQGQYGRVCGYVEPLPPGSPIKFEFENMIVGQAIPSNFIPAIEKGFKEAANSGSLIGHPVENIRIVLTDGASHAVDSSELAFKLAAIYAFRQCYTAARPVILEPIMLVELKVPTEFQGTVAGDINKRKGVIVGNDQDGDDSIITTNVPLNNMFGYSTALRSMTQGKGEFTMEYKEHLPVSQDVQMQLVNTHKASKAAE

SEQ ID NO: 2459 - protein, 755 aa, Gossypium hirsutum
MARFQRSAVPRLLYTLYSTKAAPYCSPSPTAALLLGNFEVRHFAAGNVARAKDDKEPWWKESMERLRNIGISAHIDSGKTTLTERVLYYTGRIHEIHEVRGKDGVGAKMDSMDLEREKGITIQSAATYCTWKDYQINIIDTPGHVDFTIEVERALRVLDGAILVLCSVGGVQSQSITVDRQMRRYEVPRLAFINKLDRMGADPWKVLNQARSKLRHHTAAVQVPIGLEENFKGLIDLVQLKAYYFHGSSGEKVVSEGIPADMEAIVAEKRRELIEVVSEVDDKLAEAFLNDEPISPADLEEAVRRATIARKFVPVFMGSAFKNKGVQPLLDGVLSYLPCPIEVSNYALDQTKNEEKVMLPGTPDGPLVALAFKLEEGRFGQLTYLRVYEGVVRKGDFIVNVNTGKKIKVPRLVRMHSNEMEDIQEAHAGQIVAVFGVDCASGDTFTNGSVKYTMTSMNVPEPVMSLAVQPVSKDSGGQFSKALNRFQREDPTFRVGLDAESGQTIISGMGELHLDIYVERIRREYKVDATVGKPRVNFRETITQRAEFDYLHKKQSGGQGQYGRVCGYVEPLPPGSPIKFEFENMIVGQAIPSNFIPAIEKGFKEAANSGSLIGHPVENIRVVITDGASHAVDSSELAFKLASIYAFRQCYSAARPVILEPIMLVELKVPTEFQGTVAGDINKRKGVIVGNDQDGDDSVITANVPLNNMFGYSTALRSMTQGKGEFTMEYKEHSPVSQDVQMQLVNTHKANKAVE

SEQ ID NO: 2460 - protein, 755 aa, Gossypium hirsutum
MARFQRSAVPRLLYTLYSTKAAPYSSPSPTAALLRGNFEVRHFAAGNVARAKDDKEPWWKESMERLRNIGISAHIDSGKTTLTERVLYYTGRIHEIHEVRGKDGVGAKMDSMDLEREKGITIQSAATYCTWKDYQINIIDTPGHVDFTIEVERALRVLDGAILVLCSVGGVQSQSITVDRQMRRYEVPRLAFINKLDRMGADPWKVLNQARSKLRHHTAAVQVPIGLEENFKGLIDLVQLKAYYFHGSSGEKVVSEGIPADMEAIVAEKRRELIEVVSEVDDKLAEAFLNDEPISPADLEEAVRRATIARKFVPVFMGSAFKNKGVQPLLDGVLSYLPCPIEVSNYALDQTKNEEKVMLPGTPDGPLVALAFKLEEGRFGQLTYLRVYEGVVRKGDFIVNVNTGKKIKVPRLVRMHSNEMEDIQEAHAGQIVAVFGVDCASGDTFTNGSVKYTMTSMNVPEPVMSLAVQPVSKDSGGQFSKALNRFQREDPTFRVGLDAESGQTIISGMGELHLDIYVERIRREYKVDATVGKPRVNFRETITQRAEFDYLHKKQSGGQGQYGRVCGYVEPLPPGSPIKFEFENMIVGQAIPSNFIPAIEKGFKEAANSGSLIGHPVENIRVVITDGASHAVDSSELAFKLASIYAFRQCYSAARPVILEPIMLVELKVPTEFQGTVAGDINKRKGVIVGNDQDGDDSVITANVPLNNMFGYSTALRSMTQGKGEFTMEYKEHSPVSQDVQMQLVNTHKANKAVE

SEQ ID NO: 2461 - protein, 755 aa, Gossypium raimondii
MARFQRSAVPRLLYTLYSTKAAPYSSPSPTAALLLGNFEVRHFAAGNVARAKDDKEPWWKESMERLRNIGISAHIDSGKTTLTERVLYYTGRIHEIHEVRGKDGVGAKMDSMDLEREKGITIQSAATYCTWKDYQINIIDTPGHVDFTIEVERALRVLDGAILVLCSVGGVQSQSITVDRQMRRYEVPRLAFINKLDRMGADPWKVLNQARSKLRHHTAAVQVPIGLEENFKGLIDLVQLKAYYFHGSSGEKVVTEEIPADMEAIVAEKRRELIEVVSEVDDKLAEAFLSDEPISPADLEEAVRRATIARKFVPVFMGSAFKNKGVQPLLDGVLSYLPCPIEVSNYALDQTKNEEKVMLPGTPDGPLVALAFKLEEGRFGQLTYLRVYEGVVRKGDFIVNVNTGKKIKVPRLVRMHSNEMEDIQEAHAGQIVAVFGVDCASGDTFTNGSVKYTMTSMNVPEPVMSLAVQPVSKDSGGQFSKALNRFQREDPTFRVGLDAESGQTIISGMGELHLDIYVERIRREYKVDATVGKPRVNFRETITQRAEFDYLHKKQSGGQGQYGRVCGYVEPLPPGSPIKFEFENMIVGQAIPSNFIPAIEKGFKEAANSGSLIGHPVENIRVVITDGASHAVDSSELAFKLASIYAFRQCYSAARPVILEPIMLVELKVPTEFQGTVAGDINKRKGVIVGNDQDGDDSVITANVPLNNMFGYSTALRSMTQGKGEFTMEYKEHSPVSQDVQMQLVNTHKANKAVE

SEQ ID NO: 2462 - protein, 755 aa, Gossypium hirsutum
MARFQRSAVPRLLYTLYSTKAAPYSSPSPTAALLRGNFEVRHFAAGNVARAKDDKEPWWKESMERLRNIGISAHIDSGKTTLTERVLYYTGRIHEIHEVRGKDGVGAKMDSMDLEREKGITIQSAATYCTWKDYQINIIDTPGHVDFTIEVERALRVLDGAILVLCSVGGVQSQSITVDRQMRRYEVPRLAFINKLDRMGADPWKVLNQARSKLRHHTAAVQVPIGLEENFKGLIDLVQLKAYYFHGSSGEKIVTEEIPADMEAIVAEKRRELIEVVSEVDDKLAEAFLSDEPISPADLEEAVRRATIARKFVPVFMGSAFKNKGVQPLLDGVLSYLPCPIEVSNYALDQTKNEEKVMLPGTPDGPLVALAFKLEEGRFGQLTYLRVYEGVVRKGDFIVNVNTGKKIKVPRLVRMHSNEMEDIQEAHAGQIVAVFGVDCASGDTFTNGSVKYTMTSMNVPEPVMSLAVQPVSKDSGGQFSKALNRFQREDPTFRVGLDAESGQTIISGMGELHLDIYVERIRREYKVDATVGKPRVNFRETITQRAEFDYLHKKQSGGQGQYGRVCGYVEPLPPGSPIKFEFENMIVGQAIPSNFIPAIEKGFKEAANSGSLIGHPVENIRVVITDGASHAVDSSELAFKLASIYAFRQCYSAARPVILEPIMLVELKVPTEFQGTVAGDINKRKGVIVGNDQDGDDSVITANVPLNNMFGYSTALRSMTQGKGEFTMEYKEHSPVSQDVQMQLVNTHKANKAVE

SEQ ID NO: 2463 - protein, 753 aa, Gossypium raimondii
MARFPRSAIPRLLYTFFSSKTRRFYPSPTAALLLGNFEVRQFSAGNVARAKDAKEPWWKESMERLRNIGISAHIDSGKTTLTERILYYTGRIHEIHEVRGKDGVGAKMDSMDLEREKGITIQSAATYCTWKDYQINIIDTPGHVDFTIEVERALRVLDGAILVLCSVGGVQSQSITVDRQMRRYEVPRLAFINKLDRMGADPWKVLNQARSKLRHHSAAVQVPIGLEENFQGLIDLVQLKAYYFHGSSGEKVVAEEIPADMDVIVAEKRRELIEMVSEVDDKLAEAFLNDDPISSVDLEEAVRRATIARKFVPVFMGSAFKNKGVQPLLDGVLSYLPCPIEVSNYALDQTKNEEKVMLPGTPDGPLVALAFKLEEGRFGQLTYLRVYEGVIRKGDFIVNINTGKKIKVPRLVRMHSDEMEDIQEAHAGQIVAVFGVDCASGDTFTNGSVKYTMTSMSVPEPVMSLAVQPVSKDSGGQFSKALNRFQREDPTFRVGLDAESGQTIISGMGELHLDIYVERIRREYKVDATVGKPRVNFRETITQHAEFDYLHKKQSGGQGQYGRVCGYVEPLPPGSPIKFEFENMIVGQAVPSNFIPAIEKGFKEAANSGSLIGHPVENIRIVLTDGASHAVDSSELAFKLAAIYAFRQCYSAARPVILEPIMLVELKVPTEFQGTVAGDINKRKGVIVGNDQDGDDSIITVNVPLNNMFGYSTMLRSMTQGKGEFTMEYKEHSPVSQDVQMQLVSTHKADKAE

SEQ ID NO: 2464 - protein, 750 aa, Phaseolus coccineus
MARLSRSSAPRLLYALCSTASQSPAAFLLGGSFQLRQFSAGNAARAKAEKDPWWKESMERLRNIGISAHIDSGKTTLTERVLYYTGRIHEIHEVRGRDGVGAKMDSMDLEREKGITIQSAATFCTWKDYKINIIDTPGHVDFTIEVERALRVLDGAILVLCSVGGVQSQSITVDRQMRRYDVPRLAFINKLDRMGADPWKVLNQARSKLRHHSAAIQVPIGLEEDFKGLIDLVQLKAYYFHGSSGEKVVAEDVPADMEAFVAEKRRELIETVSEVDDKLAEAFLGDETISAADLQEAVRRATLAQKFIPVFMGSAFKNKGVQPLLDGVLNYLPCPIEVSNYALDQTKNEDKVELPGSPDGPLVALAFKLEEGRFGQLTYLRIYEGVIRKGDFIVNVNTGKRIKVPRLVRMHSDEMEDIQEAHAGQIVAVFGVDCASGDTFTDGSVKYTMTSMNVPEPVMSLAVQPVSKDSGGQFSKALNRFQREDPTFRVGLDPESGQTIISGMGELHLDIYVERIRREYKVDASVGKPRVNFRETVTQRADFDYLHKKQSGGQGQYGRVIGYIEPLPAGSSTKFEFENMLVGQAIPSNFVPAIEKGFKEAANSGALIGHPVENLRVVLTDGAAHAVDSSELAFKLASIYAFRQCYATSRPVILEPVMLVELKVPTEFQGAVAGDINKRKGVIVGNDQEGDDSVITAHVPLNNMFGYSTALRSMTQGKGEFTMEYKEHSSVSNDVQTQLINAYKGNKAAE

SEQ ID NO: 2465 - protein, 756 aa, Cicer arietinum
MARFSRSSAQRLLYALSSSSSTVSPSPAGSLIGGAFHFRQFSAGNVARAKAAADDKEPWWKESMERQRNIGISAHIDSGKTTLTERVLFYTGRIHEIHEVRGKDGVGAKMDSMDLEREKGITIQSAATYCTWKDYKVNIIDTPGHVDFTIEVERALRVLDGAILVLCSVGGVQSQSITVDRQMRRYEVPRLAFINKLDRMGADPWKVLNQARSKLRHHSAAIQVPIGLEENFKGLIDLVKLKAYYFHGSSGEKIVIEEVPSDMEALVAEKRRELIETVSEVDDILAEAFLSDEPISAADLEGAIRRATIAQKFIPVFMGSAFKNKGVQPLLDGVLSYLPCPMEVSSYALDQSKNEEKVELSGSPDGPLVALAFKLEEGRFGQLTYLRIYEGIIRKGDFIINVNTGKKIKVPRLVRMHSDEMEDIQEAHAGQIVAVFGVDCASGDTFTDGSVKYTMTSMNVPEPVMSLAVQPVSKDSGGQFSKALNRFQKEDPTFRVGLDPESGQTIISGMGELHLDIYVERIRREYKVDASVGKPRVNFRETVTQRADFDYLHKKQTGGQGQYGRVIGYIEPLPAESATKFEFENMLVGQAIPSNFIPAIEKGFKEAANSGALIGHPVENLRVVLTDGAAHAVDSSELAFKLASIYAFRQCYPASRPVILEPVMLVELKVPTEFQGAVAGDLNKRKGVIVGNDQEGDDSVITAHVPLNNMFGYSTALRSMTQGKGEFTMEYKEHSPVSHDVQTQLINTCKGNKAAE

SEQ ID NO: 2466 - protein, 746 aa, Vitis vinifera
MAPSARSPAIRLLYTLSSALKTTSSPLLTGHRRTFSAGNPARVEATWWKESMERLRNIGISAHIDSGKTTLTERILYYTGRIHEIHEVRGRDGVGAKMDSMDLEREKGITIQSAATYCTWKDYQVNIIDTPGHVDFTIEVERALRVLDGAILVLCSVGGVQSQSITVDRQMRRYDVPRVAFINKLDRMGADPWKVLSQARSKLRHHSAAVQVPIGLEDDFQGLVDLVQLKAYYFHGSNGEKVVAEEIPANMEALVAEKRRELIEMVSEVDDKLAEAFLTDEPISSASLEEAIRRATVAQKFIPVFMGSAFKNKGVQPLLDGVLSYLPCPTEVSNYALDQNKNEEKVTISGTPVGPLVALAFKLEEGRFGQLTYLRIYEGVIRKGDFIINVNTGKKIKVPRLVRMHSNEMEDIQEAHAGQIVAVFGVDCASGDTFTDGSVRYTMTSMNVPEPVMSLAISPVSKDSGGQFSKALNRFQREDPTFRVGLDAESGQTIISGMGELHLDIYVERIRREYKVDATVGRPRVNFRETVTKRAEFDYLHKKQTGGQGQYGRVCGYVEPLPEGSTTKFEFENMIVGQAVPSNFIPAIEKGFKEAANSGSLIGHPVENIRIVLTDGAAHAVDSSELAFKLAAIYAFRQCYTAAKPVILEPVMLVELKAPTEFQGTVTGDINKRKGVIVGNDQDGDDSVITAHVPLNNMFGYSTSLRSMTQGKGEFTMEYKEHSPVSQDVQLQLVNTYKANKAAENS

SEQ ID NO: 2467 - protein, 768 aa, Fagus grandifolia
MARFPRPSTPRLLYTLYSSPTKTTPSHSHSHSHSQSSITTFLLNNNLHILRHFSSGNLARATTSKDDKDPWWKESMNRLRNIGISAHIDSGKTTLTERVLFYTGRIHEIHEVRGRDGVGAKMDSMDLEREKGITIQSAATYCTWKDFQVNIIDTPGHVDFTIEVERALRVLDGAILVLCSVGGVQSQSITVDRQMRRYEVPRLAFINKLDRMGADPWKVLNQARSKLRHHSAAMQVPIGLEEDFKGLIDLVQLKAYYFRGSSGENVVAEDIPADMEALVAEKRRELIEAVSEVDDKLAEPFLNDEPITSTDLEEAIRRATVARKFVPVFMGSAFKNKGVQPLLDAVLSYLPCPTEVSNFALDQTKNEEKVTLSGTPDGPLVALAFKLEEGRFGQLTYLRIYEGVIRKGDFIHNINTGKKIKIPRLVRMHSNEMEDIPEAHAGQIVAVFGVDCASGDTFTDGSVKYTMTSMNVPEPVMSLAVQPVSKDSGGQFSKALNRFQREDPTFRVGLDAESGQTIISGMGELHLDIYVERIRREYKVDATVGKPHVNFRETVTQRAEFDYLHKKQSGGQGQYGRVCGYIEPLPPGSSTKFEFDNMIVGQAIPSNFIPAIEKGFKEAANSGSLIGHPVENLRVVLTDGASHSVDSSELAFKLASIYAFRQCYTVARPVILEPVMMVELKVPTEFQGTVAGDINKRKGIIVGNDQDGDDSVITAHVPLNNMFGYSTALRSMTQGKGEFTMEYKEHSAVSNDVQMQLVNTYKGTKATD

SEQ ID NO: 2468 - protein, 728 aa, Gossypium hirsutum
PSPTAALLLGNFEVRQFSAGNVARAKDAKEPWWKESMERLRNIGISAHIDSGKTTLTERILYYTGRIHEIHEVRGKDGVGAKMDSMDLEREKGITIQSAATYCTWKDYQINIIDTPGHVDFTIEVERALRVLDGAILVLCSVGGVQSQSITVDRQMRRYEVPRLAFINKLDRMGADPWKVLNQARSKLRHHSAAVQVPIGLEENFQGLIDLVQLKAYYFHGSSGEKVVAEEIPADMDAIVAEKRRELIEMVSEVDDKLAEAFLNDEPISSVDLEEAVRRATIARKFVPVFMGSAFKNKGVQPLLDGVLSCLPCPIEVSNYALDQTKNEVKVMLPGTPDGPLVALAFKLEEGRFGQLTYLRVYEGVIRKGDFIVNINTGKKIKVPRLVRMHSDEMEDIQEAHAGQIVAVFGVDCASGDTFTNGSVKYTMTSMSVPEPVMSLAVQPVSKDSGGQFSKALNRFQREDPTFHVGLDAESGQTIISGMGELHLDIYVERIRREYKVDAIVGKPRVNFRETITQHAEFDYLHKKQSGGQGQYGRVCGYVEPLPPGSPIKFEFENMIVGQAVPSNFIPAIEKGFKEAANSGSLIGHPVENIRIVLTDGASHAVDSSELAFKLAAIYAFRQCYSAARPVILEPIMLVELKVPTEFQGTVAGDINKRKGVIVGNDQDGDDSIITVNVPLNNMFGYSTMLRSMTQGKGEFTMEYKEHSPVSQDVQMQLVSTHKADKAE

SEQ ID NO: 2469 - protein, 758 aa, Malus domestica
MTRFPPPSTPRLLYTLYRSRTAPSPPSPSPSAASSLLIGSFHFRQFSSGNLARAKEDKEPWWKDSMDKLRNIGISAHIDSGKTTLTERVLFYTGKIHEIHEVRGRDGVGAKMDSMDLEREKGITIQSAATYCTWNGYQINIIDTPGHVDFTIEVERALRVLDGAILVLCSVGGVQSQSITVDRQMKRYEVPRIAFINKLDRMGADPWKVLNQARAKLRHHSAAMQVPIGLEEDFKGLIDLVQMKAYYFHGPNGENIVTEEVPADMEEFVTEKRRELIEVVSEVDDKLAEAFLDDEPISPTDLEEAVRRATVARKFIPVFMGSAFKNKGVQPLLNAVLNYLPCPTEVSNYALDQTKDEEKVTLGGTPDGPLVALAFKLEEGRFGQLTYLRIYEGVIRKGDFIFNINTGKRIKVPRLVRMHSNEMEDIQEAHAGQIVAVFGVDCASGDTFTDGLVKYTMTSMSVPEPVMSLAVQPVSKDSGGQFSKALNRFQKEDPTFRVGLDPESGQTIISGMGELHLDIYVERIRREYKVDATVGKPRVNFRETVTQRAEFDYLHKKQSGGQGQYGRVCGYIEPLPADSQTKFEFENIIVGQAIPSNFIPAIEKGFKEAANSGSLIGHPVEHVRIVLTDGASHAVDSSELAFKLAAIYAFRKCYTAARPVILEPVMLVELKVPIEFQGTVAGDLNKRKGIIIGNDQEGDDSVITAQVPLNNMFGYSTSLRSMTQGKGEFTMEYKEHSPVSNDVQAQLVKNYKGTTAAE

SEQ ID NO: 2470 - protein, 761 aa, Unknown
  Sequence found in Organisms: Citrus clementina, Citrus sinensis
MARFPRSPAPRLLYTLFSSSRTTPTKSSPQSPSAALLQGNFHLQSRQFSAGGNLARAKDDKEPWWKESMERLRNIGISAHIDSGKTTLTERILFYTGRIHEIHEVRGRDGVGAKMDSMDLEREKGITIQSAATSCAWKDYQINIIDTPGHVDFTVEVERALRVLDGAILVLCSVGGVQSQSITVDRQMRRYEVPRLAFINKLDRMGADPWKVLDQARSKLRHHCAAVQVPMGLEDQFQGLVDLVQLTAYYFHGSNGEKIVTGEVPADMETFVAEKRRELIELVSEVDDKLGDMFLSDEPISSGDLEEAIRRATVARKFIPVFMGSAFKNKGVQPLLDGVLSYLPCPTEVSNYALDQKNNEEKVILSGNPDGPLVALAFKLEEGRFGQLTYLRIYEGVIRKGDFIINVNTGKKIKVPRLVRMHSNEMEDIQEAHAGQIVAVFGVDCASGDTFTDGSVKYTMTSMHVPEPVMSLAVQPVSKDSGGQFSKALNRFQKEDPTFRVGLDAESGQTIISGMGELHLDIYVERIRREYKVDATVGKPRVNFREAVTKRAEFDYLHKKQSGGQGQYGRVIGYIEPLPLGSPAKFEFENLLVGQAIPSNFIPAIEKGFKEAANSGSLIGHPVEYLRVVLTDGASHAVDSSELAFKMAAIYAFRQCYAAAKPVILEPVMLVELKVPTEFQGSVAGDINKRKGMIVGNDQEGDDSVITAHVPLNNMFGYSTALRSMTQGKGEFTMEYKEHAPVSQDVQLQLVKTHNAGRGAE

SEQ ID NO: 2471 - protein, 753 aa, Cucumis sativus
MAGFRRTSTPRLLYSFYSSTLTHSSSPSPSSALLLGNFHLRHSSSAARVKEDKEPWWKESMEKVRNIGISAHIDSGKTTLTERVLYYTGRIHEIHEVRGKDGVGAKMDSMDLEREKGITIQSAATYCTWNGYQINIIDTPGHVDFTIEVERALRVLDGAILVLCSVGGVQSQSITVDRQMRRYEVPRLAFINKLDRMGADPWKVLNQARSKLRHHSAAVQVPIGLEEQFKGLVDLVQLKAYYFLGSNGEKVTAEEVPADMEALVTEKRRELIEMVSEVDDKLAEAFLSDEPISPEDLEAAVRRATVARKFIPVFMGSAFKNKGVQPLLDGVLNYLPCPVEVSNYALDQTKNEEKIALSGSPDGRLVALAFKLEEGRFGQLTYLRIYEGVIKKGEFIVNVNTGKRIKVPRLVRMHSNEMEDIQEGHAGQIVAVFGVDCASGDTFTDGSIKYTMTSMNVPEPVMSLAVQPVSKDSGGQFSKALNRFQKEDPTFRVGLDPESGQTIISGMGELHLDIYVERIRREYKVDATVGKPRVNFRETVTQRAEFDYLHKKQTGGQGQYGRVCGYIEPLPPGSTAKFEFENIIVGQAIPSNFIPAIEKGFREAANSGSLIGHPVENVRVTLTDGASHAVDSSELAFKLAAIYAFRKCYTAARPVILEPVMLVEVKVPTEFQGTVGGDINKRKGIIVGNDQDGDDSIITAHVPLNNMFGYSTSLRSMTQGKGEFTMEYKEHSPVSNDVQMQLVSNYKGSKPAE

SEQ ID NO: 2472 - protein, 310 aa, Amsonia hubrichtii
MAWRSRSSATRLLYSLCSRTKATPECTQKGSSAALLAGNFHLRYFSASSAAARLREEKEVAWKESMSKLRNIGISAHIDSGKTTLTERVLYYTGRIHEIHEVRGKDGVGAKMDSMDLEREKGITIQSAATYCTWRDYQVNIIDTPGHVDFTIEVERALRVLDGAILVLCSVGGVQSQSITVDRQMRRYEVPRLAFINKLDRMGADPWKVLDQARTKLRHHSAAVQVPIGLEDEFQGLVDLVQLKAYYFHGSSGENVVIEEVPADMEDLVTQKRKSSLKQFLRSMNNLLNHTSMTSRYHRLILRRRSGELL

SEQ ID NO: 2473 - protein, 755 aa, Populus trichocarpa
MTRFQNGSRLLSYTFSRSKTKSSVSPTTALLQGNFQIQHSRHFSNLASATTKEEKEPWWKDSMDRLRNIGISAHIDSGKTTLTERILFYTGRIHEIHEVRGRDGVGAKMDSMDLEREKGITIQSAATYCTWNGYQVNIIDTPGHVDFTIEVERALRVLDGAILVLCSVGGVQSQSITVDRQMRRYEVPRLAFINKLDRMGADPWKVLNQARSKLRHHSAAVQVPIGLEEDFQGLIDLVKMKAYYFHGSNGEKIVTAEIPVEIEALAAEKRRELIETVSEVDDKLADAFLADESISTSDLEEAIRRATVAKKFVPVFMGSAFKNKGVQPLLDGVLSYLPCPLEVSNYALDQTKDEEKVVLSGTPDGPLVALAFKLEEGRFGQLTYLRIYEGVIRKGDFIVNVNTGKKIKVPRLVRMHSNEMEDIQEAHVGQIVAVFGVDCASGDTFTDGSVRYTMTSMNVPEPVMSLAIQPVSKDSGGQFSKALNRFQKEDPTFRVGLDPESAQTIISGMGELHLDIYVERIRREYKVDASVGKPRVNFRETITQRAEFDYLHKKQSGGQGQYGRVCGYIEPIPQGSMTKFEFDNMIVGQVIPSNFIPAIEKGFKEAANSGSLIGHPVENLRIALTDGVAHAVDSSELAFKLAAIYAFRQCYVAAKPVILEPVMLVELKVPTEFQGTVAGDINKRKGVIVGNDQDGDDSIITAHVPLNNMFGYSTALRSMTQGKGEFTMEYKEHSAVSQDVQMQLVNTYKASKTAE

SEQ ID NO: 2474 - protein, 763 aa, Aquilegia formosa
MARRATRSSATRLLYASLCSENTITLTSSSSSSSSPFALLIFENGQRRRNFSASNLARAKSDKEAWWKDAMEKLRNIGISAHIDSGKTTLTERVLFYTGRIHEIHEVRGRDGVGAKMDSMDLEREKGITIQSAATYCTWKDYQVNIIDTPGHVDFTIEVERALRVLDGAILVLCSVGGVQSQSITVDRQMRRYGVPRLAFINKLDRMGADPWKVLNQARAKLRHHSAAVQIPIGLEEHFQGLIDLVHLKAYYFHGSSGETIVTSDIPADMEPMATEKRRELIETVSEVDDQLAEAFLGDEPISPSDLDMAIRRATIAQKFVPVFMGSAFKNKGVQPLLDGVISYLPCPTEVSNHALDQTKDEEKVVLSGTPAGPLVALAFKLEEGRFGQLTFLRIYEGIIRKGDFIINVNTGKKLKVPRLVRMHSNDMEDIQEAHAGQIVAVFGVDCASGDTFTDGSVKYTMTSMNVPEPVMSLAVSPVSKDAGGQFSKALNRFQREDPTFRVGLDPESGQTIISGMGELHLDIYVERIRREYKVDATVGKPRVNFRETVTKRAEFDYLHKKQSGGQGQYGRVCGYIEPLPPGSPIKFEFDNMIIGQAIPSNFIPAIEKGFKEASNSGQLIGHPVENVRIVLTDGASHAVDSSELAFKLAAIYAFRQCYLTAKPVILEPVMLVELKVPTEFQGTVTGDINKRKGVIVGNDQDGDDSVITTHVPLNNMFGYSTALRSMTQGKGEFTMEYKEHSAVSQDVQTQLVNTYQATKGAE

SEQ ID NO: 2475 - protein, 764 aa, Eucalyptus grandis
MARLSKSSASRLLYTLCASPPLSSPSAAHHLQSPLASLLLCGSRLRHFSTGNLARAAAAAAKDDKEPWWKENLDKLRNIGISAHIDSGKTTLTERILFYTGKIHEIHEVRGRDGIGATMDSMDLEREKGITIQSAATYCTWKGYQVNIIDTPGHVDFTIEVERALRVLDGAILVLCSVGGVQSQSITVDRQMRRYEVPRVAFINKLDRMGADPWKVLNQARSKLRHHSAAVQVPIGLEEEFQGLVDLVQLKAYYFHGSNGENVVTAEVPANMENLVTEKRRELIEMVSEVDDKLAEAFISDEPISSADLEEAIRRATIAKKFVPVFMGSAFKNKGVQPLLDGVLSYLPCPIEVSNYALDQNKQEEKVALTGTPDGPLVALAFKLEEGRFGQLTYLRIYEGVIRKGDFVINVNTGKKLKVPRLGRMHSNEMEDIPEAHAGQIVAVFGMDCASGDTFTDGKVKYTMTSMNVPDPVMSLAVSPVSKDSGGQFSKALNRFQREDPTFRVGLDAESGQTIISGMGELHLEVYVERIRREYKVEATVGKPRVNFRETVTQRAEFDYLHKKQTGGQGQYGRVCGYVEPLPEGSPVKFEFENMIVGQAIPSNFIPAIEKGFKEAANSGSLIGHPVENIRIVLTDGASHNVDSSELAFKLAAIYAFRQCYSASKPVILEPIMLVELKVPTEFQGTVAGDINKRKGIIVGNDQDGDETVIVAQVPLNNMFGYSTSLRSMTQGKGEFTMEYKEHSAVSQDVQMQLVNAHKASKAE

SEQ ID NO: 2476 - protein, 756 aa, Citrullus lanatus
MAGFRRTSTPRLLYSFYSSTLSHSNLSSSPSPATALLLGNFHLRHSSSAARVKEDKEPWWKESMEKLRNIGISAHIDSGKTTLTERVLYYTGRIHEIHEVRGKDGVGAKMDSMDLEREKGITIQSAATYCTWNGYQINIIDTPGHVDFTIEVERALRVLDGAILVLCSVGGVQSQSITVDRQMRRYEVPRLAFINKLDRMGADPWKVLNQARSKLRHHSAAVQVPIGLEEEFKGLVDLVQLKAYYFHGSNGEKFTTEEVPADMEALVTEKRRELIEMVSEVDDKLAEAFLSDEPISPADLEAAVRRATVARKFIPVFMGSAFKNKGVQPLLNGVLSYLPCPIEVSNYALDQTKNEEKITLSGTPDGRLVALAFKLEEGRFGQLTYLRIYEGVIKKGEFIVNVNTGKKIKVPRLVRMHSDEMEDIQEAHAGQIVAVFGVDCASGDTFTDGSVKYTMTSMNVPEPVMSLAVQPVSKDSGGQFSKALNRFQKEDPTFRVGLDPESGQTIISGMGELHLDIYVERIRREYKVDATVGKPRVNFRETVTQRAEFDYLHKKQTGGQGQYGRVCGYIEPLPHGSSTKFEFENIIVGQAIPANFIPAIEKGFREAANSGSLIGHPVENLRVILTDGASHAVDSSELAFKLAAIYAFRQCYAAARPVILEPVMLVEVKVPTEFQGTVGGDINKRKGVIVGNDQDGDDSIITAHVPLNNMFGYSTSLRSMTQGKGEFTMEYKEHLPVSNDVQMQLISNYKGSNPAE

SEQ ID NO: 2477 - protein, 763 aa, Prunus persica
MARFSRPSTPRLLYTLYTSPSKTVQSPSPSPSPSPSPASSLLLGSFHFRQFSSGNLARAKEDKEPWWKDSMDKLRNIGISAHIDSGKTTLTERVLFYTGKIHEIHEVRGRDGVGAKMDSMDLEREKGITIQSAATYCTWNGYQVNIIDTPGHVDFTIEVERALRVLDGAILVLCSVGGVQSQSITVDRQMRRYEVPRLAFINKLDRMGADPWKVLNQARAKLRHHSAAMQVPIGLEEDFKGLVDLVQMKALYFHGSSGEKIVIEEVPADMEALVTEKRRELIEVVSEVDDKLAEAFLADEPISSTDLEEAVRRATIAQKFIPVFMGSAFKNKGVQPLLNAVLSYLPCPIEVSNYALDQTKNEEKVALGGTPDGPLVALAFKLEEGRFGQLTYLRIYEGVIRKGDFIFNINTGKKIKVPRLVRMHSDEMEDIQEAHAGQIVAVFGVDCASGDTFTDGSVKYTMTSMNVPEPVMSLAVQPVSKDSGGQFSKALNRFQKEDPTFRVGLDPESGQTIISGMGELHLDIYVERIRREYKVDATVGKPRVNFRETVTQRAEFDYLHKKQSGGQGQYGRVCGYVEPLPAGSPTKFEFENMIVGQAIPSNFIPAIEKGFKEAANSGSLIGHPVEHVHVVLTDGAAHAVDSSELAFKLAAIYAFRKCYAAAKPVILEPVMLVELKVPMEFQGTVAGDINKRKGVIIGNDQEGDDSVITAHVPLNNMFGYSTALRSMTQGKGEFTMEYKEHSPVSHDVQTQLINNYKGTHAAE

SEQ ID NO: 2478 - protein, 752 aa, Euphorbia peplus
MFRSRGYSTSRLLFSAAANSPSPPSNSPAASLLLGNFHLRHFSNAARVKEDKEPWWKESMERVRNIGISAHIDSGKTTLTERILYYTGRIHEIHEVRGRDGVGAKMDSMDLEREKGITIQSAATYCTWKDYQVNIIDTPGHVDFTIEVERALRVLDGAILVLCSVGGVQSQSITVDRQMRRYEVPRVAFINKLDRMGADPWKVLNQARSKLRHHSAAVQVPIGLEEDFKGLIDLVKMKAYYFHGSSGENIVTEEIPADMEAIVAEKRHELIEAISEVDDQLADAFLADEPISSTDLEDAIRRATVAQKFIPVFMGSAFKNKGVQPLLDGVLSYLPCPIEVSNYALNQSKDEEKVLLTGSPDGRLVALAFKLEEGRYGQLTYLRIYEGVIRKGDFIVNINTGKKLKIPRLVRMHSNDMEDIQEAHAGQIVAVFGVECASGDTFTDGSIRYTMTSMNVPEPVMSLAVQPVSKDAGGQFSKALSRFQREDPTFRVGLDPESGQTIISGMGELHLDIYVERIRREYKVDATVGKPRVNFRETVTRRAEFDYLHKKQSGGQGQYGRVIGFIEPLPEGSTTKFEFDNMIVGQAIPSGFIPAIEKGFREAANSGSLIGHPVENVRIALIDGAAHTVDSSELAFKLASIYAFRQCYSAAKPTILEPIMLVELKVPTEFQGTVAGDLNKRKGVIVGNDQEGDDSVITAHVPLNNMFGYSTSLRSMTQGKGEFTMEYKEHSAVSQDVQAQLVNAYTASKGTE

SEQ ID NO: 2479 - protein, 758 aa, Manihot esculenta
MAPFHRGSATSRLLFSFYSATAKATATAPSSHSPTTALLLGHFRVHQYSNLARAKEEKEPWWKESMERLRNIGISAHIDSGKTTLTERILYYTGRIHEIHEVRGRDGVGAKMDSMDLEREKGITIQSAATYCTWNGYQINIIDTPGHVDFTIEVERALRVLDGAILVLCSVGGVQSQSITVDRQMRRYEVPRLAFINKLDRMGADPWKVLNQARSKLRHHSAAVQVPIGLEDDFQGLIDLVKLKTYYFQGSNGEKVVAEEVPANMEAIVAEKRRELIEVVSEVDDKLADAFLSDEPISSADLAEAIRRATVAKKFIPVFMGSAFKNKGVQPLLDGVLSYLPCPTEVGNYALDQSKNEEKVLLGGNPDGKLVALAFKLEEGRFGQLTFLRIYEGVIRKGDFIVNINTGKKIKVPRLVRMHSDEMEDIQEAHAGQIVAVFGVDCASGDTFTDGSIRYTMTSMNVPEPVMSLAVQPVSKDSGGQFSKALNRFQKEDPTFRVGLDPESGQTIISGMGELHLDIYVERIRREYKVDATVGKPRVNFRETVTQRAEFDYLHKKQTGGQGQYGRVIGFIEPLPADSPTKFLFENMMVGQAIPSGFIPAIEKGFKEAANSGSLIGHPVENVRIVLTDGASHAVDSSELAFKLASIYAFRQCYAAARPVILEPIMLVELKVPTEFQGTVAGDINKRKGVIVGNDQDGDDSVITAHVPLNNMFGYSTSLRSMTQGKGEFTMEYKEHSPVSQDVQMQLVNTYKANKAAE

SEQ ID NO: 2480 - protein, 755 aa, Fragaria vesca
MPRFPRFATTRLLYSLHASKTTPSPSPSSSSLLLGSFHLRQFSAGNSLARAKDDKDVWWTEVMAKLRNIGISAHIDSGKTTLTERILYYTGKIHEIHEVRGRDGVGAKMDSMDLEREKGITIQSAATYCTWNGYQINIIDTPGHVDFTIEVERALRVLDGAILVLCSVGGVQSQSITVDRQMKRYEVPRIAFINKLDRMGADPWKVLNQMRSKLRHHAAALQLPIGLEDDFKGLIDLVQLKALYFHGSSGQEIVIEDIPSDMEVLVAEKRRELIEIVSEVDDQLAEAFLEDVPITSTDLEEAIRRATIARKFIPVFMGSAFKNKGVQPLLNGVLGYLPCPTEVSNYALDQTKDEEKVILGGTPDGPLVALAFKLEEGRFGQLTFLRIYEGVIRKGDFIFNINTGKKLKVPRLVRMHSDEMEDIQEAHAGQIVAVFGVDCASGDTFTDGSVKYTMTSMNVPEPVMSLAVQPVSKDSGGQFSKALNRFQKEDPTFRVGLDRESGQTIISGMGELHLEVYVERIRREYKVDATVGKPRVNFRETVTQRADFDYLHKKQSGGQGQYGRVTGFIEPLPAGSITKFEFENSIVGQAIPSNFIPAIEKGFKEAANSGSLIGHPVENVRIVLTDGASHAVDSSELAFKLAAIYAFRKCYTVAKPVILEPVMLVELKVPTEFQGTVAGDINKRKGVIIGNDQEGDDSVITAQVPLNNMFGYSTSLRSMTQGKGEFTMEYKEHSPVSHDVQAQLVNNYKGPNATE

SEQ ID NO: 2481 - protein, 760 aa, Solanum lycopersicum
MARSARSSTTRLFYSLCSSTKRTPLTPQHPPPTPVAALLAGNFQLRHYAASSATARVREEKDAVWRESLEKVRNIGISAHIDSGKTTLTERVLFYTGRIHEIHEVRGKDGVGAKMDSMDLEREKGITIQSAATYCTWKDYQVNIIDTPGHVDFTIEVERALRVLDGAILVLCSVGGVQSQSITVDRQMRRYEVPRLAFINKLDRMGADPWKVLNQARAKLRHHSAAVQVPIGLEDDFKGLIDLVQSKAYYFHGSNGEKIVAEDIPADMEAIASEKRRELIEAVSEVDDKLAESFLNDEPISSADLEAAIRRATIARKFVPFFMGSAFKNKGVQTLLDGVLSYLPCPVEVSNYALDQTKDEEKVTLTGNPSGPLVALAFKLEEGRFGQLTYLRIYEGVIRKGDFIINVNTGKKIKIPRLVRMHSNEMEDIQEAHAGQIVAVFGVDCASGDTFTDGSVKYTMTSMNVPEPVMSLAVSPVSKDSGGQFSKALNRFQKEDPTFRVGLDAESGETIISGMGELHLDIYVERIRREYKVEAQVGKPRVNFRETITKRADFDYLHKKQSGGQGQYGRVIGYVEPLEPGSGSKFEFENMLVGQTIPSNYVPAIEKGFREAANSGSLIGHPVENIRVVLTDGASHNVDSSELAFKLASIYAFRQCYTAAKPIILEPVMLVDIKVPTEFQGTVTGDINKRKGVIIGNDQEGDDSVITANVPLNMMFGYSTSLRSMTQGKGEFTMEYREHAPVSGDTQTQLVNAYKASKEN

SEQ ID NO: 2482 - protein, 373 aa, Papaver somniferum
MTRSAKSSATRLLYALCSEKTLISSLSSSSSSPFAFLVLENGGQSRKFSSSSAVAKSKDEKEAWWKETMEKLRNIGISAHIDSGKTTLTERVLYYTGKIHEIHEVRGRDGVGAKMDSMDLEREKGITIQSAATYCTWKDYQVNIIDTPGHVDFTIEVERALRVLDGAILVLCSVGGVQSQSITVDRQMRRYEVPRVAFINKLDRMGADPWKVLNQARAKLRHHSAAVQVPIGLEDDFQGLIDLVQLKTYSFQGSSGEKVTITDVPADMEVLVAEKRRELIETVSEVDDQLAEAFLNDEPISAEELDAAIRRATLANKFVPVFMGSAFKNKGVQPLLDGVLNYLPCPVEVGNYALDQTKMKKRFCYLELQLDLL

SEQ ID NO: 2483 - protein, 751 aa, Musa acuminata
MARSSATRLLSSLRRSESNRFCPLTVLVLNGAALGSGWRGMSTAARANEEKEPWWKEAMDRVRNIGISAHIDSGKTTLTERVLFYTGRIHEIHEVRGRDGVGAKMDSMDLEREKGITIQSAATYCTWNGYQINIIDTPGHVDFTIEVERALRVLDGAILVLCSVGGVQSQSITVDRQMRRYEVPRLAFINKLDRMGADPWKVLNQARSKLRHHSAAVQVPIGLEEEFQGLVDLVEMKAYYFHGANGEKVTAADIPQNLEALVTEKRRELIEVVSEVDDQLAEAFLNDEPISPVDLRMAIRRATVARKFVPVYMGSAFKNKGVQPLLDGVLNYLPCPTEVENYALDQNKSEEKILLPGTPSGPLVALAFKLEEGRFGQLTYLRIYEGVIRKGDFIINVNTGKKIKVPRLVRMHSDEMEDIQEAHAGQIVAVFGVDCASGDTFTDGSVRYTMTSMSVPEPVMSLAVSPVSKDSGGQFSKALNRFQKEDPTFRVGLDVESGQTIISGMGELHLDIYVERIRREYKVDAKVGKPRVNFRETITQRAEFDYLHKKQSGGQGQYGRVCGYIEPLPLGSSTKFEFDNHIIGQAIPSNFIPAIEKGFTEASNSGSLIGHPVENVRIVLTDGASHAVDSSELAFKLAAIYAFRKCYSAANPVILEPVMKVELKVPTEFQGTVTGDINKRKGIIVGNDQDGDDTVVVAHVPLNNMFGYSTALRSMTQGKGEFTMEYMEHSPVSQDVQKQLINAHGANKASE

SEQ ID NO: 2484 - protein, 761 aa, Vinca minor
MAWRSRSSTTRLLYRFCSSTTKTTPECTQKSPITAALFAGNFHLRSYSSGGAAASRLREEKEVSWKESMGKLRNIGISAHIDSGKTTLTERVLYYTGRIHEIHEVRGKDGVGAKMDSMDLEREKGITIQSAATYCTWRDYQVNIIDTPGHVDFTIEVERALRVLDGAILVLCSVGGVQSQSITVDRQMRRYEVPRLAFINKLDRMGADPWKVLDQARTKLRHHSAAVQVPIGLEDEFQGLVDLVQLKAYYFHGASGDEVVTEEVPANMSDLVTQKRKELIEAISEVDEELAEAYINDEPISSANLEEAIRRATIAQKFIPVFMGSAFKNKGVQPLLDGVLSYLPCPTEVCNYALDQTKNEEKIMLSGNPSGPLVALAFKLEEGRFGQLTYLRIYEGVIRKGDYMVNINTGKKIKVPRLVRMHSDELEDIQEAHAGQIVAVFGVDCASGDTFTDGSVRYTMTSMNVPEPVMSLAVSPVSKDTGGQFSKALNRFQKEDPTFRVGLDPESSQTIISGMGELHLEVYVERIRREYKVDATVGKPRVNFRETITQRAQFDYLHKKQSGGQGQYGRVIGYVEPLPAGSSMKFEFDNMIVGQNIPSGFIPAIEKGFKEAANSGSLIGHPVENIRIVLTDGASHAVDSSELAFKLAAIYAFRQCYTAAKPVILEPIMLVELKVPTEFQGTVTGDINKRKGMIVGNDQDGDDSVITANVPLNNMFGYSTALRSMTQGKGEFTMEYVEHSPVSQDVQAQLINAYKGTKGTA

SEQ ID NO: 2485 - protein, 645 aa, Valeriana officinalis
MDSMDLEREKGITIQSAATYCTWNDYQVNIIDTPGHVDFTIEVERALRVLDGAILVLCSVGGVQSQSITVDRQMRRYEVPRLAFINKLDRMGADPWKVLNQARAKLRHNSAAVQVPIGLEEDFEGLVDLVKSKAYYFHGSSGEKIVTEEIPADMEELVAEKRRELIEVVSEVDDQLAEIFLADEPISPIQLEEAIRRATIAQKFIPVFMGSAFKNKGVQPLLDGVISYLPCPVEVSNQALDQKRDEEKVILSGTPAGPLVALAFKLEEGRFGQLTYLRIYEGVIKKGDFIINVNTGKKVKIPRLVRMHSNEMEDIPQAHAGQIVAVFGVDCASGDTFTDGSVKYTMTSMNVPEPVMSLALSPVSKDSGGQFSKALSRFQREDPTFRVGLDVESGQTIISGMGELHLEVYVERIRREYKVDATVGKPRVNFRETITKRAEFDYIHKKQSGGQGQYGRVIGYVEPLPAGSPTKFEFENEICGQAIPFNFIPAIEKGFKEAANSGSLIGFPVENFRVVLSDGAAHAVDSSELAFKLASIYAFRQCYTAAKPVVLEPVMLVELKAPSEFQGTVSGDINKRKGIIVGTDQEGDDCVITAQVPLNNMFGYSTSLRSMTQGKGEFTMEYKEHLPVSNDVQTQLVNTFKATKG

SEQ ID NO: 2486 - protein, 760 aa, Unknown
  Sequence found in Organisms: Solanum tuberosum, Solanum phureja
MARSARSSTTRLFYTLCSSTKRTPLTPQHPPPTPVAALLAGNFQLRHYAAGSATARVREEKDAVWRESLEKVRNIGISAHIDSGKTTLTERVLFYTGRIHEIHEVRGKDGVGAKMDSMDLEREKGITIQSAATYCTWKDYQVNIIDTPGHVDFTIEVERALRVLDGAILVLCSVGGVQSQSITVDRQMRRYDVPRLAFINKLDRMGADPWKVLNQARSKLRHHSAAVQVPIGLEDDFKGLIDLVQSKAYYFHGSNGEKIVTEDIPADMEAITSEKRRELIEAVSEVDDKLAESFLNDEPISSADLEAAIRRATIARKFVPFFMGSAFKNKGVQTLLDGVLSYLPCPVEVSNYALDQTKDEEKVTLTGNPSGPLVALAFKLEEGRFGQLTYLRIYEGVIRKGDFIINVNTGKKIKIPRLVRMHSNEMEDIQEAHAGQIVAVFGVDCASGDTFTDGSVKYTMTSMNVPEPVMSLAVSPVSKDSGGQFSKALNRFQKEDPTFRVGLDAESGETIISGMGELHLDIYVERIRREYKVEAQVGKPRVNFRETITKRADFDYLHKKQSGGQGQYGRVIGYVEPLEPGSGSKFEFENMLVGQTVPSNYVPAIEKGFREAANSGSLIGHPVENIRVVLTDGASHNVDSSELAFKLASIYAFRQCYTAAKPIILEPVMLVDIKVPTEFQGTVTGDINKRKGVIIGNDQEGDDSVITANVPLNMMFGYSTSLRSMTQGKGEFTMEYREHAPVSGDTQTQLVNTYKASKES

SEQ ID NO: 2487 - protein, 751 aa, Medicago truncatula
MTRFSKSSAQRLLYALTSTTTGAPSLLAATSHLRHFSSGNLARAKAATTDKEPWWKESMEMIRNIGISAHIDSGKTTLTERVLFYTGRIHEIHEVRGKDGVGAKMDSMDLEREKGITIKSAATCCNWKDYTINIIDTPGHVDFTIEVERALRVLDGAILVFCSVGGVQSQSITVDRQMKRYEVPRLAFINKLDRMGADPWKVLNQARSKLRHHSAAIQIPIGLEENFKGLVDLVKLKAYYFDGSNGEKLTIEEVPSDMEALVAEKRHELIETVSEVDDILAEAFLSDEPVSDVDLEGAIRRATVARKFIPVFMGSAFKNKGIQPLLDGVLSYLPCPIEVNNYALDQSNKEEKVELPGNPDGPLVALAFKLEESKFGQLTYLRIYEGVIRKGDFIINVNTGKKNKVPRLGRMHSNEMEEIDEAHAGQIVAVFGVDCASGDTFTDGSVKYTMTSMSVPEPVMSLAVQPVSKDSGGQFSKALNRFQREDPTFRVGLDPESGQTIISGMGELHLDIYVERIRREYKVDATVGKPRVNFRETVTQRADFDYLHKKQSGGQGQYGRVIGYIEPLPAGSETKFEFENMLVGQAIPSNFFAAIEKGFIEAANSGSLIGHPVENLRVVLTDGAAHAVDSSELAFKMASIYAFRQCYTASRPTILEPVMLVELKVPNEFQGAVAGDLNKRKGMIVGNDQDGDDSVIIAHVPLNNMFGYSTALRSMTQGKGEFTMEYKEHSPVSHDVQTQLVNAYKGNKAPE

SEQ ID NO: 2488 - protein, 367 aa, Populus trichocarpa
MTRFQNGSRLLSYTFFRSKKTPSTSPNAALLQGNFQIQQHRHFSNLARVTTKEEKEPRWKDSMDRLRNIGISAHIDSGKTTLTERILYYTGRIHEIHEVRGRDGVGAKMDSMDLEREKGITIQSAATYCTWNGYQVNIIDTPGHVDFTIEVERALRVLDGAILVLCSVGGVQSQSITVDRQMRRYEVPRLAFINKLDRMGADPWKVLNQARSKLRHHSAAVQVPIGLEDDLQGLIDLVKMKAYYFHGSNGEKVVTAEIPAEMEALAAEKRRELVETVSEVDDKLADAFLTDEPISSSDLEEAIRRATVAKKFVPVFMGSAFKNKMVYLVICLVPLKLVTMLLTKPRMKRRLCCLELQMDHLWHWLLN

SEQ ID NO: 2489 - protein, 752 aa, Lactuca sativa
MAGSRSSTTRLLYTLRSSIYPSSRSPTPPSPITALLHLHRHYSAAPAVRAKDDKEPWWKESMEKVRNIGISAHIDSGKTTLTERVLFYTGRIHEIHEVRGKDGVGAKMDSMELEREKGITIQSAATYCTWKDYQVNIIDTPGHVDFTIEVERALRVLDGAILVLCSVGGVQSQSITVDRQMRRYEVPRVAFINKLDRMGADPWKVLNQARKKLRHHSAAVQMPIGLEEDFQGLVDLVQLKAYFFHGSSGEKVVTEEIPADMQAMAAEKRRELIEAVSDVDDQLAEVFLNDEPISAADLEAAIRRATIARKFIPVFMGSAFKNKGVQPLLDGVLCYLPNPLEVDNFALDQSNKEEKVKLSGTPAGPMVALAFKLEERQFGQLTYLRIYEGILRKGEFITNINTGKKIKVSKLGRMHSDSMEDIQEAHAGQIVAVFGLDCASGDTFTDGSVKYTMTSMNVPEPVVSLAVSPVSKDSGKQFSKALNRFQREDPTFRVGLDPESGQTIISGMGELHLEVYVERIKREYKVDATVGKPRVNFRETITQRAEFDYLHKKQSGGQGQYGRVVGYMEPLPAGSERKFEFENMIIGQAIPSNFIPHIEKGFREAANSGSLIGFPVENIRVVMTDGASHAVDSSELAFRLASIYAFRQCYAKCKPVILEPMMLVELKVPTEFQGTVAGDLNRRKGIIVGNDQDGDDSVINALVPLNNMFGYSTALRSMTQGKGEFTMEYKEHSPVSADVQTQLINAHKPKAE

SEQ ID NO: 2490 - protein, 754 aa, Beta vulgaris
MARSARSSASRLLYTLFTSSPTHQSLSSSSPVQLHRHFRLFSAGSAARVKEDKAALLQDSLSKVRNIGISAHIDSGKTTLTERVLFYTGRIHEIHEVRGRDGVGAKMDSMDLEREKGITIQSAATYCTWKDFQVNIIDTPGHVDFTIEVERALRVLDGAVLVLCSVGGVQSQSITVDRQMRRYEVPRVAFINKLDRMGADPWKVLNQARLKLRHHSAAVQVPIGLEEDFQGLVDLVQLKAYYFHGSNGEKVVAAEVPTDMEALVAEKRHELIEAVSEVDDKLAELFLADEPISSSDLEEAIRRATVARKFVPFFMGSAFKNKGVQPLLDGVLSYLPCPTEVSNYALDQNNNEEKVLLSGAPSGPLVALAFKLEEGRFGQLTFLRIYEGIIKKGDFIHNINTGKRLKVPRLVRMHSSEMEDIQEAHAGQIVAVFGVDCATGDTFTDGTVKYTMTSMNVPEPVMSLAVSPVSKDSGGQFSKALNRFQKEDPTFRVGLDPESGQTIISGMGELHLAIYVERIRREYKVETQTGKPRVNFREAITQRAEFDYLHKKQSGGQGQYGRVTGFVEPLPLGSATKFEFENLIVGQAIPSNFIPAIEKGFKEAANSGSLIGHPVEYVRVCLTDGASHAVDSSELAFKLASIYAFRQCYTKAKPVVLEPIMLVEVKVPSEFQGSVTGDINKRKGVIIGNDQDGDDSVIIAHIPLNKMFGYSTDLRSMTQGKGEFTMEYKEHSPVPQDVQMELMNDYKATKAAEQ

SEQ ID NO: 2491 - protein, 757 aa, Phalaenopsis aphrodite
MGRTSVTRILSSLRRAASQRSDAPSPAIALFFIDDAACRGRRGYSTASMARAKEEKEAWWKETLDKVRNIGISAHIDSGKTTLTERILFYTGRIHEIHEVRGRDGVGAKMDSMDLEREKGITIQSAATYCTWKDYQVNIIDTPGHVDFTIEVERALRVLDGAILVLCSVGGVQSQSITVDRQMRRYEVPRLAFINKLDRMGADPWKVLNQARSKLRHHSAAVQVPIGLEEEFQGLVDLVEMKAYYFHGSNGENIVTSDVPSDIEALVAEKRHELIEVVSEVDDQLAESFLNDESISSDDLKMAIRRATVSRKFVPVYMGSAFKNKGVQPLLDGVVNFLPCPTEVENHALDQDQSEVKVRLSGNPAGPLVALAFKLEEGRFGQLTYLRIYEGIIKKGDFIININTGKKIKVPRLVRMHSNEMEDIQEAHAGQIVAVFGIDCASGDTFTDGSVRYTMTSMNVPEPVMSLAVSPISKDYGAQFSKALNRFQKEDPTFRVGLDPESGQTIISGMGELHLDIYVERIRREYKVDAQTGRPRVNFRETITQRAEFDYLHKKQTGGQGQYGRVCGYIEPLSADAATKFEFDNMIIGQAIPSNFIPAIEKGFKEACNSGSLIGHPVENIRIVLTDGASHAVDSSELAFKLASIYALRQCYAAAKPVILEPVMKVELKFPTEFQGTVTGDINKRKGIIVGNDQEGDDTVIVTHVPLNNMFGYSTSLRSMTQGKGEFTMEYLEHSAVSQDVQTQLINTYKASKGTTD

SEQ ID NO: 2492 - protein, 402 aa, Trigonella foenum-graecum
MARFSKSSAQRLLYALTTTTTTTTASASPSTSLITSSFHLRHFSSGNLARAKAATTDKEPWWKESMEMIRNIGISAHIDSGKTTLTERVLFYTGRIHEIHEVRGKDGVGAKMDSMDLEREKGITIKSAATCCTWKDYTINIIDTPGHVDFTIEVERALRVLDGAILVFCSVGGVQSQSITVDRQMKRYEVPRLAFINKLDRMGADPWKVLNQARSKLRHHSAAIQVPIGLEERFEGLVDLVKLKAYYFDGPNGEKLTIKEVPSDMEALVAEKRHELIETVSEVDDILAEAFLSDEPISDVDLEGAIRRATVARKFIPVFMGSAFKNKGIQPLLDGVLSYLPCPVEVNNYALDQSKKEEKIELPGNPDGPLVALAFKLEESKFGQLTYLRIYEGVIRKGDFYH

SEQ ID NO: 2493 - protein, 755 aa, Elaeis guineensis
MARSSATRLLSTLRRGHKNSLSPLHPLAVLILDGAPLGSRRGLATSSAARVKEEKEAWWKEAMERMRNIGISAHIDSGKTTLTERILYYTGRIHEIHEVRGRDGVGAKMDSMDLEREKGITIQSAATYCKWNDYQINIIDTPGHVDFTIEVERALRVLDGAILVLCSVGGVQSQSITVDRQMRRYEVPRLAFINKLDRMGADPWKVLNQARSKLRHHSAAVQVPIGLEEEFQGLVDLVELQAYYFHGANGEKVVTEDIPPKLEALVTEKRRELIEVVSEVDDKLAEAFLNDEPISSSDLKMAIRRATTARKFVPFFMGSAFKNKGVQPLLDGVLNYLPCPTEVENYALDQNKSEEKVLLPGTPVGPFVALAFKLEEGRFGQLTYLRIYEGVIRKGDFMINVNTGKKIKVPRLVRMHADEMEDIQEAHAGQIAAVFGVDCASGDTFTDGSVRYTMTSMNVPEPVMSLAVSPVSKDSGGQFSKALNRFQKEDPTFRVGLDVESGQTIISGMGELHLDIYVERIRREYKVDAKVGKPRVNFRETVTQRAEFDYLHKKQSGGQGQYGRVCGYIEPLPMDSPAKFEFENMVIGQAIPSNFIPAIEKGFKEASNSGSLIGHPVEYVRVVLTDGASHAVDSSELAFKLAAIYAFRQCYAAAKPVILEPVMKVELKAPTEFQGTVTGDINKRKGMIVGNDQEGDDTVVVAHVPLNNMFGYSTALRSMTQGKGEFTMEYLEHSPVSQDVQMQLVNTYKATKGTE

SEQ ID NO: 2494 - protein, 758 aa, Brachypodium distachyon
MAMARRSASHLLCSFRPFSLLLQPLTDAPTPAAAAAAASARRAMSSASALRARGDDKELARWRESMDRMRNIGISAHIDSGKTTLTERVLYYTGRIHEIHEVRGRDGVGAKMDSMDLEREKGITIQSAATYCTWNDYQVNIIDTPGHVDFTIEVERALRVLDGAILVLCSVGGVQSQSITVDRQMKRYEIPRVAFINKLDRMGADPWKVLNQARSKLRHHSAALQVPIGLEEEFEGLVDLVELKAYNFEGGSGQDVVTSDVPSNMQDLVTDKRRELIEVVSEVDDQLAEAFLNDEPISANELKAAIRRATVARKFIPVYMGSAFKNKGVQPLLNGVLDYLPCPAEVENYALDQNKSEEKVLLGGTPAGPLVALAFKLEEGRFGQLTYLRIYDGVIRKGDFIYNVNTGKKIKVPRLVRMHSNEMEDIQEAHAGQIVAVFGVDCASGDTFTDGSVKYTMTSMNVPEPVMSLAVNPISKDSGGQFSKALNRFQREDPTFRVGLDPESGQTIISGMGELHLDIYVERIRREYKVDAKVGKPRVNFRETITQRAEFDYLHKKQSGGQGQYGRVCGYIEPLPSGSDGKFEFDNMIIGQAIPSNFIPAIEKGFKEACNSGSLIGHPVENIRITLTDGASHAVDSSELAFKLAAIYAFRQCYTAAKPVILEPVMKVELKVPTEFQGTVTGDMNKRKGIIVGNDQEGDDTVVVCHVPLNNMFGYSTALRSMTQGKGEFTMEYMEHNTVSQDVQMQLVNSHKATKSPE

SEQ ID NO: 2495 - protein, 753 aa, Flaveria ramosissima
MVRSRSSTTRLLYTLRSSIYQSSRSPSPPSPITALLHLHRHYSAAPSLRAKEDKEPWWKESMERVRNIGISAHIDSGKTTLTERVLFYTGRIHEIHEVRGKDGVGAKMDSMELEREKGITIQSAATYCTWKDYQINIIDTPGHVDFTIEVERALRVLDGAILVLCSVGGVQSQSITVDRQMRRYEVPRVAFINKLDRMGADPWKVLNQARKKLRHHSAAVQIPIGLEEDFQGLVDLVQQKAYYFHGSSGEKVVNEDIPADMLTMVTEKRRELIEAVSDVDDQLAELFLSDEPISSADLEAAIRRATVARKFIPVFMGSAFKNKGVQPLLDGVLSYLPCPLEVDNFALDQSKKEEKVKLSGTPAGHMVALAFKLEERQFGQLTYLRIYEGVLRKGDFITNINTGKKIKVSKLGRMHSDSMEDIQEAHAGQIVAVFGLDCASGDTFTDGSVKYTMTSMNVPEPVVSLAVSPVSKDSGKQFSKALNRFQREDPTFRVGLDPESGQTIISGMGELHLEVYVERIKREYKVDATVGKPRVNFRETITQRAEFDYLHKKQSGGQGQYGRVCGYMEPLPAGSETKFEFENMMIGQAIPSNFIPHIEKGFREAANSGSLIGFPVENIRVVLTDGASHAVDSSELAFRLASIYAFRQCYAKCKPVILEPVMLVELKVPTEFQGTVAGDLNRRKGIIVGNDQEGDDSVINALVPLNNMFGYSTSLRSMTQGKGEFTMEYKEHSPVSADVQTQLINAHKPKNSE

SEQ ID NO: 2496 - protein, 753 aa, Flaveria ramosissima
MVRSRSSTTRLLYTLRSSIYPSSRSPSPPSPITALLHLHRHYSAAPSLRAKEDKEPWWKESMERVRNIGISAHIDSGKTTLTERVLFYTGRIHEIHEVRGKDGVGAKMDSMELEREKGITIQSAATYCTWKDYQINIIDTPGHVDFTIEVERALRVLDGAILVLCSVGGVQSQSITVDRQMRRYEVPRVAFINKLDRMGADPWKVLNQARKKLRHHSAAVQIPIGLEEDFQGLVDLVQLKAYYFHGSSGEKVVTEEIPADMLTMVTEKRRELIEAVSDVDDQLAELFLSDEPISSADLEAAIRRATVARKFIPVFMGSAFKNKGVQPLLDGVLSYLPCPLEVDNFALDQSKKEEKVKLSGTPAGHMVALAFKLEERQFGQLTYLRIYEGVLRKGDFITNINTGKKIKVSKLGRMHSDSMEDIQEAHAGQIVAVFGLDCASGDTFTDGSVKYTMTSMNVPEPVVSLAVSPVSKDSGKQFSKALNRFQREDPTFRVGLDPESGQTIISGMGELHLEVYVERIKREYKVDATVGKPRVNFRETITQRAEFDYLHKKQSGGQGQYGRVCGYMEPLPAGSETKFEFENMMIGQAIPSNFIPHIEKGFREAANSGSLIGFPVENIRVVLTDGASHAVDSSELAFRLASIYAFRQCYAKCKPVILEPVMLVELKVPTEFQGTVAGDLNRRKGIIVGNDQEGDDSVINALVPLNNMFGYSTSLRSMTQGKGEFTMEYKEHSPVSADVQTQLINAHKPKNSE

SEQ ID NO: 2497 - protein, 731 aa, Mimulus guttatus
KMAARSARSKSTRLLYSLCTAAAAARLREEKDTWWKDSLQKLRNIGISAHIDSGKTTLTERVLFYTGRIHEIHEVRGKDGVGAKMDSMDLEREKGITIQSAATYCTWKDYQVNIIDTPGHVDFTIEVERALRVLDGAILVLCSVGGVQSQSITVDRQMRRYEVPRLAFINKLDRMGADPWKVLNQARTKLRHHSAAVQMPIGLEEDFKGLIDLVNMKACYFHGSSGETIVSEDIPADLEALALEKRRELVEAVSEVDDKLAEAFLSDEPILAADLDEAIRRATISRKFVPVFMGSAFKNKGVQPLLDGVLSYLPCPTEVTNQALDQSKDEEKVELSGSPAGPLVALAFKLEEGRFGQLTYLRIYEGVIKKGDFIVNVNTGKKVKVPRLVRMHSNEMEDIQQAHAGQIVAVFGVDCASGDTFTDGSVRYTMTSMSVPEPVMSLAISAVSKDSGGNFSKALNRFQREDPTFRVGLDPESSQTIISGMGELHLDIYVERMKREYKVEATVGKPRVNFRETITQRAEFDYLHKKQSGGQGQYGRVTGFMEPLPPGSGTKFEFDNMLVGQAIPSNFVPAIEKGFKEAANSGSLIGHPVENIRIALTDGAAHTVDSSELAFKLAAIYAFRQCYELCKPVILEPVMLVELKFPSEFQGTVTGDINKRKGMIVGNDQEADDCVITAHVPLNNMFGYSTALRSMTQGKGEFTMEYLEHMQVSQDVQTQLVNAYKATRTGE

SEQ ID NO: 2498 - protein, 340 aa, Arnica chamissonis
MHSDSMEDIQEAHAGQIVAVFGLDCASGDTFTDGSVKYTMTSMNVPEPVVSLAVSPVSKDSGKQFSKALNRFQREDPTFRVGLDPESGQTIISGMGELHLEVYVERIKREYKVDATVGKPRVNFRETITQRAEFDYLHKKQSGGQGQYGRVCGYMEPLPAGSETKFEFENMMIGQAVPSNFIPHIEKGFREAVNSGSLIGFPVENIRVVLTDGASHAVDSSELAFRLASIYAFRQCYAKCKPVILEPVMLVELKVPTEFQGTVAGDLNRRKGIIVGNDQEGDDSVINALVPLNNMFGYSTSLRSMTQGKGEFTMEYKEHSPVSADVQTQLINAHKPKTAE

SEQ ID NO: 2499 - protein, 758 aa, Sorghum bicolor
MAMARRSASHLLSSFRPFSLLLQPHLADSPSPAAAAAAASARRAMSAASALRARDEKDVARWRESMARMRNIGISAHIDSGKTTLTERVLYYTGRIHEIHEVRGRDGVGAKMDSMDLEREKGITIQSAATYCTWKDYQINIIDTPGHVDFTIEVERALRVLDGAILVLCSVGGVQSQSITVDRQMRRYDIPRVAFINKLDRMGADPWKVLNQARSKLRHHNAAVQVPIGLEEEFEGLVDLVEMKAYKFEGSSGQNVTASDIPLNMEDLVTEKRRELIEVVSEVDDQLAEAFLNDEPITANQLKAAIRRATVAQKFIPVYMGSAFKNKGVQPLLDGVLDYLPCPLEVDNYALDQNKSEEKVLLAGTPAEPLVALAFKLEEGRFGQLTYLRIYDGVIRKGDFIYNVNTGKKIKVPRLVRMHSNEMEDIQEAYAGQIVAVFGVDCASGDTFTDGTVKYTMTSMNVPEPVMSLAVSPISKDSGGQFSKALNRFQKEDPTFRVGLDAESGQTIISGMGELHLDIYVERIKREYKVDAKVGKPRVNFRETITQRAEFDYLHKKQSGGQGQYGRVCGYIEPLPSGSDGKFEFDNMIIGQAIPSNFIPAIEKGFREACNSGSLIGHPVENLRIVLTDGASHQVDSSELAFKLAAIYAFRQCYTSAKPVILEPVMKVELKFPTEFQGTVTGDMNKRKGIIVGNEQEGDDTIVVCHVPLNNMFGYATAIRSVTQGKGEFTMEYLEHNVVSQDVQMQLVNSYKAAKGTE

SEQ ID NO: 2500 - protein, 757 aa, Oryza sativa
MAMARRSASRLLSSFRPFSLLLQPLDDAPSLSAAAAAASARRGMSSASALRARDEKEVARWRESMDRMRNIGISAHIDSGKTTLTERVLYYTGRIHEIHEVRGRDGVGAKMDSMDLEREKGITIQSAATYCTWNGYQVNIIDTPGHVDFTIEVERALRVLDGAILVLCSVGGVQSQSITVDRQMRRYEIPRVAFINKLDRMGADPWKVLNQARSKLRHHNAAVQVPIGLEEEFEGLVDLVELKAYKFEGGSGQNVVASDVPSNMQDLVMEKRRELIEVVSEVDDQLAEAFLNDEPIQANQLKAAIRRATVARKFIPVYMGSAFKNKGVQPLLDGVLDYLPCPMEVESYALDQNKSEEKVLLAGTPAEPLVALAFKLEEGRFGQLTYLRIYDGVIRKGDFIYNVNTGKKIKVPRLVRMHSNEMEDIQEAHAGQIVAVFGVDCASGDTFTDGSVKYTMTSMNVPEPVMSLAVSPISKDSGGQFSKALNRFQKEDPTFRVGLDPESGETIISGMGELHLDIYVERIRREYKVDAKVGKPRVNFRETITQRAEFDYLHKKQSGGQGQYGRVCGYIEPLPSESDGKFEFDNMIIGQAIPSNFIPAIEKGFKEACNSGSLIGHPVENIRIVLTDGASHAVDSSELAFKLASIYAFRQCYAAARPVILEPVMKVELKVPTEFQGTVTGDMNKRKGIIVGNDQEGDDTVVVCHVPLNNMFGYSTALRSMTQGKGEFSMEYLEHNTVSQDVQMQLVNTYKASRGTE

SEQ ID NO: 2501 - protein, 297 aa, Arabidopsis lyrata
MSEDKKPQDPNPRFACEGCSVLLDVNDGDRLVFARLSGGAILKIGNKNYSLKPLIGAPFGSLFQVETGEDGSFLSRIFPIKQENSSNNVMDDSRDNREIVDNNEAQNLTGEEIEAMRREGAKGDEIIEALIANSKTFDKKFQLSQEKYKLKKQKKYAPKLLLRRPFARSICEAYFKKYPARIGFLRVDALSLLLTMANVTAYSDVLVVDMVGGLVTGAVAERLGGTGYVCNTYKGSAPYPVEMVRMFNFSDKVLERIVQSSINELSSANTASPEGNNQQEGVCNAENNINARNVIYI

SEQ ID NO: 2502 - protein, 436 aa, Eutrema halophilum
MSENNKPQDPDPRFACEGCSVLLDVNDGDRLVFARLSGGAILKIGNKNYSLKPMIGAPFGSLFQVESGDEGSFLSRILPVKQENKSNNVIDDSRDNRELVDNNEAQNLTGEEIEAMRREGAKGDEIIEALIANSKTFEKKFQLSQEKYLLKKQKKYAPKVLLRRPFARSICEAYFKKYPERIGFLRVDALSLLLTMANVTAYSDVLVVDMVGGLVTGAVAERLGGTGYVCNTYKGNSPSSVEMVRMFNFSDKVIKRIVQSSINELSSAKTVSPEENNQQERVCNAEININEPSTSDIVEETSVTAEAMVVDIVAPESKIIKAPKAGAKASKEAIEMWQENGFSSLIMAAQDQDPWSLAKDVLPLLSCSAPFAIYHQYLQPLATCMHNLQQGKMAINLQITEPWLREYQVLPSRTHPHMQMSSFGGYVLSGIRISTT

SEQ ID NO: 2503 - protein, 429 aa, Eutrema parvulum
MSENNNKPQAPNPRFACEGCSVLLDVNDGDRLVFARLSGGAILKIGNKNYSLKPLIGAPFGSLFQVETGEEGSFLSRILPVKKESTSNSVIEDSRDNRELVDNNEAQNLTGEEIEAMRREGAKGDEIIEALIANSKTFEKKFQLSQEKYKLKKQKKYAPKLLLRRPFARSICEAYFKKYPARIGFLRVDALSLLLTMANVTAYSDVLVVDMVGGLVTGAVAERLGGTGYVCNTYKGNSPYPVEMVRMFNFSDKVIERIVQSSINELSSPKTASPEENNQQEGEPSTSDMVEEISVTAETGVVDDNVVPESRIIKAPKAGAKASKEAIEMWQENGFSSLIMAAQDQDPWTLAKDVLPLLSYSAPFAIYHQYLQPLATCMHNLQQGKMAINLQITEPWLREYQVLPSRTHPHMQMNSFGGYVLSGIRISAT

SEQ ID NO: 2504 - protein, 327 aa, Brassica napus
MSENNNNKAQDPNPRVAGEGCSVLLDVNDGDRLVFARLSGGAVLKIGNKNYSLKPLIGAPFGSIFQVETGEDGSFLSRILPIKKESSSNNVIDDARDNRELIDNNEAQNLTGEEIEAMRREGAKGDEIIEALIANSKTFDQKFQLSQEKYKLKKQKKYAPKLLLRRPFARSICEAYFKKYPARIGFIRVDALSLLLTMANVTAHSDVLVVDMVGGLITGAVAERLGGTGYVCNTYKGNSPPSVEMVRMFNFTDKVIERIVQSSIDELSAAKTVSPEENNQQGGVHPSTSDMVEDTPVTAEARVVDDAFPESKIVKAPKAGAKASKTQ

SEQ ID NO: 2505 - protein, 258 aa, Raphanus sativus
MSENKNNSNKAQDINPRFASEGCSVLLDVNDGDRLVFARLSGGAGLKIGNTRYSLKPLIGAPFGSLFQVESGSEEGSFLSRILPIKKESTSNNVTEDTRDNRELIDNNEAQNLTEEEIEAMRREGAKGDEIIEALIANSKTFDKKFQLSQDKYKLKKQKKYAPKVLLRRPFARSICEAYFKKYPARIGFLRVDALSLLLTMANVTAYSDVLVVDMVGGLVTGAVAERLGGTGYVAIHIKETILPLWIWLGCSTLLTRL

SEQ ID NO: 2506 - protein, 431 aa, Brassica rapa
MSENNNNNKAQDPNPRFASEGCSVLLDVNDGDRLVFARLSGGAVLKIGNKNYSLKPLIGAPFGSIFQVETGEDGSFLSRILPIKKESSSNNVIDDARDNRELIDNNEAQNLTGEEIEAMRREGAKGDEIIEALIANSKTFDQKFQLSQEKYKLKKQKKYAPKLLLRRPFARSICEAYFKKYPNRIGFIRVDALSLLLTMANVTAHSDVLVVDMVGGLITGAVAERLGGTGYVCNTYKGNSPPSVEMVRMFNFTDKVIERIVQSSIDELSAAKTVSPEENNQQGGVHPSTSDMVEDTPVTAEARVVDDAVPESKIVKAPKAGAKASKDAIEMWKENGFSSLIMAAQDQDPWSLAKDVLPLLSYSAPFAIYHQYLQPLATCMHNLQQGKMAINLQITEPWLREYQVLPSRTHPHMQMSSFGGYVLSGIRISTA

SEQ ID NO: 2507 - protein, 438 aa, Brassica juncea
MEHSKEDQAKSEDQKINKAQDPNPRFASEGCSVLLDVNDGDRLVFARLSGGAIFKIGNTNYSLKPLIGAPFGSLFQVETGEDGSFLSRILPVKKESTSVNVVDDDARDNRELIDDNESQNLTCEEIEAMRREGAKGDEIIEALIANSKTFDKKFQLSQEKYKLKKQKKYAPKVLLRRPFARSICEAYFKKYPARIGFIRVDALSLLLTMANVTAYSDVLVVDMVGGLVTGAVAERLGGTGYVCNTYKGDSPSSVDMVKMFNFTDKIRERIVHSSINELSSAKAASPEENNQQDSSASDMVEDVSVTAEARVVDDVVTESKTIKAPQPGAKASKEAVEMWKENGFSSLIMAAQDQDPWTLAEDVLPLLSYSAPFAIYHQYLQPLATCMHNLQQGKMAINLQITEPWLREYQVLPSRTHPHMQMSSFGGYVLSGIRISTT

SEQ ID NO: 2508 - protein, 314 aa, Brassica napus
MRREGAKGDEIIEALIANSKTFDQKFQLSQEKYKLKKQKKYAPKLLLRRPFARSICEAYFKKYPNRIGFLRVDALSLLLTMANVTAYSDVLVVDMVGGLVTGAVAERLGGTGYVCNTYKGNSPPSVEMVRMFNFTDKVIERIVQSSINELSSAKTVSPEENNHQEGVHPSTSDMVEDTAVTAEARVVVDDVVLESKIVKAPKAGAKASKEAIEMWKENGFSSLIMAAQDQDPWALANDVLPLLSYSAPFAIYHQYLQPLATCMHNLQQGKMAINLQITEPWLREYQVLPSRTHPHMQMSSFGGYVLSGIRISTT

SEQ ID NO: 2509 - protein, 438 aa, Brassica rapa
MEHSKEDQAKSEDQKINKAQDPNPRFASEGCSVLLDVNDGDRLVFARLSGGAIFKIGNTNYSLKPLIGAPFGSLFQVETGEDGSFLSRILPVKKESTSVNVVDDDARDNRELIDDNESQNLTCEEIEAMRREGAKGDEIIEALIANSKTFDKKFQLSQEKYKLKKQKKYAPKVLLRRAFARSICEAYFKKYPARIGFIRVDALSLLLTMANVTAYSDVLVVDMVGGLVTGAVAERLGGTGYVCNTYKGDSPSSVDMVKMFNFTDKIRERIVHSSINELSSAKTAPPEENNQQDSSASDMVEDVSVTAEARVDDIAVRESKITKAPQPGAKASKEAVEMWKENGFSSLIMAAQDQDPWTLAKDVLPLLSYSAPFAIYHQYLQPLATCMHNLQQGKMAINLQITEPWLREYQVLPSRTHPHMQMSSFGGYVLSGIRISTT

SEQ ID NO: 2510 - protein, 437 aa, Brassica napus
MEHSKEDQAKSENQKINKAQDPNPRFASEGCSVLLDVNDGDRLVFARLSGGAIFKIGNTNYSLKPLIGAPFGSLFQVETGEDGSFLSRILPVKKESTSVNVVDDDARDNRELIDDNESQNLTCEEIEAMRREGAKGDEIIEALIANSKTFDKKFQLSQEKYKLKKQKKYAPKVLLRRPFARSICEAYFKKYPARIGFIRVDALSLLLTMANVTAYSDVLVVDMVGGLVTGAVAERLGGTGYVCNTYKGDSPSSVDMVKMFNFTDKIRERIVHSSINELSSAKAASPEENNQDSSASDMVEDVSVTAEARVDDVAVRESKLTKAPQPGAKASKEAVEMWKENGFSSLIMAAQDQDPWTLAKDVLPLLSYSAPFAIYHQYLQPLATCMHNLQQGKMAINLQITEPWLREYQVLPSRTHPHMQMSSFGGYVLSGIRISTT

SEQ ID NO: 2511 - protein, 226 aa, Arabidopsis lyrata
MVREEEKSRWWWFESHKSSKHSQWLQSTLAELDAKTKAMLKLIEGNADSFAQRAETYYKKRPELICFVEDFYRAHRSLAEKFDHLKSSDYGSRSSKFPQQSMDSVSDSNSHFQDAHSEIADPEDDELDSPFASHKEDETWNLEQERSKLIEESDALRKQLLDKDEEKREVIRQLSLTLETLKDENLTLKRRLAHHSLKRRTFLEFKPLDKFFGKLFYIVCDGNKVV

SEQ ID NO: 2512 - protein, 226 aa, Arabidopsis lyrata
MVREEEKSRWWWFESHKSSKHSQWLQSTLAELDAKTKAMLKLIEGNADSFAQRAETYYKKRPELICFLEDFYRAHRSLAEKFDHLKSSDYGSRSSKFPQQSMDSVSDSNSHFQDAHSEIADPEDDELDSPFASHKEDETWNLEQERSKLIEESDALRKQLLDKDEEKREVIRQLSLTLETLKDENLTLKRRLAHHSLKRRTFLEFKPLDKFFGKLFYIVCDGNKVV

SEQ ID NO: 2513 - protein, 255 aa, Arabidopsis lyrata
MSYSHQSMGSGSRSTRGYEFGRTYVVRPKGKHQATIVWLHGLGDNGSSSSQLLESLPLPNIKWICPTAPSRPVSLLGGFPCTAWFDVGEISEDLHDDIEGLDASAAHIANLLSAEPTDVKVGIGGFSMGAAIALYSTTCYALGRYGTGHPYTINLRATVGLSGWLPGWRSLRSKIESSNEVARRAASIPIILAHGTSDDVVPYRFGEKSAHSLAMAGFRQTMFKPYEGLGHYTVPKEMDEVVHWLASRLGLEGSR

SEQ ID NO: 2514 - protein, 255 aa, Eutrema parvulum
MSYSHQSMGSGSRSARGYDFGRTYVVRPKGKHQATIVWLHGLGDNGSSSSQLLESLPLPNIKWICPTAPSRPVSLLGGFPCTAWFDVGEISEDLHDDIEGLDASAAHIANLLSTEPTDVKVGIGGFSMGAAIALYSTTCYALGRYGTGHPYTINLRATVGLSGWLPGWRSLRSKIESSNEAARRAASIPVILAHGTSDDVVPYRFGEKSAHALALAGFRQVAFKPYEGLGHYTVPKEMDEVVHWLASRLGLEGSR

SEQ ID NO: 2515 - protein, 255 aa, Brassica rapa
MSYSRQSMGSGSRSTRGYEFGRTYVVRPKGKHQATIVWLHGLGDNGSSSSQLLESLPLPNIKWICPTAPSRPVSLLGGFPCTAWFDVGEISEDLHDDIEGLDASAAHIANLLSTEPTDVKVGIGGFSMGAAIALYSTTCYALGRYGNGLPYTINLRATVGLSGWLPGWRSLRSKIESSNEAARRAASIPVILAHGTSDDVVPYRFGETSAQALAMAGFRQVMFKQYEGLGHYTVPKEMNEVVHWLASRLGLEGSR

SEQ ID NO: 2516 - protein, 255 aa, Brassica napus
MSYSHQSMGSGSRSARGYEFGRTYVVRPKGKHQATIVWLHGLGDNGSSSSQLLESLPLPNIKWICPTAPSRPVSLLGGFPCTAWFDVGEISEDLQDDIEGLDASAAHIANLLSTEPTDVKVGIGGFSMGAAIALYSTTCYALGRYGTGHPYTINLRATVGLSGWLPGWRSLRSKIESSNEAARRAASVPVILAHGTSDDVVPYRFGEKSAHSLAMSGFRQVVFKPYEGLGHYTVPKEMDEVVQWLASRLGLEGWR

SEQ ID NO: 2517 - protein, 255 aa, Eutrema halophilum
MSYSHQSMGSGSRSARGYEFGRTYVVRPKGKHQATIVWLHGLGDNGSSSSQLLESLPLPNIKWICPTAPSRPVSLLGGFPCTAWFDVGEISENLHDDVEGLDASAAHIANLLSAEPRDVKVGIGGFSMGAAIALYSTTCCALGRYGNGHPYTINLRATVGLSGWLPGWRSLRSKIESSNEATRRAASIPVILAHGTSDDVVPYIFGEKSAHSLALAGFRQVMFKPYEGLGHYTVPKEMEEVVHWLASRLGLEGSR

SEQ ID NO: 2518 - protein, 160 aa, Brassica napus
MSYSHQSMGSGSRSGRGHEFGRTYVVRPKGKHQATIVWLHGLGDNGSSSSQLLESLPLPNIKWICPTAPSRPVSLLGGFPCTAWFDVGEISEDLQDDIEGLDASAAHIANSCQLNQQMSKLDRRFQHGCSNSSLFHDVLRSWTLRNRTSLYYKPTSYCRT

SEQ ID NO: 2519 - protein, 128 aa, Brassica napus
MGAAIALYSTTCYALGRYGNGLPYTINLRATVGLSGWLPGWRSLRSKIESSNEAARRAASIPVILAHGTSDDVVPYRFGETSAQALAMAGFRQVMFKQYEGLGHYTLPKEMNEVVHWLASRLGLEGSR

SEQ ID NO: 2520 - protein, 84 aa, Brassica napus
MSYSHQNMGSGSRSARGYEFGRTYVVRPKGKHQATIVWLHGLGDNGSSSSQLLESLPFKHKMDMPNSSLASCFASRWIPLHCMV

SEQ ID NO: 2521 - protein, 260 aa, Brassica rapa
FVIALVEYVSGKIFVGSRSARGYEFGRTYVVRPKGKHQATIVWLHGLGDNGSSLSQLLESLPLPNIKWICPTAPSRPVSLLGGFPCTAWFDVGEISEDLHDDIEGLDASAAHIANLLSTEPSDVKVGIGGFSMGAAVALYSTTCYALGRYGTGHPYTINLRATVGLSGWLPGWRSLRSKIESSNEAARRAASIPIILAHGTSDDVVPYRFGEKSAHSLAMAGFRQVVFKPYEGLGHYTVPKEMEEVVHWLASRLGLEGSS

SEQ ID NO: 2522 - protein, 260 aa, Brassica rapa
FVITILQYVSGKIFVGSRSARGYEFGRTYVVRPKGKHQATIVWLHGLGDNGSSSSQLLESLPLPNIKWICPTAPSRPVSLLGGFPCTAWFDVGEISEDLQDDIEGLDASAAHIANLLSTEPTDVKVGIGGFSMGAAIALYSTTCYALGRYGTGHPYTINLRATVGLSGWLPGWRSLRSKIESSNEAARRAASVPVILAHGTSDDVVPYRFGEKSAHSLAMSGFRQVVFKPYEGLGHYTVPKEMDEVVQWLASRLGLEGWR

SEQ ID NO: 2523 - protein, 255 aa, Eutrema parvulum
MSYSHQSMGSGSRNARGYEFGRTYVVRPKGKHQATLVWLHGLGDNGSSSSQLMESLHLPNIKWICPTAPTRPVSSLGGFTCTAWFDVGEISEDSHDDMEGLDASASHIANLLSSEPADVKVGIGGFSMGAAISLYSATCYALGRYGTGHTYPINLRAVVGLSGWLPGWKSLRSKIECSYEAARRAASLPIVLTHGTSDDVVPYRFGEKSAQSLGMAGFRQAVFKQYEGLGHYTVPKEMDEVVHWLTTRLGLEGSR

SEQ ID NO: 2524 - protein, 86 aa, Arabidopsis lyrata
MSYSRQSMGSGSRNARGYEFGRTYVVRPKGKHQATLVWLHGLGDNGSSSSQLMESLHASSKYKMDLSNCSFASCYKSWWIYLHCLV

SEQ ID NO: 2525 - protein, 255 aa, Arabidopsis thaliana
MSYSHQSMGSGSRNARGYEFGRTYVVRPKGKHQATLVWLHGLGDNGSSSSQLMDSLHLPNIKWICPTAPSRPVTSLGGFTCTAWFDVGEISEDGHDDLEGLDASASHIANLLSSEPADVKVGIGGFSMGAAISLYSATCYALGRYGTGHAYPINLQAVVGLSGWLPGWKSLRSKIECSFEAARRAASLPIILTHGTSDDVVPYRFGEKSAQSLGMAGFRLAMFKPYEGLGHYTVPREMDEVVHWLTTMLGLEGSR

SEQ ID NO: 2526 - protein, 255 aa, Eutrema halophilum
MSYSHQSMGSGSRNARGYEFGRTYVVRPKGKHQATLVWLHGLGDNGSSSSQLMESLHLPNIKWICPTAPTRPVSSLGGFTCTAWFDVGEISEDSHDDMEGLDASASHIANLLSSEPADVKVGIGGFSMGAAISLYSATCYALGRYGTGHTYPINLRAVVGLSGWLPGWKSLRSKIECSYDAARRAASLPIILTHGTSDDVVPYRFGEKSAQSLGIAGFRQVVFKAHEGLGHYTIPKEMDEVVHWLTTRLGLEGSR

SEQ ID NO: 2527 - protein, 255 aa, Brassica napus
MSYSHQSMGSGSRNARGYEFGRTYVVRPKGKHQATLVWLHGLGDNGSSSSQLMESLHLPNIKWICPTAPTRPVSSLGGYTCTAWFDVGEISEDSHDDLEGLDASASHIANLLSSEPADVKVGIGGFSMGAAISLYSATCYALGRYGTGHTYPINLRAVVGLSGWLPGWKSLRNKIECSYEAARRAASLPIILTHGTADDLVPYRFGEKSAQSLGMAGFRQAVFKPYEGLGHYTVPKELDEVVQWLTTRLGLEGSR

SEQ ID NO: 2528 - protein, 255 aa, Raphanus sativus
MSYSHQSMASGSRNARGYEFGRTYVVRPKGKHQATLVWLHGLGDNGSSSSQLMESLHLPNIKWICPTAPTRPVSSLGGYTCTAWFDVGEISEDSHDDLEGLDASASHIANLLSSEPADVKVGIGGFSMGAAISLYSATCYALGRYGAGHTYPINLRAVVGLSGWLPGWKSLRNKIECSYEAARRAASLPIILTHGTADDLVPYRFGEKSAHSLGMAGFRQTVFKPYEGLGHYTVPKELDEVVQWLTTRLGLEGSR

SEQ ID NO: 2529 - protein, 255 aa, Brassica rapa
MSYSHQSMGSGSRNARGYEFGRTYVVRPKGKHQATLVWLHGLGDNGSSSSQLMESLHLPNIKWICPTAPTRPVSSLGGFTCTAWFDVGEISEDGHDDMESLDASASHIANLLCSEPADVKVGIGGFSMGAAISLYSATCYALGRYGTGHSYPINLRAVVGLSGWLPGWKSIRNKIESSYEAARRASSLPVILTHGIADDVVPYRFGEKSAQSLGMAGFRQTVFKPYQGLGHYTVPKEMDEVVHWLTTRLGLEGSR

SEQ ID NO: 2530 - protein, 254 aa, Brassica rapa
  misc_feature (142)..(142): Xaa can be any naturally occurring amino acid
  misc_feature (175)..(175): Xaa can be any naturally occurring amino acid
  misc_feature (180)..(180): Xaa can be any naturally occurring amino acid
  misc_feature (182)..(183): Xaa can be any naturally occurring amino acid
  misc_feature (201)..(201): Xaa can be any naturally occurring amino acid
  misc_feature (204)..(205): Xaa can be any naturally occurring amino acid
  misc_feature (212)..(212): Xaa can be any naturally occurring amino acid
  misc_feature (215)..(215): Xaa can be any naturally occurring amino acid
  misc_feature (218)..(218): Xaa can be any naturally occurring amino acid
  misc_feature (232)..(232): Xaa can be any naturally occurring amino acid
  misc_feature (243)..(244): Xaa can be any naturally occurring amino acid
  misc_feature (247)..(249): Xaa can be any naturally occurring amino acid
  misc_feature (252)..(253): Xaa can be any naturally occurring amino acid
MGSGSRSARGYEFGRTYVVRPKGKHQATIVWLHGLGDNGSSLSQLLESLPLPNIKWICPTAPSRPVSLLGGFPCTAWFDVGEISEDLHDDIEGLDASAAHIANLLSTEPSDVKVGIGGFSMGAAVALYSTTCYALGRYGTGXPYTINLRATVGLSGWLPGWRSLRSKIESSNEAXRRAAXIXXILAHGTSDDVVPYRFGEXSAXXLAMAGFXQVXFKXYEGLGHYTVPKEMXEVVHWLASSLXXRAXXXLQXXL

SEQ ID NO: 2531 - protein, 263 aa, Brassica rapa
MLLMIKFLSKIISIEIILGSRNARGYEFGRTYVVRPKGKHQATLVWLHGLGDNGSSSSQLMESLHLPNIKWICPTAPTRPVSSLGGYTCTAWFDVGEISEDSHDDLEGLDASASHIANLLSSEPADVKVGIGGFSMGAAISLYSATCYALGRYGTGHTYPINLRAVVGLSGWLPGWKSLRNKIECSYEAARRAASLPIILTHGTADDLVPYRFGEKSAQSLGMAGFRQAVFKPYEGLGHYTVPKELDEVVQWLTTRLGLEGSR

SEQ ID NO: 2532 - protein, 258 aa, Ricinus communis
MSYQQHPSVGSGSRTARRTFEFGRTYVVRPKGKHQATIVWLHGLGDNGSSWSQLLESLPLPNIKWICPTAPTRPVALLGGFPCTAWFDVGEISENSPDDWEGLDASAAHIANLLSTEPTDVKVGIGGFSMGAAIALYSATCAALGRYGNGNLYPINLRAVVGLSGWLPGSRSLRSKIEGLNEAVRRAASLPILLCHGTSDDVVSYNYGEKSAHSLNTAGFRHLTFKPYEGLGHYTVPKEMDEVRNWLSAKLNLEGSRA

SEQ ID NO: 2533 - protein, 258 aa, Populus trichocarpa
MSYQQHFSMGSGSRPARRNFEFGRTYVVRPKGKHQATIVWLHGLGDNGSSWSQLLENLPLPNIKWICPTAPTRPVALLGGFPCTAWSDVGEISEDSPDDWEGLDASAAHIANLLSTEPADVKVAIGGFSMGAATAIYSATCAALGQYGNGNAYPINLRAVVGLSGWLPGSRSLRSKVEGSHEAARRAASLPIFLCHGTSDDVVPYNYGEKSAHSLNTAGFRNLIFKSYEGLGHYTVPKEMDEVRNWLTARLGLEGSRS

SEQ ID NO: 2534 - protein, 461 aa, Arabidopsis lyrata
MSILCCVPVLECVYCLGCAHWLWKKCLYSAGHESENWGLATSDEFEPIPRICRLILAVYEENLHDPMWAPPGGYGLDPNHVILKKDYDQTEGRVTPYMIYLDHDNGDVVLAIRGLNLAKECDYAVLLDNKLGQTKFDGGYVHNGLLKAAMWVFEEEHVVLRELLEANPSYSLTFVGHSLGAGVVSLLVLFVIQNRARLGNIERKRIRCFAIAPPRCMSLHLAVTYADVINSIVLQDDFLPRTTTALENVFKSIICLPCLLCLTCLKDTFTFEEKKLKDARRLYAPGRLYHIVVRKPLRLGRYPPVVRTAVPVDGRFEQIVLSCNTTADHAIIWIERESQRALELMLEEDQVMQIPVEQKIVRQKSIVEDHDEEYRAAIMKAASLNIPMSPSPSYGTFHDTEEGESSTGSGMEGSPSGWSFKGMRRKWDQFIDCHFPVNDHREHIIFKKNESSALLCGQETL

SEQ ID NO: 2535 - protein, 457 aa, Eutrema halophilum
MSILCCVPVLECVYCLGCAHWLWKKCLYSAGHESENWGLATSDEFEPIPRLCRLILAVYEEDLHNPMWAPPGGYGIDPHHVVLKKDYDQTQGRVTPYMIYLDHQNGHVVLAIRGLNLAKESDYAVLLDNKLGQTKFDGGYVHNGLLKAAMWVFEEEHEVLKKLLDENPGYSLTFVGHSLGAGVVSLLVLFVVQNRDRLGNIERKRIRCFAIAPPRCMSLHLAVTYADVINSVVLQDDFLPRTTTALEDVFKSIICLPCVLCLTCLKDTFTFEEKKLKDTRRLYAPGRLYHIVVRKPLRLGRFPPVVRTAVPVDGRFEQIVLSCNATADHAIIWIQRESQIALDLMLEEDRVMQIPVEQRIVRQKSIVEDHDEEYRAAIMKAASLNIPMSPSPSYGTFHDPEEGESSAGSGVEGSPSPWSFKGMRRNWNRFIDRYFPVDDNSGHMIFKKEESSALLCR

SEQ ID NO: 2536 - protein, 457 aa, Eutrema parvulum
MSILCCVPVLECVYCLGCAHWLWKKCLYSAGHESENWGLATSDEFEPIPRLCRLILAVYEEDLHNPMWAPPGGYGIDPHQVILKKDYDRTQGRVTPYMIYLDHQNGEVVLAIRGLNLAKESDYAVLLDNKLGQTKFEGGYVHNGLLKAAMWVFEEEHEVLNKLLEENPGYSLTFVGHSLGAGVVSLLVLFVVQNRSRLGNIERKRIRCFAIAPPRCMSLHLAVTYADVIKSVVLQDDFLPRTTTALEDVFKSIICLPCLLCLTCVKDTFTFEEKKLKDARRLYAPGRLYHIVVRKPLRLGRYPPVVRTAVPVDGRFEQIVLSCNATADHAIIWIQRESQRALDLMLEEDQVMQIPVEQKIVRQKSIVEDHEEEYRAAIMKAASLNIPMSPSPSYGTFHDTEEGESSVGSGDPSTPSPWSFKGMRRKWNQFVDGHFPMDDDSGRMIFKKEESPDLLCR

SEQ ID NO: 2537 - protein, 159 aa, Brassica napus
MSILCCVPVIECVYCLGCSHWLWKKCMYSAGHESESWGLATSDEFDPIPRLCRLILAVYEEDLHNPMWAPPGGYGLDPDHVILKKDYDQTQGRVTPYMIYLDHDNDAVVLAIRGLNLAKESDYALLLDNKLGQTKFDGGYVHNGLLKAAMWVLRRSMRF

SEQ ID NO: 2538 - protein, 460 aa, Brassica rapa
MSILCCVPVIECVYCLGCSHWLWKKCMYSAGHESESWGLATSDEFDPIPRLCRLILAVYEEDLHNPMWAPPGGYGLDPHHVILKKDYDQTQGRVTPYMIYLDHDNDAVVLAIRGLNLAKESDYALLLDNKLGQTKFDGGYVHNGLLKAAMWVFEEEHEVLNRLLEENPSYSLTFVGHSLGAGVVSLLVLFVLQNRGRLGNIERKRIRCVAIAPPRCMSLHLAVTYADIINSVVLQDDFLPRTTTALEDVFKSIICLPCLLCLTCVKDTFTFEEKKLKDARRLYAPGRLYHIVVRKPLRLGRYPPVVRTAVPVDGRFDQLVLSCNATADHAIIWIQRESQRALDLMLEEDQVMQIPVEQKIVRQKSVVEEHDEEYRAAIMKAASLNIPMSPSPSYGTFHDTAEEGESSTGGSVNEGSPSMWSFKGMKRKWNRFVDRHFPMDDDDSGDMILKKEESSTLLCR

SEQ ID NO: 2539 - protein, 102 aa, Arabidopsis lyrata
MSTDCNRADDFLFSQQQESTSGANKYEGLVPKKKPLISKDSKRAFFDSADWALLKQEASIDQRPIAAIEKLRPKFQRTPRKELPPRRPTCATGHDNLTESSF

SEQ ID NO: 2540 - protein, 102 aa, Brassica napus
MATDYNRADDFLFSQRQESTSGAHKYGGLVPKKKPLISQNHKRAFFDSADWALHKQEASVDERTIAAIENLRPKLQRTPRKQLPLRRPTCATGQENLADSSF

SEQ ID NO: 2541 - protein, 102 aa, Brassica oleracea
  misc_feature (14)..(14): Xaa can be any naturally occurring amino acid
  misc_feature (37)..(38): Xaa can be any naturally occurring amino acid
MATDYNRADDFLFXQRQESTSGAHKYGGLVPKKKPLXXQNHKRAFFDSADWALHKQEASVDERTIAAIENLRPKLQRTPRKQLPLRRPTCATGQENLADSSF

SEQ ID NO: 2542 - protein, 854 aa, Arabidopsis lyrata
MRDLVIVFGSSSAITNPHHHHRRCYATAPEPNRKTKSNSSFTKLLPSLPQQHSPSPAPVSASHSLSNHFSKVVRWIPDGSLEYYADFASKLAEDGRIEDVALIAETLAAESGTNVARFASMVDYDLLSKGISSNLRQGKIESVVYTLKRIEKVGIAPLDLVDETSVKLMRKQFRAMANSLQVEKAIDLMEILAGLGFKIKELVDPFDVVKSCVDVSNPQLAIRYACLLPHTEILLCRIIHGFGKKGDMVSVMTAYEACKQILDTPNMYICRTMIDVCGLCGDYVKSRYIYEDLLKENIKPNIYVMNSLMNVNSHDLGYTLKVYKDMKKLEVTADMTSYNILLKTCCLAGRVDLAQDIYKEAKRMESSGLLKLDAFTYCTIIKVFADAKMWKWALKVKDDMKSVGVTPNTHTWSSLISACANAGLVEQANHLFEEMLASGCEPNSQCFNILLHACVEACQYDRAFRLFQSWKGSTVKEALYVDDSKGGISSQNRLKNHGPGSLVNSNSNSPYIQASNRFCFKPTTATYNILLKACGTDYYRGKELMDEMKSLGLAPNQITWSTLIDMCGGSGDVEGAVRILRTMHSAGTRPDVVAYTTAIKICAENKSLKLAFSLFEEMRRYQIKPNWVTYNTLLKARSKYGSLLEVRQCLAIYQDMRKAGYKPNDHFLKELIEEWCEGVIQENGLSQEVSDQEGDAGRPVSLLIEKVATHMQERTAGNLAIDLQGLTKIEARLVVLAVLRMIKEDYMRGDVVIDDVLIILGTGEANSDSGKQEITVKEALVKLLQDELSLVVLPAGPKSIKQDAHCVDDAKQDTVHTLETTTSLVSISSTRRPAILERLMVTKASLYKWLQRKK

SEQ ID NO: 2543 - protein, 858 aa, Eutrema halophilum
MRDLVIVFGSSSVITNPHHRRCYATAPELNRKLKSTSSLTKQLPSLPQQHTSSPASVSSANALSSHFSDAVRWIPDGSVEYYADFASKLAEDGRIQDVALIAETLAAESGANVARFASMVDSDLLSKGISLNLRQGKIESVVYTLQRIEKVGIAPLDLVDESSVKLMRKHFRAMANSVQVEKAIDLMEILAGFRFKIKELVDPFDVVKICVDISNPQLAIRYACLLPHTELLLCRIIHGFGKKGDMVSVLTAYEACKQILDNPNMYIYRTMIDVCGLCGDYVKSRYIYEDLLKENIKPNIYVMNSLMNVNSHDLGYTLKVYKNMQKLDVTADMTSYNILLKTCCLAGRVDLAQDIYKEAKRMESSGLLKLDAFTYCTIIKVFADAKMWKMALKVKEDMQSVGVTPNTHTWSSLISACANAGLVEQANHLFEEMLASGCEPNSQCFNILLHACVEACQFDRAFRLFQSWKGSSDKEALYADDITGKGSIFSPNKLKNHGNGSLVNTNSSPYIQASNRFFFKPTTATYNILLKACGTDYYRGKELMDEMRSLGLAPNQITWSTLIDICGGSGDVEGAVGILRTMHSAGTRPDVVAYTTAIKICAENKSLKLAFSLFEEMRRYQIKPNWVTYNTLLKARSKYGSLLEVRQCLAIYQDMRKAGYKPNDHFLKELIEEWCEGVIQENSQSQIKTSDQEGTNLGRPVSLLIEKVATHLQERTAGNLAIDLQGLTKVEARLVVLAVLRMIKEDYIRGDVVTDDLLIILGTGEANIDPGKQEIAVKDVLVQLLKDELSLVVLPAGHRHVLDITLDARCVDDADQGIELTSENTKSIVGISSTRRPAILERLMVTKASLHQWLQRKK

SEQ ID NO: 2544 - protein, 857 aa, Eutrema parvulum
MRDLVIVFGSSSVITNPHHRHRRCYATAPEPHRKTHSTSSLTKPLLSLPQQHSASPASVSSANTHYSDAVRWIPDGSVEYYANFASKLAEDGRIQDVALIAETLAAESGANVARFASMVDSHLLSKGISLNLRQGKIESVVYTLKRIEKVGIAPLDLVDDSSVKLMRKQFRAMANSVQVEKAIDLMEILAGFRFKIKELVDPFDVVKICVDISNPQLALRYACLLPHTEILLCRIIHGFGKKGDMVSVMTAYEACKQILDTPNMYIYRTMIDVCGLCGDYVKSRYIYEDLLKEDIKPNIYVMNSLMNVNSHDLGYTIEVYKNMQKLDVTADMTSYNILLKTCCLAGRVDLAQDIYKEAKRMESCGLLKLDAFTYCTIIKVFADAKMWKMALKVKDDMQSVGVTPNTHTWSSLISACANAGLVEHANHLFEEMLASGCEPNSQCFNILLHACVEACQYDRAFRLFQSWKGSSAKESLYADDIISKGGIFSPNKLNHHGPRSLVNINSSPYIQASNRFFFKPTTATYNILLKACGTDYYRGKELMDEMKSLGLAPNQITWSTLIDICGGSGDVEGAVRILRTMHSAGTRPDVVSYTTAIKICAENKSLKLAFSLFEEMRRYQIKPNWVTYNTLLKARSKYGSLLEVRQCLAIYQDMRKAGYKPNDHFLKELIEEWCEGVIQENSQSQNKASYQEGTNLGRPVSLLIEKVATHLQERTAGNLAIDLQGLTKVETRLVVLAVLRMIKEDYTRGDVVTDDLLIILGTGKANTVSGKQEIAVKDVLVKLLKDELSLVVLPAGQRHVLDITQDARCVDDADQDAEHTLENTKSIVGISSTRRPAILERLLVTKASLHQWLQRKK

SEQ ID NO: 2545 - protein, 853 aa, Brassica rapa
MRDLVIVFPSSSLITNPHHHHHNHRRRYATAPEHNRKTKYTSSLTKQLPSLSSANHLSNHFPDAVRWTPDGSVEYYADFASKLAEDGRIQDVALIAETLAAESGANAARFASMVDSDLLSKGIALNLRQGKVESVVYTLKRIEKVGIAPLDLVNDDSSVKLMRKQFRAMANSVQVEKAIDLMEILAGFRFKIKDLVDPFDVIKICVDISNPQLALRYACLLPHTEILLCRIILGFGKKGDMASVMTAYEACKQILDAPNMYIYRTMIDVCGLCGDYVKSRYIYEDLLKEDIKPNIYVMNSLMNVNSHDLGYTLKVYKNMQKLNVTADMTSYNILLKTCCLAGRVDLAQDIYKEAKRMESSGLLKLDAFTYCTIIKVFADAKMWKMALKVKEDMQSVGVTPNTHTWSSLISACANAGLVEQANHLFEEMLASGCEPNSQCFNILLHACVEACQYDRAFRLFQSWKGSSAKEALYADDIISKGGVFNPNKLNHHGPGSLVKSNSSPYIQASNRFFFKPTTATYNILLKACGTDYYRGKELMDEMKSLGLAPNQITWSTLIDICGGSGDVEGAVRILRTMHSDGTRPDVVAYTTAIKICAENKSLKLAFSLFEEMRRFQIKPNWVTYNTLLKARSKYGSLLEVRQCLAIYQDMRKAGYKPNDHFLKELIEEWCEGVIQENSQSQNKASDLEGTDFGRPVSLLIEKVASHLQERTSGHLAIDLQELTKVEARLVVLAVLRMIKEDYTRGDVVKDDLVIILGTGEANTDSGKQEVAVKDALVKLLKDELSLVVLPAGQRRVLDITQDARFVDDADQNTEHTSENTKSIVGMSTTRRPAILERLMVTKASLHKWLQRKK

SEQ ID NO: 2546 - protein, 611 aa, Arabidopsis lyrata
MASDAVKYMPIHGGGTTTTTTAADIKSFFSALKPKKPSTFAYAFVITFVSFTLFFAFSPSPNSSSPWFSNIFTSSSTTTTSVSDNTSGSQFSSIFSYILPNVTSTKPTNRSSDATDPISVNATSPSLNSNSKNVTLQAPAPETHTPIAKNTTFEPPIVNGTNPVAKNNTLSHPLLSDKSSATGSNNQSRTTSDTETVKRNQTTVPAPSKAPVSVDLKTNSSSNSSTASSTPEKQTKNVDLVSSMKQEIEKWRDSLKNCEFFDGEWIKDDSYPLYKPGSCKLIDEQFNCISNGRPDKDFQKLKWKPKKCSLPRLNGAILLEMLRGRRLVFVGDSLNRNMWESLVCILKGSVKDETKVYEARGRHHFRGEAEYSFVFQDYNCTVEFFVSPFLVQEWEIVDKKGTKKETLRLDLVGKSSEQYKGADIIVFNTGHWWTHEKTSKGEDYYQEGSNVYHELAVLEAFRKALTTWGRWVEKNVNPAKSLVFFRGYSASHFSGGQWNSGGACDSETEPIKNDTYLTPYPSKMKVLEKVLRGMKTPVTYLNITRLTDYRKDGHPSVYRKHSLSEKEKKTPLLYQDCSHWCLPGVPDSWNEILYAELLVKLNQLSQTQRKT

SEQ ID NO: 2547 - protein, 613 aa, Eutrema halophilum
MASDAVKYMPIHGGTTTTTAAAAEIKSFFSAVKPRKTSTFAYAFVITFVAFTLFFAFSPSPNSSSPWFSNIFSSSSTTSPSSDNTSGSHFSSIFSYIIPNVTLTKPTNRSSDATSNFTEPIPVNTTSPSSPTSNSVSDTIRNGTLQAPAPENLTPIAKNSTFKSPIVNRTNPVAKTNTSSHPLLPDKSPTGSSNQSLTTDAARNQKTAAPAPSKAPVSVNLTANSSSSAPSTPEKQTGNGGLVTSVKQEMEKWSESLKDCEFFDGEWIKDDSYPLYKPGSCKLIDEQFNCISNGRPDKGFQKLKWKPKKCSLPRLNGGILLEMLRGRRLVFVGDSLNRNMWESLVCILKGSVKDESKVYEASGRHHFRGEAEYSFVFQDYNCTVEFFVSPFLVQETEIVDKKGTKKETLRLDLVGKSSEQYKGADIIIFNTGHWWTHEKTSKGEDYYQEGSNVYHELAVLEAFRKALTTWGRWVEKNVNPDKSLVFFRGYSASHFSGGQWNSGGACDSETEPIKNETYLTPYPSKMKVLERVLRGMRTPVTYLNITRLTDYRKDGHPSVYRKHSLSEKEKRTPLLYQDCSHWCLPGVPDSWNEILYAELLVKLNQLGQARRKP

SEQ ID NO: 2548 - protein, 615 aa, Eutrema parvulum
MASDAVKYMPIHGGTTTTTAAAAEIKSFFSAVKPRKTSTFAYAFVITFVSFTLFFAFSPSSNSSSPWFSNIFSSSAAPSSDSTSGSHFSSIFSYIIPNVTSAKPTNRSTDAKSNITVPVSVNSTSPSPSLNSVSDAVKNSTLQAPAPKNRTPVAKNATFESPIVNGTNTVAKSNTSHPLLSDKSSTRSSNQSRTTDAVRNSEAVKRNQTGASSPPKAPVSVDLKANSSSSTASTPGKQIGKSDSVSSAKQEIEKWSESLKDCEFFDGEWIRDDSYPLYKPGSCKLIDEQFNCISNGRADKNFQKLKWKPKKCSLPRLNGGILLEMLRGRRLVFVGDSLNRNMWESLVCILKGSVKNESKVYEARGRHHFRGEAEYSFVFQDYNCTVEFFVSPFLVQETEIVDKKGTKKETLRLDLVGKSSEQYKGADIIVFNTGHWWTHEKTSKGEDYYQEGSNVYHELAVLEAFRKALTTWGRWVEKNVNPEKSLVFFRGYSASHFSGGQWNSGGGCDSETEPIKNETYLTPYPSKMKVLERVLRGMRTPVTYLNITRLTDFRKDGHPSVYRKHSLSDKEKRTPLLYQDCSHWCLPGVPDSWNEILYAELLVKLNQLGQTQRKP

SEQ ID NO: 2549 - protein, 601 aa, Brassica rapa
MASDAVKYMPIHGATTTTAAAAAEIRSFISAVKPKKTSTFAYAFVITFVSFTLFFAFSPSPNSSSPWFSNIFSSSSFSSSTTTTAAAPSSSKTASVSSIFSYIIPNVTSTNPTNRSSDAASNTTVPVSVNSTSPSLSSSSVVKNSTLQAPPPENRTPVAKNSTFESPVVNRTEPVAKTNTSQPLLPTGSSNLSRTADKAPSPAKSPPVSVDLTSNSTSSAPSKPGEQTGSVSLLEQEIEKWSESLKDCEFFDGGWIMDDTYPLYKPGSCNIIDEQFNCISNGRPDKDFQKLKWKPKKCSLPRLNGGIMLEMLRGRRLVFVGDSLNRNMWESLVCMLKGSVKDESKVYEASGRHHFRGEAEYSFVFQDYNCTVEFFVSPFLVQENEIVDKKGTKKETLRLDLVGKSSEQYKGADIIVFNTGHWWTHEKTSKGEDYYQEGSNVYHELAVLEAFRKALTTWGRWVEKNVNPDKSLVFFRGYSASHFSGGQWNSGGACDSETEPIKNETYLTPYPDKMKVLERVLKGMRTPVTYLNITRLTDYRKDGHPSVYRKQSLSDKEKKTPLLYQDCSHWCLPGVPDSWNEILYAELLVKLNQLGQTRRNP

SEQ ID NO: 2550 - protein, 91 aa, Arabidopsis lyrata
MAGLRWREWWNTMAFPTRRIWNRFTVRVGFRHSGLLRLQNDVSSCEYEDIHIMWNLLHKNEDLTRTAPIQQQQQRKKPCWNLLGSYLCQRF

SEQ ID NO: 2551 - protein, 97 aa, Eutrema halophilum
MAGVRWREWWNTMAFPTRRIWNRFTVRVGFRHSGLLRLQNDVSSCEYEDIHIMWNLLHKNEIQTPTPTRGARIQQRIQQRKKACWNLLIGSYLCQRF

SEQ ID NO: 2552 - protein, 94 aa, Brassica juncea
MAGLRWREWWNTMAFPSRRIWNRFTVRVGFRHSGLLRLQNDVSSCEYEDIHIMWNLLHKIEDPTPIRGARIQQRIQQRKKACWNLFDSYLCQRF

SEQ ID NO: 2553 - protein, 110 aa, Brassica oleracea
FVVQSLSSLLFSLSSLAQMAGLRWREWWNTMAFPTRRIWNRFTVRVGLRHSGLLRLQNDVSSCEYEDIHIMWNLLHKIEDPTPTPTRVARIKQRKKACWNLFGSYLCQRF

SEQ ID NO: 2554 - protein, 76 aa, Eutrema halophilum
VYLIEAIACNVSFWELGLFYSLSLLSLLSSLSPLSSLVSLFTSSNGRREMERVVEHDGVPHAANLESFHRSRRIPS

SEQ ID NO: 2555 - protein, 120 aa, Brassica rapa
TRVCCTVSSLSLFSLPLLSCLCKLSHMAGLRWREWWNTMAFPARRIWNRFTVRVGFRHSGLLRLQNDVSSCEYEDIHIMWNLLHKIDDPTPIRGARIQQRIQQRKKACWNLFDSYLCQRF

SEQ ID NO: 2556 - protein, 129 aa, Raphanus sativus
  misc_feature (107)..(107): Xaa can be any naturally occurring amino acid
EAIACNVSFGSSVCCTVSLSPLSLSSLLCLCKLSHMAGLRWREWWNTMAFPTRRIWNRFTVRVGFRHSGLLRLQNDVSSCEYEDIHIMWNLLHKIEDPSPTPSTQFXKRIQQKKKACWNLFGSYLCQRF

SEQ ID NO: 2557 - protein, 94 aa, Unknown
  Sequence found in Organisms: Brassica napus, Brassica rapa
MAGLRWREWWNTMAFPARRIWNRFTVRVGFRHSGLLRLQNDVSSCEYEDIHIMWNLLHKIDDPTPIRGARIQQRIQQRKKACWNLFDSYLCQRF

SEQ ID NO: 2558 - protein, 94 aa, Brassica juncea
MAGLRWREWWNTMAFPTRRIWNRFTVRVGFRHSGLLRLQNDVSSCEYEDIHIMWNLLHKIEDQTPTRSAKFNKRIQQKKKACWNLLGSYLCQRF

SEQ ID NO: 2559 - protein, 92 aa, Brassica napus
MAGLRWREWWNTMAFPTRRIWNRFTVRVGLRHSGLLRLQNDVSSCEYEDVHIMWNLLHKIEDPTPTPTRVARIKQRKKACWNLFGSYLCQRF

SEQ ID NO: 2560 - protein, 94 aa, Brassica juncea
MAGLRWREWWNTMAFPSRRIWNRFTVRVGLRHSGLLRLQNDVSSCEYEDIHIMWNLLHKIDDPTPIRGARIQQRIQQRKKACWNLFDSYLCQRF

SEQ ID NO: 2561 - protein, 94 aa, Brassica juncea
MAGLRWREWWKTMAFPARRIWNRFTVRVGFRHSGLLRLQNDVSSCEYEDIHIMWNLLHKIDDPTPIRGARIQQRIQQRKKACWNLFDSYLCQRF

SEQ ID NO: 2562 - protein, 90 aa, Brassica rapa
MTGLRWREWWNTMAFPTRRIWNRFTVRVGLRHSGLLRLQNDVSSCEYEDIHIMWNLLHKIEEPTPTRVARIKQRKKACWNLFGSYLCQRF

SEQ ID NO: 2563 - protein, 224 aa, Arabidopsis lyrata
MANSESSQVNEEEENNQRISTLHHQTMPSELTQDEFTSLSQSIAEFHTYQLGHGRCSSLLAQRIHAPPETVWSVVRRFDRPQIYKHFIKSCFVKEGFEMRVGCTRDVNVISGLPANTSRERLDLLDDDRRVTGFSITGGEHRLRNYKSVTTVHRFEKEDRIWTVVLESYVVDVPEGNSEEDTRLFADTVIRLNLQKLASITEAMNRNNNNAGDGGRNSSSSQVK

SEQ ID NO: 2564 - protein, 434 aa, Arabidopsis lyrata
MSSSAVESVAEQRIRSNDGDGAGEKIENGELHHLLSEPSAPTIYLPTESFLRAATLLKNQVVEAMWKGVVDVLAPGSSPVLDPTVYTGLLGTAFTCLKSYEVTRNHQDLLTCAEIIDTCANVARATTRHVTFLCGRGGVYTLGAIVANYRGDQSKRDFFLGLFLELAEARELPAGPEEGGFGMSYDLLYGRAGFLWAALFLNRYLGQGTVPDHLLSPIVAAILAGGRVGAADHEACPLLYRFHGTRFWGAANGLAGILYVLLHFPLSEEDVKDVQGTLRYMMSNRFPNSGNYPCSEGNPRDKLVQWAHGATGMAITLAKASQVFPKERDFREAAIEAGEVVWKSGLVKKVGLADGVAGNAYAFLSLYRLTGDVLYEERAKAFASYLCHDARDLMNMTRQEAEHDYSLFRGLAGPVCLWFDLVSPVDSRFPGYEI

SEQ ID NO: 2565 - protein, 433 aa, Eutrema halophilum
MSSSAVEFVGEQRRCGDDDNGGETVENGALDHFLLRTSSEPTAPTISLSTETFLRAATLLKDKVVEATWKGGVPGPSLVLDPTVYTGLLGTAFTCLKSYEVTRNRQDLLTCAEIIETCANVARATTRHVTFLCGRGGVYALGAIVANYRGDQSKRDLFLALFLELAEERELPAGPEEGGFGMSYDLLYGRAGFLWAALFLNRYLGEGTVPDHLLSPIIAAILSGGRAGAADHQACPLLYRFHGTRFWGAANGLAGILHVLLHFPLSEDDVEDVQGTLRYMMSNRFPNSGNYPCSEGNPRDKLVQWAHGATGMAITLAKASQVFPKEGDFREAAIEAGEVVWKSGLVKKVGLADGVAGNAYAFLSLYRLTGDVVYEERAKAFASYLCCDARDLVNATMEEAEHDYSLFRGLAGPVCLWFDLVSPVDSKFPGYEI

SEQ ID NO: 2566 - protein, 244 aa, Eutrema parvulum
MSSSAVEFVAEQRRCGEDGNGGETVENGELDHLLLRTTSEPTAPTKFLSTETFLRAATLLKDQVVEATWKGGVPDPGLVLDPTVYTGLLGTAFTCLKSYEVTRNHRDLLTCAEIIDTCANVARATTRHVTFLCGRGGVYALGAVVANYRGDQSKLDFFLGLFLELAEERELPAGPEEGGFGMSYDLLYGRAGFLWAALFLNRYLGEGTVPDLLLLPIVAAILSGGRVGAADHEACPLLYRQISD

SEQ ID NO: 2567 - protein, 433 aa, Brassica napus
MLSSAVEFSAEQARCGEDGNSGETNKNGDLDHFILRTSSEPKVPTTSFLSTDTFLRAATLLKDQVVEATWKGGPDPGLVLDPTVYTGLLGTAFTCLKSYEVTRNHQDLLTCADIIDTCADVARATTRHVTFLCGRGGVYALGAIVASYSGDQSKLDLFLGLFLELAEERELPAGPEEGGFGMSYDLLYGRAGFLWAALFLNRYLGEGTVPDHLLSPIVAAILSGGRVGAADHQACPLLYRFHGTRFWGAANGLAGILHVLLHFPLSEEDVKDVQGTLRYMMSNRFPNSGNYPCSEGNPRDKLVQWAHGATGMAITLAKASQVFPKERDFREAAIEAGEVVWKSGLVKKVGLADGVAGNAYAFLSLYRLTGDVVYEERAKAFASYLCHDARELVSATMGEAEHDYSLFRGLAGPACLWFDLVSPVDSKFPGYEI

SEQ ID NO: 2568 - protein, 433 aa, Brassica rapa
MLSSALEFSAEQARCGEDGNGGETNKNGDLDHFILRTSSEPKVPTTSFLSTDTFLRAATLLKDQVVEATWKGGPDPGLVLDPTVYTGLLGTAFTCLKSYEVTRNHQDLLTCADIIDTCADVARATTRHVTFLCGRGGVYALGAIVASYSGDQSKLDLFLGLFLELAEERELPAGPEEGGFGMSYDLLYGRAGFLWAALFLNRYLGEGTVPDHLLSPIVAAILSGGRVGAADHQACPLLYRFHGTRFWGAANGLAGILHVLLHFPLSEEDVKDVQGTLRYMMSNRFPNSGNYPCSEGNPRDKLVQWAHGATGMAITLAKASQVFPKERDFREAAIEAGEVVWKSGLVKKVGLADGVAGNAYAFLSLYRLTGDVVYEERAKAFASYLCHDARELVSATMGEAEYDYSLFRGLAGPACLWFDLVSPVDSKFPGYEI

SEQ ID NO: 2569 - protein, 432 aa, Brassica juncea
MLSSAVEFSAEQARCGDDGNGGETSKKGDLDHFLLRTSSEPKAPTTSLLSTDTFLRAATLLKDQVVEATWKGGVPDPDLVLDPTVYTGLLGTAFTCLKSYEATRNHQDLLTCADIIDTCADVARATTRHVTFLCGRGGVYALGAIVANYRGDQSKLDLFLGLFLEIAEERELPAGPEEGGFGMSYDLLYGRAGFLWAALFLNRYLGEGTVPDHLLSPIVEAILSGGRVGAADHQACPLLYRFHGTRFWGAANGLAGILHVLLHFPLSEENVKDVQGTLRYMMSNRFPNSGNYPCSEGNPRDKLVQWSHGATGMAITLAKASQVFPKERDFREAAIEAGEVVWKSGLVKKVGLADGVAGNAYAFLSLYRLTGDAVYEERAKAFAGYLCRDARDLATRGEAEHDYSLFRGLAGPACLWFDLASPVDSKFPGYEI

SEQ ID NO: 2570 - protein, 434 aa, Raphanus sativus
MISSAVEFSAEQARCGDDGDGGETNKNGDRDHFIIRTSSEPKAQTTSFLSTDTFLRAATLLKDQVVEATWKRGAPDPSLVLDPTVYTGLLGTAFTCLKSYEVTRNHQDLLTCADIIDTCADVARATTRHVTFLCGRGGVYALGAIVASYRGDQSKLDLFLGLFLELAEERELPAGPEEGGFGMSYDLLYGRAGFLWAALFLNRYLGEGTVPDHLLSPIVAAILSGGRVGAADHQACPLLYRFHGTRFWGAANGLAGILHVLLHFPLSEEDVKDVQGTLRYMMSNRFPNSGNYPCNEGNPRDKLVQWAHGATGMAITLAKASQVFPEERDFREAAIEAGEVVWKSGLVKKVGLADGVAGNAYACLSLYRLTGDVVYEERAKAFASYLCRDGRELVSATMGEAEHDYSLFRGLAGPACLWFDLASPADSKFPGYEI

SEQ ID NO: 2571 - protein, 197 aa, Brassica rapa
MTAIVGVSFGATSSRISIVTPTLSSSSLFPPLTLHQSGNKKESQLRCAVQESSTSAVATEKKEKEDSTVEVPAKKPKPAAAKAAVAKPLREMMEEDVIPPLKAILEAQDDISEIDLSFQDDKLEGFFFKKGIQYSFWAFFPSGNLTGAKGFSISSYGSGPSTVEPFLVDERKPTANHVVFWVEKRLAAQGIIPVWNQ

SEQ ID NO: 2572 - protein, 211 aa, Brassica oleracea
ASGLFELLILSSGLLPNPKLETSVLSICLTTETLHYVISNGVAAAVSTRVANNLGAGSPQVARVSILAGLCLWLIESVFFSTLLFTCRNIIGYAFSNSKEVVDYVADISPLLCISFILDGFTAVLNGVARGSGWQHIGAWNNVVSYYLVGAPVGLYLAFSHGFNGKGLWCGVVVGSAVQATILAIVTTSMDWKKQAEKARKRIISRENGLA

SEQ ID NO: 2573 - protein, 106 aa, Brassica napus
MMEEDVIPPLKAILEAQDDISEIDLSFHDDKLEGFFFKKGIQYSFWAFFPSGNLTGAKGFSISSYGSGPSTVEPFLVDERNPTANHVVFWVEKRLAAQGIIPVWNQ

SEQ ID NO: 2574 - protein, 198 aa, Unknown
  Sequence found in Organisms: Thellungiella halophila, Eutrema halophilum
MAAMAGGTFGVTNSRISITTPTLSSSSLFPPLTLPPGNKKDNQLRCAVQESSTSAVATEKKDKEEKDSTVEVPAKKPKPAAAKAAVVKPLREMMDEDVIPPLKAILEAQDDISDLELSFQDDKLEGYFLKKGIQYSFWAFFPTGNLTGAKGFSISSYGSGPSTVEPFLVDERKPTANHVVFWVEKRLAAQGIIPVWNQ

SEQ ID NO: 2575 - protein, 196 aa, Arabidopsis lyrata
MAAIAGGSFGVPSSRISIATPTLSSSSLLPPLTLQSVTRKDNLLRCAVQESSTSAVTTEKKDKEDKNESTVAVPAKKPKPAAAVAKPLRQMMEEDVIPPLKAILESQDDISEIDLSYQDDKLEGFFLKKSIPYSFWAFFPTGNLTGAKGFSISSHGSGPSTVEPFLVDERKPTANHVVFWVEKRLAAQGIIPVWNQ

SEQ ID NO: 2576 - protein, 234 aa, Brassica juncea
MASLQQTMLSLQSKLPPSSFHIGGSLPMRKTALPLRTRGGNAAGARMSATAAGSYAMALADVAKRNDTLELTSADVEKLEKVFSDPQVLNFFANPTVEVEKKRLVIDEIVKSSSLQSHTSNFLNILVDANRINIVTDIVKEFEMVYNKITDTQLAEVRSVVKLEPPQLAQIAKQVQKLTGAKNVRVKTILDPSLVAGFTIRYGDSGSKLIDMSVKKQLEDIAAQLELGEIQLAA

SEQ ID NO: 2577 - protein, 234 aa, Brassica oleracea
MASLQQTMLSLQSKLPPSSFHIGGSLPMRKTALPLRIRGGNAAGARMSATAAGSYAMALADVAKRNDTLELTSADVEKLEKVFSDPQVLNFFANPTVELEKKRLVIDEIVKSSSLQSHTSNFLNILVDANRINIVTDIVKEFEIVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2578 - protein, 234 aa, Brassica napus
MVSLQQTMLSLQSKLPPSSFHIGGSLPMRKTALPLRIRGGNAAGARMSATAAGSYAMALADVAKRNDTLELTSADVEKLEKVFSDPQVLNFFANPTVELEKKRLVIDEIVKSSSLQSHTSNFLNILVDANRINIVTDIVKEFEIVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2579 - protein, 234 aa, Brassica juncea
MASLQQTMFSLQSKLPPSSFHIGGSLPMRKTTLPLRIRGGNAAGARMSATAAGSYAMALADVAKRNDTLELTSADVEKLEKVFSDPQVLNFFANPTVEVEKKRLVIDEIVKSSSLQSHTSNFLNILVDANRINIVTDIVKEFEMVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2580 - protein, 234 aa, Brassica juncea
MASLQQTMFSLQSKLPPSSFHIGGSLPMRKTTLPLRIRGGNAAGARMSATAAGSYAMALADVAKRNDTLELTSADVEKLEKVFSDPLVLNFFANPTVELEKKRLVIDEIVKSSSLQSHTSNFLNILVDANRINIVTDIVKEFEMVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2581 - protein, 234 aa, Brassica juncea
MASLQQTMFSLQSKLPPSSFHIGGSLPMRKTTLPLRIRGGNAAGARMSATAAGSYAMALADVAKRNDTLELTSADVEKLEKVFSDPQVLNFFANPTVEVEKKRLVIDEIVKSSSLQSHTSNFLNILVDANRINIVTDIVKEFEMVYNKITDTQLAEVRSVVKLEPPQLAQIAKQVQKLTGAKNVRVKTILDPSLVAGFTIRYGDSGSKLIDMSVKKQLEDIAAQLELGEIQLAA

SEQ ID NO: 2582 - protein, 234 aa, Brassica juncea
MASLQQTMFSLQSKLPPSSFHIGGSLPMRKTTLPLRIRGGNAAGARMSATAAGSYAMALADVAKRNDTLELTSADVEKLEKVFSDPLVLNFFANPTVELEKKRLVIDEIVKSSSLQSHTSNFLNILVDANRINIVTDIVKEFEMVYNKITDTQLAEVRSVVKLEPPQLAQIAKQVQKLTGAKNVRVKTILDPSLVAGFTIRYGDSGSKLIDMSVKKQLEDIAAQLELGEIQLAA

SEQ ID NO: 2583 - protein, 226 aa, Brassica napus
LSLQSKLRPSSFHIGGSLPMRKTALPLRTRGGNAAGARMSATAAGSYAMALADVAKRNDTLELTSADVEKLEKVFSDPQVLNFFANPTVELEKKRLVIDEIVKSSALQSHTSNFLNILVDANRINIVRDIVKEFEMVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2584 - protein, 234 aa, Brassica rapa
MASLQQTMLSLQSKLPPSSFQIAKSLPIRRTNLPLRIGGGNAAGTRMSATAAGSYAMALADVAKRNDTLELTSADVEKLEKVFSDPQVLNFFANPTVEVEKKRLVIDEIVKSSSLQSHTSNFLNILVDANRINIVRDIVKEFEMVYNKITDTQLAEVRSVVKLEPPQLAQIAKQVQKLTGAKNVRVKTILDPSLVAGFTIRYGDSGSKLIDMSVKKQLEDIAAQLELGEIQLAA

SEQ ID NO: 2585 - protein, 234 aa, Brassica napus
MASLQQTMLSLQSKLPPSSFQIAKSLPIRRTNLPLRIGGGNAAGARMSATAAGSYAMALADVAKRNDTLELTSADVEKLEKVFSDPQVLNFFANPTVEVEKKRLVIDEIVKSSSLQSHTSNFLNILVDANRINIVRDIVKEFEMVYNKITDTQLAEVRSVVKLEPPQLAQIAKQVQKLTGAKNVRVKTILDPTLVAGFTIRYGDSGSKLIDMSVKKQLEDIAAQLELGEIQLAA

SEQ ID NO: 2586 - protein, 234 aa, Brassica juncea
MASLQQTMFSLQSKLPPSSFQIAKSLPIRRTTLPLRIGGGNATGARMSATAAGSYAMALADVAKRNDTLELTSADVEKLEKVFSDPQVLNFFANPTVELEKKRLVIDEIVKSSSLQSHTSNFLNILVDANRINIVTDIVKEFEMVYNKITDTQLAEVRSVVKLEPPQLAQIAKQVQKLTGAKNVRVKTILDPSLVAGFTIRYGDSGSKLIDMSVKKQLEDIAAQLELGEIQLAA

SEQ ID NO: 2587 - protein, 234 aa, Triticum aestivum
MASLQQTMLSLQSKLPPSSFQIAKSLPIRRTNLPLRIGGGNAAGARMSATAAGSYAMALADVAKRNDTLELTSADVEKLEKVFSDPQVLNFFANPTVEVEKKRLVIDEIVKSSSLQSHTSNFLNILVDANRINIVTDIVKEFEMVYNKITDTQLAEVRSVVKLEPPQLAQIAKQVQKLTGAKNMRVKTILDPSLVAGFTIRYGDSGSKLIDMSVKKQLEDIAAQLELGEIQLAA

SEQ ID NO: 2588 - protein, 234 aa, Brassica juncea
MASLQQTMLSLQSKLPPSSFQIAKSLPIRRTNLPLRIGGGNAAGARMSATAAGSYAMALADVAKRNDTLELTSADVEKLEKVFSDPQVLNFFANPTVEVEKKRLVIDDIVKSSSLQSHTSNFLNILVDANRINIVRDIVKEFEMVYNKITDTQLAEVRSVVKLEPPQLAQIAKQVQKLTGAKNVRVKTILDPTLVAGFTIRYGDSGSKLIDMSVKKQLEDIAAQLELGEIQLAA

SEQ ID NO: 2589 - protein, 234 aa, Brassica rapa
MASLQQTMLSLQSKLPPSSFQIAKSLPIRRTNLPLRIGGGNAAGTRMSATAAGSYAMALADVAKRNDTLELTSADVEKLEKVFSDPQVLNFFANPTVEVEKKRLVIDEIVKSSSLQSHTSNFLNILVDANRINIVRDIVKEFEMVYNKITDTQLAEVRSVVKLEPPQLAQIAKQVQKLTGAKNVRVKTILDPSLVAGFTIRYGDSGSKLIYMSVKKQLEDIATQLELGEIQLAA

SEQ ID NO: 2590 - protein, 234 aa, Raphanus sativus
  misc_feature (23)..(23): Xaa can be any naturally occurring amino acid
MASLQQTMFSLQSKLPPSSFHIXGSLPMRKTSLPLRIRGGNAAGARMSATAAGSYAMALADVAKRNDTLELTSADVEKLENVFSDPQVLNFFANPTVEVEKKRLVIDEIVKASSLQTHTSNFLNLLVDANRVDIVTDIVKEFEIVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2591 - protein, 234 aa, Raphanus sativus
  misc_feature (28)..(28): Xaa can be any naturally occurring amino acid
  misc_feature (229)..(229): Xaa can be any naturally occurring amino acid
MASLQQTMFSLQSKLPPSSFHIGGSLPXRKTALPLRIRGGNAAGARMSATAAGSYAMALADVAKRDDTLELTSADVEKLENVFSDPQVLNFFANPTVEVEKKRLVIDEIVKASSLQIHTSNFLNLLVDANRVDIVTDIVKEFEIVYNKITDTQLAEVRSVVKLEPPQLAQIAKQVQKLTGAKNVRVKTVLDPSLVAGFTIRYGDSGSKLIDMSVKKQLEDIAAQLELGXIQLAA

SEQ ID NO: 2592 - protein, 235 aa, Raphanus sativus
  misc_feature (118)..(118): Xaa can be any naturally occurring amino acid
MASLQQTMFSLQSKFPPSSFHIGGSLPIRKKTTLPLRIRGGNAAGARMSATAAGSYAMALADVAKRNDTLELTSADVEKLEKVFSDPQVLNFFVNPTVEVEKKRLVIDEIVKASSLQXHTSNFLNLLVDANRVDIVTDIVKEFEIVYNKITDTQLAEVRSVVKLEPPQLAQIAKQVQKLTGAKNVRVKTVLDPSLVAGFTIRYGDSGSKLIDMSVKKQLEDIAAQLELGEIQLAA

SEQ ID NO: 2593 - protein, 234 aa, Unknown
  Sequence found in Organisms: Thellungiella halophila, Eutrema halophilum
MASLQQTLFSLQSKLPPSSFQIARSLPMRKTTLPLRIGGGNAAGARMSATAAGSYAMALADVAKRNDTLELTSADVEKLEKVFSDPQVLNFFANPTVEVEKKRLVIDEIVKSSSLQSHTSNFLNVLIDANRISIVTEIVKEFEMVYNKITDTQLAEVRSVVKLEPPQLAQIAKQVQKLTGAKNVRVKTVIDPSLVAGFTIRYGDSGSKLIDMSVKKQLEDIAAQLELGEIQLAT

SEQ ID NO: 2594 - protein, 234 aa, Eutrema parvulum
MASLQQTLFSLQSKLPPSSFQIARSLPMRKTTLPLRIGGGNAAGARMSATAAGSYAMALADVAKRNDTLELTSADVEKLEMVFSDPQVLNFFANPTVEVEKKRLVIDDIVKSSSLQSHTSNFLNILVDANRINIVTEIVKEFEIVYNKITDTQLAEVKSVVKLEPPQLAQIAKQVQKLTGAKNVRVKTVIDPSLVAGFTIRYGDSGSKLIDMSVKKQLEDIAAQLELGEIQLAA

SEQ ID NO: 2595 - protein, 235 aa, Raphanus sativus
MASLQQTMFSLQSKLPPSSFQIAKSLPIRRTTLPLRISGGNAAGARMSATAAGSYAMALADVAKKNDTLESTSADIEKLEKVFSDPQVLNFFANPTVELEKKRLVIDEIVESSSLQSHHTSNFLNILVDANRIDIVTDIVKEFEMVYNKITDTQLAEVRSVVKLEEPQLAQIAKQVRKLTGAKNVRVKTVLDPSLVAGFTIRYGDSGSKLIDMSVKKQLEDIAAQLELGEIQLAA

SEQ ID NO: 2596 - protein, 233 aa, Arabidopsis lyrata
MASLQQTLFSLQSKLPPSSFQIARSLPLRKTFPIRINNGNAAGARMSATAASSYAMALADVAKRNDTMELTVADIEKLDQVFSDPQVLNFFANPTITVEKKRQVIDDIVKSSSLQSHTSNFLNVLVDANRINIMTEIVKEFELVYNKLTDTQLAEVRSVVKLEPPQLAQIAKQVQKLTGAKNVRVKTVIDPSLVAGFTIRYGDSGSKLIDMSVKKQLEDIAQQLELGEIQLAT

SEQ ID NO: 2597 - protein, 234 aa, Arabidopsis thaliana
MASLQQTLFSLQSKLPPSSFQIARSLPLRKTFPIRINNGGNAAGARMSATAASSYAMALADVAKRNDTMELTVTDIEKLEQVFSDPQVLNFFANPTITVEKKRQVIDDIVKSSSLQSHTSNFLNVLVDANRINIVTEIVKEFELVYNKLTDTQLAEVRSVVKLEAPQLAQIAKQVQKLTGAKNVRVKTVIDASLVAGFTIRYGESGSKLIDMSVKKQLEDIASQLELGEIQLAT

SEQ ID NO: 2598 - protein, 235 aa, Cleome spinosa
MASLHQTLVSMQSKLLPSSAQISRSLPLRMTFPLRIGRRGGGAAGARMSATAAGSYATALADVAKSNNTLDTTSADVEKIEKVFSDQQVVDFFANPTVDVEKKRQVLDEIVKSSSLQPHTANFLNILVDANRIEIVTEIVKEFEAVYNTLTDTELAVVSSVVKLEPPQLAQIAKQVQKLTGAKNVRVKTVIDPDLVAGFTIRYGNSGSKLIDMSVKKQLEDIAAQLDLGEIQLAT

SEQ ID NO: 2599 - protein, 376 aa, Brassica rapa
MELPLLSYTNSASFSRTGLCSSSSSSSSTSINDFLERRRSLRMRLNGGETSRSVKTFAGRSSEGIEKTDGGVGGGGQFAGPAMEVTTLDRGFANSTTVDFPIWDKIGAVVRLTYGIGIYGAMAVAGRFICSVTGIDSSGGFDPSLDALLSGLGYATPPIMALLFILDDEVVKLSPHARAIRDVEDEELRSFFFGMSPWQFILIVVASSVGEELFYRVAVQGALSDIFLRGTQLMTDSRGMAALTGVFPPFVPFAQAFAAVITATLTGSLYFLAASPKDPIYIVAPVLRSRRDDFKKLLSAWYEKRQMKKIYSPLLEGLLALYLGIEWVQTDNILAPMMTHGIYSAVILGNGLWKIHDHRRRLRQRIERIRSESGDQ

SEQ ID NO: 2600 - protein, 376 aa, Brassica napus
MELPLLSYTNSASFSRTGLCSSSSSSSSTSINDFLERRRSLRMRLNGGETSRSVKTFAGRSSEGIEKTDGGVGGGGQFAGPAMEVTTLDRGFANSTTVDFPIWDKIGAVVRLTYGIGIYGAMAVAGRFICSVTGIDSSGGFDPSLDALLAGLGYATPPIMALLFILDDEVVKLSPHARAIRDVEDEELRSFFFGMSPWQFILIVVASSVGEELLYRVAVQGALSDIFLRGTQLMTDSRGMAALTGVFPPFVPFAQAFAAVITATLTGSLYFLAASPKDPIYIVAPVLRSRRDDFKKLLSAWYEKRQMKKIYSPLLEGLLALYLGIEWVQTDNILAPMMTHGIYSAVILGNGLWKIHDHRRRLRQRIERIRSESGDQ

SEQ ID NO: 2601 - protein, 232 aa, Brassica rapa
  misc_feature (215)..(215): Xaa can be any naturally occurring amino acid
  misc_feature (231)..(231): Xaa can be any naturally occurring amino acid
MELPLLSYTNSASFSRTGLCSSSSSSSSTSINDFLERRRSLRMRLNGGETSRSVKTFAGRSSEGIEKTDGGVGGGGQFAGPAMEVTTLDRGFANSTTVDFPIWDKIGAVVRLTYGIGIYGAMAVAGRFICSVTGIDSSGGFDPSLDALLSGLGYATPPIMALLFILDDEVVKLSPHARAIRDVEDEELRSFFFGMSPWQFILIVVASSVGEELFXRVAVQGALSDIFLREXN

SEQ ID NO: 2602 - protein, 375 aa, Brassica napus
MELPLLSYTNSASFSRTGLCSSSSSSSSSTSINEFLERRRNLRMIFNGGETSRSVKASAGRSSEGIEKTDGGGARQFAGPAMEVTKLDRGFANSKTVDFPIWDKIGAVVRLTYGIGIYGAMAVAGRFICSVTGIDSSGGFDPSLDALLAGLGYATPPIMALLFILDDEVVKLSPHARAIRDVEDEELRSFFFGMSPWQFILIVVASSVGEELFYRVAVQGALSDMFLRGTQLMTDPRGMASLTGVFPPFVPFSQAFAAVITATLTGSLYFLAASPKDPIYIVAPVLRSRRDDFKKLLSAWYEKRQMKKIYSPLLEGLLALYLGIEWVQTDNILAPMMTHGIYSAVILGNGLWKIHDHRRRLRQRIERIRSESGDQ

SEQ ID NO: 2603 - protein, 372 aa, Brassica juncea
MELPLLSYTNSASFSRTGICSTSSSSTSINGFLERRRCLRMRFNGGENARSVKASAGRSSEGMEKTDSSGGGGFAGPVMEVTTLDRGFANSTTVDFPVWDKIGAVVRLTYGIGIYGAMAVAGRLICSVTGIDSSGGFDPSLDALLAGLGYATPPIMALLFILDDEVVKLSPHARAIRDVEDEELRSFFFGMSPWQFILIVAASSIGEELFYRVAVQGALSDIFLKGTQLMTDSRGMASLTGVLPPFVPFAQAFAAVITATLTGSLYFLAASPKDPTYIVAPVLRSRRDDFKKLLSAWYEKRQMKKIYSPLLEGLLALYLGIEWVQTDNILAPMMTHGIYSTVILGHGLWKIHDHRRRLRRRIERLRSETADE

SEQ ID NO: 2604 - protein, 374 aa, Brassica rapa
MELPLLSYTNSASFSRTGICSTSSSSTSINDFLERRRSLRMRFNGGDNPRSVKASAGRSSEGMEKTDSSGGGARQFAGPVMEVTTLDRGFANSTTVDFPVWDKIGAVVRLTYGIGIYGAMAVAGRVICSVTGIDSSGGFDPSLDALLAGLGYATPPIMALLFILDDEVVKLSPHARAIRDVEDEELRGFFFGMSPWQFILIVAASSIGEELFYRVAVQGALSDIFLKGTQLMTDSRGMASLTGVLPPFVPFAQAFAAVITATLTGSLYFLAASPKDPTYIVAPVLRSRRDDFKKLLSAWYEKRQMKKIYSPLLEGLLAFYLGIEWVQTDNILAPMMTHGIYSTVILGHGLWKIHDHRRRLRRRIERLRSETADE

SEQ ID NO: 2605 - protein, 374 aa, Brassica napus
MELPLLSYTNSASFSRTGICSTSSSSTSINDFLERRRSLRMRFNGGDNPRSVRASAGRSSEGMEKTNSSGGGARQFAGPVMEVTTLDRGFANSTTVDFPVWDKIGAVVRLTYGIGIYGAMAVAGRVICSVTGIDSSGGFDPSLDALLAGLGYATPPIMALLFILDDEVVKLSPHARAIRDVEDEELRGFFFGMSPWQFILIVAASSIGEELFYRVAVQGALSDIFLKGTQLMTDSRGMASLTGVLPPFVPFAQAFAAVITATLTGSLYFLAASPKDPTYIVAPVLRSRRDDFKKLLSAWYEKRQMKKIYSPLLEGLLAFYLGIEWVQTDNILAPMMTHGIYSTVILGHGLWKIHDHRRRLRRRIERLRSETADE

SEQ ID NO: 2606 - protein, 377 aa, Brassica napus
MELPLLSYTNSASFCRTGICSSSSSSSSTSISDFPEIRRSLRMRLNGGENSRSVKASAGRSTEGMEKTDSSGGGGARQFAGPVMEVTTLDRGFANSTTVDFPVWDKIGAVVRLTYGIGIYGAMAVAGRVICSVTGIDSSGGFDPSLDALLAGLGYATPPIMALLFILDDEVVKLSPHARAIRDVEDEELRGFFFGMSPWQFILIVAASSIGEELFYRVAVQGALSDIFLKGTQLMTDSRGMASLTGVLPPFVPFAQAFAAVITATLTGSLYFLAASPKDPTYIVAPVLRSRRDDFKKLLSAWYEKRQMKKIYSPLLEGVLAFYLGIEWVQTDNILAPMMTHGIYSTVILGHGLWKIHDHRRRLRRRIERLRSETADE

SEQ ID NO: 2607 - protein, 382 aa, Eutrema parvulum
MELPLLSYTNSASFSRTGLCSSSSSSSTGISDFPERRSLRLRLNGGEKSRSVKASAGRSSEGIDKTDGVSGGGGGGGGTRQFAGPAMEVTTFDRGFANSTTVDFPIWDKIGAVVRLTYGIGIYGAMAVAGRIICSVTGIDSSGGFDPSLDALLAGIGYATPPIMALLFILDDEVVKLSPHARAIRDVEDAELRSFFFGMSPWQFILIVVASSIGEELFYRVAVQGALSDMFLRGTQLMTDSRGMASLTGVLPPFVPFAQAFAAVITATLTGSLYFLAASPKDPTYIVAPVLRSRRDDFKKLLSAWYEKRQMKKIYSPLLEGLLALYLGIEWVQTDNILAPMMTHGIYSAVILGHGLWKIHDHRRRLRRRIERIKSETTDEQF

SEQ ID NO: 2608 - protein, 367 aa, Raphanus sativus
MELPLLSYTNSVTFSRTGICSSSSSSSTSIRNFPGKRMSLGMGFNNSRSVKASAGRSTEGVEKTDGGQFAGPVMEVTTLDRGFANSTTVDFPVWDKIGAVVRLTYGIGVYGAMAVAGRFICSVTGIDSSGGFDPSLDALLAGLGYATPPIMALLFILDDEVVKLSPHARAIRDVEDEELRSFFFGMSPWQFILIVAASSIGEELFYRVAVQGALSDIFLKGTQLMTDSRGMASLTGVLPPFVPFAQAFAAVITATLTGSLYFLAASPKDPTYIVAPVLRSRRDDFKKLLSAWYEKRQMKKIYSPLLEGLLALYLGIEWVQTDNILAPMMTHGIYSTVILGHGLWKIHDHRRKLRRRIERLRSETADE

SEQ ID NO: 2609 - protein, 371 aa, Arabidopsis lyrata
MELPLLSYASSASFSRTGFYSSSSSTSICEFPERRRSFRMRFNGGERSRSVIASAERSSEGIEKTDGGGGFAGTAMEVTTLDRGFANSTTVDFPIWDKIGAVVRLTYGIGIYGAMAVAGRFICSVTGIDSSGGFDPSLDALLAGLGYATPPIMALLFILDDEVVKLSPHARAIRDVEDEELRSFFFGMSPWQFILIVAASSIGEELFYRVAVQGALSDIFLKGTQLMTDSRGMASLTGVFPPFVPFAQAFAAVITATLTGSLYFLAASPKDPTYIVAPVLRSRRDDFKKLLSAWYEKRQMKKIYSPLLEGLLALYLGIEWVQTDNILAPMLTHGIYSAVILGHGLWKIHDHRRRLRRRIERIRSEATDKLI

SEQ ID NO: 2610 - protein, 379 aa, Eutrema halophilum
MELPLLSYTNSASFSRTGLCSSSSSASVSDLTERRRNLRMRFNGGENSRIVKASAGRSSEGIDKTDGVSGGGGGGTRQFAGPAMEVTTLDRGFANSTTVDFPIWDKIGAVVRLTYGIGVYGAMAVAGRFICSVTGVDSSGGFDPSLDALLAGLGFATPPIMALLFILDDEIVKLSPHARAIRDVEDEELRSFFFGMSPWQFILIVVASSIGEELFYRVAVQGALSDMFLRGTQLMTDSRGMASLTGVLPPFVPFAQAFAAVITATLTGSLYFLAASPKDPAYIVAPVLRSRRDDFKKLLSAWYEKRQMKKIYSPLLEGLLALYLGFEWIQTDNILAPMMTHGIYSAVILGHGLWKIHDHRRRLRRRIERVRTETTNEQF

SEQ ID NO: 2611 - protein, 503 aa, Brassica rapa
MEEAQTLTFTLIFVVLTLIFFIVTNRTKKRKPKLPPSPPFALPVIGHLRLLKPPLHRVFYSISQSLGGAPIFSLRLGSRLVFVVSSHSIAEECFTKNDVVLANRPNTIASKYVSYDHTTMVTAPYGEHWRNLRRIGAVEIFSAHRLNKFLSIRQDEVRRLIVRLSRNSSYEFAKVEINSMFSDLTFNNIIRMVAGKRYYGDVSEENSEAKLVRQLIADLMSIFGAGNAADYVPILRWVTGFEKRVKELGGRFDEFLQGLVDERRAAKEKGNTMIDHLLSLQETQPGYYTDRTIKGTILSLILAGTDTSAVTLEWALSSLLNHPEKLRKAREEIDCKIGLDRLVEESDISNLPCLQNIVSETLRLYPAGPLMVPHVASEDCKVGGYDMPQGTTLLVNLWAMHRDPQLWDDPETFKPERFEKEGEAHKLMTFGLGRRACPGSGLAQRLVSLTLASLIQCFEWERIGEEEVDMTEAGGATMPKARPLVAMCTARTTLVGKILHESA

SEQ ID NO: 2612 - protein, 502 aa, Brassica napus
MEEAQTLTFTLIFIVLTLIFFIVRNRTKRKPKLPPSPPFALPVIGHLRLLKPPLHRVFYSISQSLGGAPIFSLRLGSRLVFVVSSHSIAEECFTKNDVVLANRPNTIASKYVSYDHTTMVTAPYGEHWRNLRRIGAVEIFSAHRLNKFLSIRQDEVRRLIVRLSQNSSHEFAKVEINSMFSDLTFNNIIRMVAGKRYYGDGAEENSEAKLIRQLIADLMNIFGAGNAADYVPILRWVTGFEKRVKELAGRFDEFLQGLVDERRSAKEKGNMMIDHLLSLQETQPEYYTDCTIKGTILSLILAGTDTSAVTLEWALSSLLNHPEKLRKAREEIDSKIGLDRLVEESDISNLPCLQSIVSETLRLYPAGPLMVPHVASEDYKVGGYDMPQGTTLLVNLWAMHRDLQLWDDPETFKPERFEKEGEAHKLMTFGLGRRACPGSGLAQRLVSLTLASLIQCFEWERTGEEEVDMTEAGGVTMPKARPLVAMCRTRTTLVGKIVHESA

SEQ ID NO: 2613 - protein, 715 aa, Brassica napus
MPLMGGPKSVDPAKRIFFSSKSYIPSATPEPLKKLRKEELETLQGNNRKKVGEFEKHERVYDYDVYNDVGDPDKNDELARPVIGGLSHPYPRRCKTGRKSSKKDPSTEKREGDFYVPRDEEFSTTKGTAFTGKAILAALPSVFTQLESILLDPKSPFPHFKSIEDLFDVGINLPKDAGLLPMLPKLIKVLSEAQDDLLQFDPPILLNKDRFSWIRDDEFARQTLAGLNPYCIQLVTEWPLQSKLDPAVYGDPNSLITWEIVEKEIRGVMSVDEALKNKRLFMLDYHDLLLPYVNKVRELDDTMLYASRTLFFLSDDSTLRPVAIELTRPPDVNRPQWKQVFTPGYDATSCWLWKLAKTHVVAHDAGYHQLISHWLRTHCCMEPYIIAANRQLSAMHPIYRLLHPHFRYTMEINARARQSLVNAGGIIETCFWPGKYSLELSSDVYGKLWRFDKEGLPADLINRGLAVEDEKAEHGVRLTIPDYPFANDGLMLWDALKEWITDYVNHYYPDAGLITSDEELQAWWSEVKNIGHGDKKDEPWWPELKTQDDLIGVATTIAWVASGHHAAVNFGQYGYGGYFPNRPTTTRRRMPVEEPTEEELKEFYEEPEKVLLKTFPSQKQATQVMVTLDLLSTHSPDEEYLGEEPEASWIDEPVIFAAYERFKGRLQYLEGVIDERNVNVSLKNRAGAGVVKYELLKPISEPGCTGMGVPYSVSI

SEQ ID NO: 2614 - protein, 374 aa, Triticum aestivum
MPLMGAPKSVDPAKRIFFSSKSYIPSATPETLKKLRKEELETLQGKNRKKVGEFAKHERVYDYDVYNDVGDPDKDDELARPVIGGLSHPYPRRCKTGRKRSDKDPSTEKREGDFYVPRDEEFSTTKGTAFTGKAILAALPSVFTQVESILLDPKSPFPHFKSIEDLFDVGINLPKDAGLLPMLPKLIKVISEAQDDLLQFDPPILLNKDRFSWIRDDEFARQTLAGLNPYCIQLVTEWPLQSKLDPAVYGDPNSLITWEIVEKEIRGVMSVDEALKNKRLFMLDYHDLLLPYVNKVRELDDTMLYASRTLFFLSDDSTLRPVAIELTRPPDVNRPQWKQVFTPGYELPPAGYGNLLRLTLLLMMPVIISLFPTG

SEQ ID NO: 2615 - protein, 901 aa, Eutrema parvulum
MFCKESSSLQTLSIAKSCSSIFPKPSALINPILAGRRDKLCRRRNLGGGCKVTASQSNIEQKGKIVKEKVKKIKVKGFITAEEGSLLEGLGWSRPLDDITDIRGRSLLVELISAETDTRTLMEKDPVEDYAQRVWFESPDEKYECVFDMPEDFGTVGAIRIQNQHHKEMFIKEMELELPSGSVTFTCNSWVTPKSVDPSKRIFFSNKSYLPSTTPEPLKKLRKEELETLQGNNRKRVGEFTKYERVYDYDVYNDVGDPDRDEELARPVIGGLSHPYPRRCKTGREPCDKDPSTEKRHGDFYVPRDEEFSTTKGTAFTGKAILAALPSIFPQIESALLDPNLPFPHFKSIEDLFEIGIELPKDAGLLPMIPRLIKAVAEAQDDLLQFHPPILLNKDRFSWIRDDEFARQTLAGLNPYCIQLITEWPLKSKLDPAVYGDPNSLITWDVVEKEIRGVMSVDEALKNKKLFVLDYHDLLLPYVNKVRELDDTTLYASRTIFFLSDDSTLRPVAIELTRPPDVNRSQWRQVFTPGYDATSCWLWSLAKTHAVAHDAGYHQLISHWLRTHCCIEPYIIAANRQLSAMHPIYRLLHPHFRYTMEINARARQSLVNAGGIIETCFWPGKYSLELSSDVYGKLWRFDREGLPADLISRGLAVEDETAEHGLRLTIPDYPFANDGLMLWDALKEWITDYVKHYYPDAGLIMLDEELQGWWSEVRNIGHGDKKDEPWWPVIRTQDDLIEVVTTIAWVASGHHAAVNFGQYGYGGYFPNRPTTTRTRMPMEEPTEEELKEFYEEPEKVLLKTFPSKKQATQVMVTLDLLSTHSPDEEYLGENPEASWASDPVIFAAYERFKARLQYLEGVIDERNVNVSLKNRAGAGVVKYELLKPISKPGVTGMGVPYSVSI

SEQ ID NO: 2616 - protein, 534 aa, Brassica napus
MLPKLIKVISEAQDDLLQFDPPILLNKDRFSWIRDDEFARQTLAGLNPYCIQLVTEWPLQSKLDPAVYGDPNSLITWEIVEKEIRGVMSVDEALKNKRLFMLDYHDLLLPYVNKVRELDDTMLYASRTLFFLSDDSTLRPVAIELTRPPDVNRPQWKQVFTPGYDATSCWLWKLAKTHVVAHDAGYHQLISHWLRTHCCMEPYIIAANRQLSAMHPIFRLLHPHFRYTMEINARARQSLVNAGGIIETCFWPGKYSLELSSDVYGKLWRFDKEGLPADLINRGLAVEDEKAEHGVRLTIPDYPFANDGLMLWDALKEWITDYVNHYYPDAGLITSDEELQAWWSEVKNIGHGDKKDEPWWPELKTQDDLIGVATTIAWVASGHHAAVNFGQYGYGGYFPNRPTTTRRRMPVEEPTEEELKEFYEEPEKVLLKTFPSQKQATQVMVTLDLLSTHSPDEEYLGEEPEASWVDEPVIFAAYERFKGRLQYLEGVIDERNVNVSLKNRAGAGVVKYELLKPISEPGVTGMGVPYSVSI

SEQ ID NO: 2617 - protein, 900 aa, Brassica rapa
MFCKESPSLQTLSTAQSLSSLFPKPSALINPILTGRRDKPCRRQNFRGRCRITASQFNIAQKGKLLKEKVKRIKVKGFITAEEGLLESLSWLRPLDVITDIRGRSLLVELISAETDTRTVMEEGPVEDYAQRVWFESRNEKYECVFDMPEDFGTVGAIRVQNQHRREMFIKEMKLELPSGSVTFTCNSWVTPKSIDPTKRIFFSNKSYLPSATPEPLKKLRKEELETLQGNNRERVGEFAKYERVYDYDVYNDVGDPDKDERLARPVMGGLSHPYPRRCKTGRKPCEKDASSEKREGEFYVPRDEEFSSTKGTAFTGKAILAALPSVFPQIEAALLDPNLPFPHFKSIEDLYEVGIDIPKDAGLLPMIPKLIKVVAEAQDNLLQFDPPILLNKDRFSWIRDDEFARQTLAGLNPYCIQLVTEWPLKSKLDPAVYGDPKSLITWDIVEKEIRGVMSVDEALKNKRLFMLDYHDLLLPYVNKVRELDDTTLYASRTLFFLSDDSTLRPVAIELTRPPDVNRPQWSQVFTPGYDATSCWLWNLAKTHAVAHDAGYHQLISHWLRTHCCMEPYIIAANRQLSAMHPIYRLLHPHFRYTLEINARARQSLVNAGGIIETCFWPGKYSLELSSDVYAKLWRFDREGLPADLISRGLAVEDETAEHGLRLTIPDYPFANDGLMLWDALKEWITESVKHYYPDAALITCDEELQAWWSEVRNIGHGDKKDEPWWPVLRTQDDLIGVVTTIAWVASGHHAAVNFGQYGYGGYFPNRPTTTRIRMPVEEPTEEELKEFYEEPEKVLLKTFPSQKQATQVMGTLDLLSTHSPDEEYLGEEPEASWVDDPVIFAAYERFKGRLKHLEDVIDERNVNVSLKNRAGAGVVKYELLKPISQPGVTGMGVPYSVSI

SEQ ID NO: 2618 - protein, 213 aa, Eutrema halophilum
MFCRESSSSLQTLNIAKSVNSLFPNPSALIKPISVGGRDKLCRRRRQNLGGRCKVTSSQSNIDQKAKIVKEKVKKIKVKGYITAKEGTLLEGLGWTRPLDDITDIRGRSLLVELISTKTDTHTLMEKDPVEDYAQRVWFEAPDEKYECVFDMPEDFGTVGAIRVQNQHHKEMFIKEMELELPSGSVTFTCNSWVTPKSGSSQANILLQQVLLA

SEQ ID NO: 2619 - protein, 869 aa, Brassica napus
ILTGRRDNPCRRQNFRGRCKITASQSNIAQKGKLLKEKVKRIKVKGFITAEEGLLESLSWSRPLDVITDIRGRSLLVELISAETDTRTVMEEDPVEDYAQRVWFESRNEKYECVFDMPEDFGTVGAIRVQNQHHREMFIREMKLELPSGSVTFTCNSWVTPKSIDPTKRIFFSNKSYLPSATPEPLKKLRKEELETLQGNNRERVGEFAKHERVYDYDVYNDVGDPEKDERLARPVMGGLSYPYPRRCKTGRKPCEKDASSEKREGEFYVPRDEEFSTTKGTAFTGKAILAALPSVFPQIEAALLDPNLPFPHFKSIEDLYQVGIDIPKDAGLLPMIPKLIKVVAEAQDNLLQFEPPILLNKDRFSWIRDDEFARQTLAGLNPYCIQLVTEWPLKSKLDPAVYGDPKSLITWDIVEKEIRGVMSVDEGLKNKRLFMLDYHDLLLPSVNKVRELDDTTLYASRTLFFLSDDSTLRPVAIELTRPPDVNRPQWSQVFTPGYDATSCWLWNLAKTHAVAHDAGYHQLISHWLRTHCCMEPYIIAANRQLSAMHPIYRLLHPHFRYTLEINARARQSLVNAGGIIETCFWPGKYSLELSSDVYAKLWRFDREGLPADLISRGLAVEDETAEHGLRLTIPDYPFANDGLMLWDALKEWITEYVKHYYPDAALIMCDEELQAWWSEVRNIGHGDKKDEPWWPVLRTQDDLIGVVTTIAWVASGHHAAVNFGQYGYGGYFPNRPTTTRIRMPVEEPTEEELKEFYEEPEKVLLKTFPSQKQATQAMVTLDLLSTHSPDEEYLGEEPEASWVDDPVIFAAYERFKGRLKHLEEVIDERNVNVSLKNRAGAGVVKYELLKPISQPGVTGMGVPYSVSI

SEQ ID NO: 2620 - protein, 896 aa, Arabidopsis lyrata
MFCRESLSSLQTLSVAKSLSSLFPKQSALINPISTGRRNNLPRPNLRRRCKVTTSRSNIEQEGNIVKEPIQKIKVKGYITAQEEFLEGITWSRGLDDIADIRGRSLLVELISAKSDQRITVEDYAQRVWAEAPDEKYECEFEMPEDFGPVGAIKVQNQYHRQLFLQGMELELPGGSVTFTCESWVAPKNVDPTKRIFFSNQSYLPSETPEPLKKYRKEELETLQGKNREQVGEFTKFERIYDYDVYNDVGDPDNDPELARPVIGGLQHPYPRRCKTGRKPCETDPSSEQRYGGEFYVPRDEEFSTAKGTSFTGKAVLAALPSVFPQIESVLLDPQSPFPHFKAIQNLFEEGIQLPKDAGLLPLLPRIIKALGEAQDDILQFEAPVLINRDRFSWLRDDEFARQTLAGLNPYSIQLVEEWPLKSKLDPAVYGDPTSLITWEIVEKEVKGNMTVDEALKNKRLFVLDYHDLLLPYVNKVRELDNTTLYASRTLFFLSDDSTLRPVAIELTCPPNVNKPQWKQVFTPGYDATSCWLWNLAKTHAISHDAGYHQLISHWLRTHCCTEPYIIAANRQLSAMHPIYRLLHPHFRYTMEINARARQSLVNAGGIIETCFWPGKYSLELSSAVYGKLWRFDKEGLPADLIGRGLAVEDETAEHGLRLRIPDYPFANDGLILWDALKEWVTDYVKHYYPDDGLITSDDELQGWWHEVRTIGHGDKKDEPWWPVLKTQDDLIGVVTTIAWVTSGHHAAVNFGQYGYGGYFPNRPTTTRRRMPVEDPTDEDLKEFYESPEIVLLKTYPSQKQATLVMVTLDLLSTHSPDEEYIGQQPEASWANDPVINAAFEKFKGKLQYLEGVIDERNVNVTLKNRAGAGVVKYELLKPLSDHGVTGMGVPYSISI

SEQ ID NO: 2621 - protein, 397 aa, Hordeum vulgare
MLATASPHLHAAAHRLSLAAPARAARSARLPLRRPLRYPSLRLRASAAAEAAPSAKEGAEALGFEEMAARTTRRYYMLGGKGGVGKTSCAASLAVRFANSGHPTLVVSTDPAHSLSDSFAQDLTGGALAPVEGTDSPLFALEINPEKSREEFRTINQKNGGTGVKDFMDGMGLGILAEQLGELKLGELLDTPPPGLDEAIAISKVIQFLEAPEYSMFSRIVFDTAPTGHTLRLLSLPDFLDASIGKILKLRSKIASATSAIKSVFGQEVQQQDAANKLEQLRERMVKVRELFRDTESTEFIIVTIPTVMAISESARLHSSLQKESVPVRRLIVNQVLPPSSSDCKFCAIKRKDQTRALDMIKSDPELMGLNIMQAPLVDMEIRGVPALKFLGDIVWK

SEQ ID NO: 2622 - protein, 397 aa, Triticum aestivum
MLATASPHLHAAAHRLSLAAPARAARSARLPLRRPLRYAPLRLRASAAAEAAPSAKEGAEELGFEEMVARTTRRYYMLGGKGGVGKTSCAASLAVRFANSGHPTLVVSTDPAHSLSDSFAQDLTGGALAPVEGTDSPLFALEINPEKSREEFRTINQKNGGTGVKDFMDGMGLGILADQLGELKLGELLDTPPPGLDEAIAISKVIQFLEAPEYSMFSRIVFDTAPTGHTLRLLSLPDFLDASIGKILKLRSKIASATSAIKSVFGQEVQQQDAANKLEQLRERMVKVRELFRDTESTEFIIVTIPTVMAISESARLHSSLQKESVPVRRLIVNQVLPPSSSDCKFCAIKRKDQARALDMIKSDPELMGLNIMQAPLVDMEIRGVPALKFLGDIVWK

SEQ ID NO: 2623 - protein, 401 aa, Setaria italica
MLATATPGLHAAVRRLTLAAPAAAAQVRCVVRLPQRRPGRSASLRAVASAAAAEAAPPAKDGAEELGFQEMTSGTRRRYYMLGGKGGVGKTSCAASLAVRFANDGHPTLVVSTDPAHSLSDSFAQDLTGGSLVQVEGPDAPLFALEINPEKAREEFRTASQKNGGTGVKDFMDSMGLGVLVEQLGELKLGELLDTPPPGLDEAIAISKVMQFLEAQEYSMFSRIVFDTAPTGHTLRLLSLPDFLDASIGKILKLRSKIASATSAIKSVFGQEVQQQDAANKLEQLRERMVKVRELFRDTESTEFIIVTIPTVMAISESSRLHSSLQKESVPVRRLIVNQVLPPSTSDCKFCAIKRKDQTRALDMIRSDPELMGLNIIQAPLVDMEIRGVPALKFLGDIVWK

SEQ ID NO: 2624 - protein, 403 aa, Sorghum bicolor
MLATASPHLQAAAARRLSLAVPVNQGCSSVRLPRRRPGRYASVRAASASASASASAAAPPAKEGAEDLGFQEMSSGTRRRYYMLGGKGGVGKTSCAASLAVRFANNGHPTLVVSTDPAHSLSDSFAQDLSGGTLVQVDGPDSPLFALEINPEKAREEFRTANQKNGGTGVKDFMDSMGLGVLAEQLGELKLGELLDTPPPGLDEAIAISKVMQFLEAQEYSMFSRIVFDTAPTGHTLRLLSLPDFLDASIGKILKLRSQIASATSAIKSVFGQEVQQQDAANKLEQLRERMLKVRELFRDTESTEFIIVTIPTVMAISESSRLHSSLQKESVPVRRLIVNQVLPPSTSDCKFCAIKRKDQTRALDMIRSDPELMDLNIIQAPLVDMEIRGVPALKFLGDIVWK

SEQ ID NO: 2625 - protein, 394 aa, Zea mays
MLATASPHLQAAARRLFLAVPVNQGCSSIRLPRRCFGRYASVRAASVTAPPAKEGADDLGFLEMSSGTRRRYYMLGGKGGVGKTSCAASLAVRFANNGHPTLVVSTDPAHSLSDSFAQDLSGGTLVQVEGPDSPLFALEINPEKAREEFRTVSQKNGGTGVKDFMDSMGLGVLVEQLGELKLGELLDTPPPGLDEAIAISKVMQFLEAQEYSMFSRIVFDTAPTGHTLRLLSLPDFLDASIGKILKLRSKIASATSAIKSVFGQEVQQQDAANKLEQLRERMVKVRELFRDTESTEFIIVTIPTVMAISESSRLHSSLQKESVPVRRLIVNQVLPPSTSDCKFCSIKRKDQTRALDMIRTDPELKGLNIIQAPLVDMEIRGVPALNFLGDILWK

SEQ ID NO: 2626 - protein, 393 aa, Oryza sativa
MLATAAPRLRAAAWGSLSPPAPVRAQFVSLPLSLPGRYASLRLRASAAAAAKEGAEEMGFEEMAAGTRRRYYMLGGKGGVGKTSCAASLAVRFANNGHPTLVVSTDPAHSLSDSFAQDLSGGALVPVEGPEAPLFALEINPEKAREEFRAASQKNGGTGVKDFMDGMGLGVLAEQLGELKLGELLDTPPPGLDEAIAISKVMQFLEAQEYSMFRRIVFDTAPTGHTLRLLSLPDFLDASIGKILKLRSKIASATSAIKSVFGQEVQQQDAANKLEQLRERMVQVRELFRDTESTEFIIVTIPTVMAISESARLHSSLRNESVPVKRLIVNQILPPSSSDCKFCAIKRKDQTRALDMIRNDPELMGLNLIQAPLVDMEIRGVPALKFLGDIVWK

SEQ ID NO: 2627 - protein, 406 aa, Oryza sativa
MLATAAPRLRAAAWGSLSPPAPVRAQFVSLPLSLPGRYASLRLRASAAAAAKEGAEEMGFEEMAAGTRRRYYMLGGKGGVGKTSCAASLAVRFANNGHPTLVVSTDPAHSLSDSFAQVASPVEHLLSRFEDLSGGALVPVEGPEAPLFALEINPEKAREEFRAASQKNGGTGVKDFMDGMGLGVLAEQLGELKLGELLDTPPPGLDEAIAISKVMQFLEAQEYSMFRRIVFDTAPTGHTLRLLSLPDFLDASIGKILKLRSKIASATSAIKSVFGQEVQQQDAANKLEQLRERMVQVRELFRDTESTEFIIVTIPTVMAISESARLHSSLRNESVPVKRLIVNQILPPSSSDCKFCAIKRKDQTRALDMIRNDPELMGLNLIQAPLVDMEIRGVPALKFLGDIVWK

SEQ ID NO: 2628 - protein, 331 aa, Secale cereale
MAARTTRRYYMLGGKGGVGKTSCAASLAVRFANSGHPTLVVSTDPAHSLSDSFAQDLTGGALAPVEGTDSPLFALEINPEKSREEFRTINQKNGGTGVKDFMDGMGLGILAEQLGELKLGELLDTPPPGLDEAIAISKVIQFLEAPEYSMFSRIVFDTAPTGHTLRLLSLPDFLDASIGKILKLRNKIASATSAIKSVFGQEVQQQDAANKLEQLRERMVKVRELFRDTESTEFIIVTIPTVMAISESARLHSSLQKESVPVRRLIVNQILPPSSSDCKFCAIKRKDQTRALDMIKSDPELMGLNIMQAPLVDMEIRGVPALKFLGDIVWK

SEQ ID NO: 2629 - protein, 263 aa, Brachypodium distachyon
MPLPTMTHSSSFLLPSPPAEAAAAADAVAYAVIVLNQRLPRFASLLWTRAQLRVCADGGANRLFDGMPELHPGEDPDEVRARYKPDAIKGDMDSIRPEVKEFYSNLGAKIVDESHDQDTTDLHKCISFITRNPPGPDKANLCILVLGALGGRFDHEMGNINVLYRFSNIKIILLSDESLIFLLPKTHNHEILVDQSIEGPHCGLIPMGMPSSSSTTTGLRWNLDNTSMSYGGLVSTSNIVDDKKVMVTSDSDLIWTISLRNHT

SEQ ID NO: 2630 - protein, 537 aa, Brachypodium distachyon
MDPDFSRASGGPSYEFAFNSVNFSDRVLRIEIVAGDDTAGAKGATGEGCSSIADWARHRKRRREELRREKESGKHMLDLTNVKVKAEEPDTYEEINEEPVAMIEESPPDIGQDGEDGGSSDSSWNMECNSVLRVKSIYISSAILAAKSPFFYKLFSNGMKESDQRHATLRITASEENALMELLSFMYSGKLTTNQPTLLLDILMISDKFEVVSCMRHCSQLLRSLPMTTESALLYLDLPSSISMAAAVQPLTDAAKEFLSNKYKDLTKFQDEAMNIPLAGIEAILWSNDLQVASEDAIYDFVIKWARAQYPKLEERREILGTRLLPLVRFCHMTCRKLRKVLACNDLDHEQATKSVTDALLYKADAPHRQRTLAADVLTCRKYCERAYKYRPLKVVEFDRPYPQCIAYLDLKREECTRLFPSGRIYSQAFHLAGQGFFLSAHCNMDQQSAFHCFGLFLGMQEKGSTSVTVDYEFAARTRPSGEFVSKYKGYYTFTGGKAVGYRNLFAIPWPSFMADDSLFFINGVLHLRAELTIKQP

SEQ ID NO: 2631 - protein, 536 aa, Oryza sativa
MDPDFSRASRGPSFAFAFNSVNFSDRVLRIEIVAGDDAAGAKGAAGEGCSSLADWAHQRKRRREELRREKESGKYTDLETCKVEAEECDTYEENNEEPVAMIEESPPDIGQDGEDGDSCDSSWSMECTQVLRVKSIYISSAILAAESPFFYKLFSNGMKESDQRHATLRITASEENALMELLSFMYSGKLTTNQPTLLLDILMIADKFEVVSCMRHCSQLLRSLPMTTESALLYLDLPSSISMAAAVQPLTDTAKAFLANKYKDLTKLQDEAMNIPLAGIEAILWSNDLQVASEDAIYDFVIKWARSQYPKLEERREILGTRLLPLVRFCHMTCRKLRKVLACNDLDHEQATKCVTEALLYKADAPHRQRTLAADVLTCRKYAERAYKYRPLKVVEFDRPYPQCIAYLDLKREECSRLFPSGRIYSQAFHLAGQGFFLSAHCNMDQQSAFHCFGLFLGMQEKGSTSVTVDYEFAARTRPSGEFVSKYKGYYTFTGGKAVGYRNLFAIPWSSFMADDSLFFIEGVLHLRAELTIKQP

SEQ ID NO: 2632 - protein, 536 aa, Sorghum bicolor
MDPDFSRASGGPSFEFAFNSVNFSDRVLRIEIVAGDDALGAKGAAGEGCSSLADWARHRKRRREELRRGKESGKYMPDPGNCKVEAEECDAYEEGNEPVAMIEESPPDIEPDGEDGESSDSSWSMECTQVLRVKSIYISSAILAAKSPFFYKLFSNGMKESDQRHATLRITASEENALMELLSFMYSGKLTTNQPTALLDILMVADKFEVVSCMRHCSQLLRSLPMTTESALLYLDLPSSISMAAAVQPLTDTAKEFLANKYKDLTKFQDEAMNIPLAGIEAILWSNDLQVASEDAIYDFVIKWARAQYPKLEERREILGTRLLPLVRFCHMTCRKLRKVLACSDLDHEQATKCVTEALLYKADAPHRQRALAADVMTCRKYAERAYKYRPLKVVEFDRPYPQCIAYLDLKREECSRLFPSGRIYSQAFHLAGQGFFLSAHCNMDQQSAFYCFGLFLGMQEKGSTSVTVDYEFAARTRPSGEFVSKYKGYYTFTGGKAVGYRNLFAIPWPSFMADDSLFFIDGVLHLRAELTIKQP

SEQ ID NO: 2633 - protein, 531 aa, Setaria italica
MDPDFSRGSGGPSFEFAFNSVNFSDRVLRIEIVAGDDAPGAKGAAGEGCSSLADWARHRKRRREELRRGKESGANCKVEAEECDAYEEGNEEPVAMIEESPPDIEQDGEDGESSDSSWSMECTQVLRVKSIYISSAILAAKSPFFYKLFSNGMKESDQRHATLRITASEENALMELLSFMYSGKLTTNQPTLLLDILMIADKFEVVSCMRHCSQLLRSLPMTTESALLYLDLPSSISVATAVQPLTDTAKEFLANKYKDLTKFQDEAMTIPLAGIEAILWSNDLQVASEDAIYDFVIKWARAQYPKLEERREILGTRLLPLVRFCHMTCRKLRKVLACSDLDHEQATKCVTEALLYKADAPHRQRALAADVMTCRKYAERAYKYRPLKVVEFDRPYPQCIAYLDLKREECSRLFPSGRIYSQAFHLAGQGFFLSAHCNMDQQSAFYCFGLFLGMQEKGSTSVTVDYEFAARTRPSGEFVSKYKGYYTFTGGKAVGYRNLFAIPWPSFMADDSLFFIDGVLHLRAELTIKQP

SEQ ID NO: 2634 - protein, 537 aa, Secale cereale
MDPDFSRASGGPSFEFAFNSVNFSDRVLRIEIVAGDDAPGAKGAAGEGCSSIADWARHRKRRREDLRREKECGKYMSEPANIKIEADERDTYEETNEEPVAMIEESPPDIGQDGEDGESSDSSWNMECNQVLRVKSIYISSAILAAKSPFFYKLFSNGMKESDQRHATLRITASEESALMELLSFIYSGKLTTNQPTLLLDILMMSDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWARAQYSRTEERREILGTRLLPLVRFSHMTCRKLRKVLACSDLDNEQATKSVTDALLYKADAPHRQRALATDVLTSRKYTERAYKYRPLKVVEFDRPYPQCIAYLDLKREECGRLFPSGRIYSQAFHLAGQGFFLSAHCNMDQQSAFHCFGLFLGMQEKGSSSVTVDYEFAARTRPSGEFVSKYKGCYTFTGGKAVGYRNLFAIPWPSFMADDSLFFINGVLHLRAELTIKQL

SEQ ID NO: 2635 - protein, 537 aa, Secale cereale
MEPDFSRASGGPSYEFAFNSVNFSDRVLRIEIVAGDDAPGAKGAAGEGCSSIADWARHRKRRREDLRRDKECGKYMLEPSKVKIEAEECDTYEETGEEPVAMIEESPPDIGQDGEDGENSDSSWNMECNQVLRVKSIYISSAILAAKSPFFYKLFSNGMKESDQRHATLRITASEESALMELLSFIYSGKLTTNEPTLLLDILMISDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWVRAQYPRTEERREILGTRLLPLVRFSHMTCRKLRKVLACSDLDHEQASKSVTDALLYKADAPHRQRALAADVLTCRKYTERAYKYRPLKVVEFDQPYPQCIAYLDLKREECSRLFPSGRIYSQAFHLAGQGFFLSAHCNMDQQSAFHCFGLFLGMQEKGSTSVTVDYEFAARTRPSGDFVSKYKGYYTFTGGKAVGYRNLFAIPWPSFMADDSLFFIDGVLHLRAELTIKQS

SEQ ID NO: 2636 - protein, 537 aa, Secale cereale
MDPDFSRASGGPSFEFAFNSVNFSDRILRIEIVAGDDAPGAKGAAGEGCSSIADWARHRKRRREDLRREKECGKYMSEPANIKIEADERDTYEETNEEPVAMIEESPPDIGQDGEDGESSDSSWNMECNQVLRVKSIYISSAILAAKSPFFYKLFSNGMKESDQRHATLRITASEESALMELLSFIYSGKLTTNQPTLLLDILMMSDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWARAQYSRTEERREILGTRLLPLVRFSHMTCRKLRKVLACSDLDNEQATKSVTDALLYKADAPHRQRALATDVLTSRKYTERAYKYRPLKVVEFDRPYPQCIAYLDLKREECGRLFPSGRIYSQAFHLAGQGFFLSAHCNMDQQSAFHCFGLFLGMQEKGSSSVTVDYEFAARTRPSGEFVSKYKGCYTFTGGKAVGYRNLFAIPWPSFMADDSLFFINGVLHLRAELTIKQL

SEQ ID NO: 2637 - protein, 536 aa, Saccharum officinarum
MDPDFSRASGGPSFEFAFNSVNFSDRVLRMEIVAGDDALGAKGAAGEGCSSLADWARHRKRRREELQRGKESGKYMPDPGSCKVEAEKCDAYEEGNEPVAMIEESPPDIEPNGEDGESSDSSWSMECTQVLRVKSIYISSAILAAKSPFFYKLFSNGMKESDQRHATLRITASEENALMELLSFMYSGKLTTNQPTALLDILMVADKFEVVSCMRHCSQLLRSLPMTTESALLYLDLPSSISMAAAVQPLTDTAKEFLANKYKDLTKFQDEAMNIPLAGIEAILWSNDLQVASEDAIYDFVIKWARAQYPKLEERREILGTRLLPLVRFCHMTCRKLRKVLACSDLDHEQATKCVTEALLYKADAPHRQRALAADVMTCRKYAERAYKYRPLKVVEFDRPYPQCIAYLDLKREECSRLFPSGRIYSQAFHLAGQGFFLSAHCNMDQQSAFYCFGLFLGMQEKGSTSVTVDYEFAARTRPSGEFVSKYKGYYTFTGGKAVGYRNLFAIPWPSFMADDSLFFIDGVLHLRAELTIKQP

SEQ ID NO: 2638 - protein, 537 aa, Triticum aestivum
MEPDFSRASGGPSYEFAFNSVNFSDRVLRIEIVAGDDAPGAKGAAGEGCSSIADWARHRKRRREDLRRDKECGKYMLEPSKVKIEAEECDTYEETGEEPVAMIEESPPDIGQDGEDGENSDSSWNMECNQVLRVKSIYISSAILAAKSPFFYKLFSNGMKESDQRHATLRITTSEESALMELLSFIYSGKLTTNEPTLLLDILMISDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWVRAQYPRTEERREILGTRLLPLVRFSHMTCRKLRKVLACSDLDHEQASKSVTDALLYKADAPHRQRALAADVLTCRKYTERAYKYRPLKVVEFDQPYPQCIAYLDLKREECSRLFPSGRIYSQAFHLAGQGFFLSAHCNMDQQSAFHCFGLFLGMQEKGSTSVTVDYEFAARTRPSGDFVSKYKGYYTFTGGKAVGYRNLFAIPWPSFMADDSLFFIDGVLHLRAELTIKQS

SEQ ID NO: 2639 - protein, 537 aa, Triticum aestivum
MEPDFSRASGGPSYEFAFNSVNFSDRVLRIEIVAGDDAPGARGAAGEGCSSIADWARHRKRRREDLRRDKECGKYMLEPSKVKIEAEECDTYEETGEEPVAMIEESPPDIGQDGEDGENSDSSWNMECNQVLRVKSIYISSAILAAKSPFFYKLFSNGMKESDQRHATLRITTSEESALMELLSFIYSGKLTTNEPTLLLDILMISDKFEVVSCMRHCSQLLRSLPMTTESALLYLDLPSSISMAAAVQPLTDAAKEFLANKYKDLAKFQDEVMNIPLAGIEAILCSNDLQVASEDAVYDFVIKWVRAQYPRTEERREILGTRLLPLVRFSHMTCRKLRKVLACSDLDHEQASKSVTDALLYKADAPHRQRALAADVLTCRKYTERAYKYRPLKVVEFDQPYPQCIAYLDLKREECSRLFPSGRIYSQAFHLAGQGFFLSAHCNMDQQSAFHCFGLFLGMQEKGSTSVTVDYEFAARTRPSGDFVSKYKGYYTFTGGKAVGYRNLFAIPWPSFMADDSLFFIDGVLHLRAELTIKQS

SEQ ID NO: 2640 - protein, 539 aa, Triticum aestivum
MDPDFSRASGGPSFEFAFNSVNFSDRVLRIEIVAGDDAPGAKGAAGEGCSSIADWARHRKRRREDLRLEKGGEECGKYMSEPANITIEADERDTYEETNEEPVAMIEESPPDIGQDGEDGDSDSSWNMECNQVLRVKSIYISSAILAAKSPFFYKLFSNGMKESDQRHATLRITASEESALMELLSFIYSGKLTTNQPTLLLDILMMSDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWARAQYSRTEERREILGTRLLPLVRFSHMTCRKLRKVLACSDLDNEQATKSVTDALLYKADAPHRQRALATDVLTSRKYTERAYKYRPLKVVEFDRPYPQCIAYLDLKREECGRLFPSGRIYSQAFHLAGQGFFLSAHCNMDQQSAFHCFGLFLGMQEKGSTSVTVDYEFAARTRPSGEFVSKYKGCYTFTGGKAVGYRNLFAIPWPSFMADDSLFFINGVLHLRAELTIKQL

SEQ ID NO: 2641 - protein, 539 aa, Triticum aestivum
MDPDFSRASGGPSFEFAFNSVNFSDRVLRIEIVAGDDAPGAKGAAGEGCSSIADWARHRKRRREDLRREKGGEECGKYMSEPANIKIEADERDTYEETNEEPVAMIEESPPDIGQDGEDGDSDSSWNMECNQVLRVKSIYISSAILAAKSPFFYKLFSNGMKESDQRHATLRITTSEESALMELLSFIYSGKLTTNEPTLLLDILMISDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWVRAQYPRTEERREILGTRLLPLVRFSHMTCRKLRKVLACSDLDHEQASKSVTDALLYKADAPHRQRALAADVLTCRKYTERAYKYRPLKVVEFDQPYPQCVAYLDLKREECSRLFPSGRIYSQAFHLAGQGFFLSAHCNMDQQSAFHCFGLFLGMQEKGSSSVTVDYEFAARTRPSGDFVSKYKGYYTFTGGKAVGYRNLFAIPWPSFMADDSLFFIDGVLHLRAELTIKQS

SEQ ID NO: 2642 - protein, 540 aa, Leymus cinereus x Leymus triticoides
  misc_feature (33)..(33): Xaa can be any naturally occurring amino acid
  misc_feature (46)..(46): Xaa can be any naturally occurring amino acid
  misc_feature (195)..(195): Xaa can be any naturally occurring amino acid
  misc_feature (198)..(198): Xaa can be any naturally occurring amino acid
  misc_feature (240)..(240): Xaa can be any naturally occurring amino acid
  misc_feature (332)..(332): Xaa can be any naturally occurring amino acid
  misc_feature (352)..(352): Xaa can be any naturally occurring amino acid
  misc_feature (356)..(356): Xaa can be any naturally occurring amino acid
MEPDFSRASGGPSYEFAFNSVNFSDRVLRIEIXAGDDAPGAKGAAXEGCSSIADWARHRKRRREDLRREKGGGECGKYMLEPSIVKIEAEEHDTYEETGEEPVAMIEESPPDIGQDGEDGENSDSSWNMECNQVLRVKSIYISSAILAAKSPFFYKLFSNGMKESDQRHATLRITASEESALMELLSFIYSGKLXTNXPTLLLDILMISDKFEVVSCMRHCSQLLRSLPMTTESALLYLXLPSSISMAAAVQPLTDAAKEFLANKYKDLTKFQDEVMNIPLAGIEAILCSNDLQVASEDAVYDFVIKWARAQYPRTEERREILGTRLLPLVXFSHMTCRKLRKVLACSDLDXEQAXKSVTDALLYKADAPHRQRALATDVLTSRKYTERAYKYRPLKVVEFDRPYPQCIAYLDLKREECGRLFPSGRIYSQAFHLAGQGFFLSAHCNMDQQSAFHCFGLFLGMQEKGSTSVTVDYEFAARTRPSGEFVSKYKGCYTFTGGKAVGYRNLFAIPWPSFMADDSLFFINGVLHLRAELTIKQL

SEQ ID NO: 2643 - protein, 536 aa, Zea mays
MDPDFSPASGGPSFEFAFNSVNFSDRVLRIEIVAGDDALGAKGATGEGCSSLADWACHRKRRREELRRDKESRKYMPDPANCKVEAEECDAYEEGNEPVAMIEESPPDIEADGEDGKSSDSYCSMECTQVLRVKSMYISSAILAAKSPFFYKLFSNGMKESDQRHATLRITASEENALMELLSFMYSGKLTTNQPTVLLDILMIADKFEVGSCMRHCSQLLRNLPMTTESALLYLDLPSSISMAAAVQPLTDTAKEFLANKYKDLTKFQDEAMNIPLAGIEAILWSNDLQVASEDAIYDFMIKWARAQYPKLEERREILGTRLLPLVRFCHMTCRKLRKVIACSDLDHEQATKCVTEALLYKADAPHRQRALAADVMTCRKYAERAYKYRPLKVVEFDRPYRQCIAYLDLKREECSRLFPSGRIYSQAFHLAGQGFFLSAHCNVDQQSAFYCFGLFLGMQEKGSTSVTVDYEFAARTRPSGEFVSKYKGYYTFTGGKAVGYRNLFAIPWPLFMADDSLFFIDGVLHLRAELTIKQP

SEQ ID NO: 2644 - protein, 516 aa, Triticum aestivum
NFSDRVLRIEIVAGDDAPGAKGAAGEGCSSIADWARHRKRRREDLRRDKECGKYMLEPSKVKIEAEECDTYEETGEEPVAMIEESPPDIGQDGEDGENSDSSWNMECNQVLRVKSIYISSAILAAKSPFFYKLFSNGMKESDQRHATLRITTSEESALMELLSFIYSGKLTTNEPTLLLDILMISDKFEVVSCMRHCSQLLRSLPMTTESALLYLDLPSSISMAAAVQPLTDAAKEFLANKYKDLTKFQDEVMNIPLAGIEAILCSNDLQVASEDAVYDFVIKWVRAQYPRTEERREILGTRLLPLVRFSHMTCRKLRKVLACSDLDHEQASKSVTDALLYKADAPHRQRALAADVLTCRKYTERAYKYRPLKVVEFDQPYPQCIAYLDLKREECSRLFPSGRIYSQAFHLAGQGFFLSAHCNMDQQSAFHCFGLFLGMQEKGSTSVTVDYEFAARTRPSGDFVSKYKGYYTFTGGKAVGYRNLFAIPWPSFMADDSLFFIDGVLHLRAELTIKQS

SEQ ID NO: 2645 - protein, 346 aa, Panicum virgatum
MDPDFSPGGGGPNFEFAFNEVNFSDRELRIEVVPGDDDAPGSSGAGAGGGGLADWARHRKRRREELLKEKESTTHMSDQTNCDEVEAEECDAYEENQEEPVAMIEESPPDVGQDGDDGQGIDSSWTVVSTPVLRVKTIYISSAILAAKSPFFFKLFSNGMKESDQRHATLRITDSEETALMELLSFMYSGKLTTTEPTLLLDILMAADKFEVVSCMRYCSQLLTSLPMTTESALLYLDLPCSISMAAAVQPLTDAAKDFLAVKYKDLTKFQDEVMNIPLAGIEAILSSNDLQVASEDTIYDFLLRWARAQYPKPEERREILSSRLLPLVRFSHMTCRKLRKGPNMH

SEQ ID NO: 2646 - protein, 539 aa, Zea mays
MDPDFSPGGGGPSFEFAFNEVNFSDRELRIEVVAGDDYAPGSSGAGAGGGGLADWARHRKRRREELLKEKESTTHMSDQTNCNEVEAEECDAYEENQEEPVAMVEESPPDVGQDGDDGQGIDSSWTVVGTPVLRVKTIYISSAILAAKSPFFFKLFSNGMKESDQRHATLRITDSEETALMELLSFMYSGKLATTEPTLLLDILMAADKFEVVSCMRYCSQLLTSLPMTTESALLYLDLPCSISMAAAVQPLTDAAKDFLAVKYKDLTKFQDEVMNIPLAGIEAILSSNDLQVASEDTIYDFLLRWARAQYPKSEERREILSSRLLPLVRFSHMTCRKLRKVLTCTDIDHEQATKCVTEALLYKADAPHRQRALAADTTTCRKFAERAYKYRPLKVVEFDRPYPQCIAYLDLKREECSRLFPAGRIYSQAFHLAGQGFFLSAHCNMEQQSTFYCFGLFLGMQEKGSTSVTVDYEFAARTRPSGEFVSKYKGNYTFTGGKAVGYRNLFGIPWQAFMADDSLFFIDGMLHLRAELTIKQPT

SEQ ID NO: 2647 - protein, 538 aa, Sorghum bicolor
MDPDFSPGGGGPSFEFAFNEVNFSDRELRIEVVAGDDDAPGSSGGGAGGGGLADWARHRKRRREELLKEKESTTHMSDQTSCNGVEAEECDAYEENQEEPVAMIEESPPDVGQDGDDGQGIDSSWTVVGTPVLRVKTIYISSAILAAKSPFFFKLFSNGMKESDQRHATLRITDSEETALMELLSFMYSGKLTTTEPTLLLDILMAADKFEVVSCMRYCSQLLTNLPMTTESALLYLDLPCSISMAAAVQPLTDAAKDFLAVKYKDLTKFQDEVMNIPLAGIEAILSSNDLQVASEDTIYDFLLRWARAQYPKSEERREILSSRLLPLVRFSHMTCRKLRKVLTCTDIDHEQATKCVTEALLYKADAPHRQRALAADTVTCRKFAERAYKYRPLKVVEFDRPYPQCIAYLDLKREECSRLFPAGRIYSQAFHLAGQGFFLSAHCNMEQQSTFYCFGLFLGMQEKGSMSVTVDYEFAARTRPSGEFVSKYKGNYTFTGGKAVGYRNLFAIPWQTFMADDSLFFIDGMLHLRAELTIKQP

SEQ ID NO: 2648 - protein, 538 aa, Setaria italica
MDPDFSPGGGGPSFEFAFNEVNFSDRELRIEVVAGDDDAPGSSGGGAGGGGLADWARHRKRRREELLKEKESTTHMSDQTNCNEVEAEECDAYEENQEEPVAMIEESPPDVGQDGDDGPGIDSSWTVVGTPVLRVKTIYISSAILAAKSPFFFKLFSNGMKESDQRHATLRITDSEETALMELLSFMYSGKLTTTEPNLLLDILMAADKFEVVSCMRYCSQLLTSLPMTTESALLYLDLPCSISMAAAVQPLTDAAKDFLAVKYKDLTKFQDEVMNIPLAGIEAILSSNDLQVASEDTIYDFLLRWARAQYPKSEERREILSSRLLPLVRFSHMTCRKLRKVLTCTDIDHEQATKCVTEALLYKADAPHRQRALAADAVTCRKFAERAYKYRPLKVVEFDRPYPQCIAYLDLKREECSRLFPSGRIYSQAFHLAGQGFFLSAHCNMEQQSTFYCFGLFLGMQEKGSMSVTVDYEFAARTRPSGEFVSKYKGNYTFTGGKAVGYRNLFAIPWQTFMADDSLFFIDGMLHLRAELTIKQP

SEQ ID NO: 2649 - protein, 181 aa, Brassica juncea
MASSDVTLFSSRIQFRSYSSIRYALPTIFNLSSPAVSSCATKSTQFLKRRLRAKSTNFSLSSLPRRGFVCRAAEYKFPDPIPEFAEAETKKFRDHMTKKLSKRDLFEDSVDEIVGVCTEIFETFLRSEYGGPGTLLVVPFIDMADTLNERELPGGPQAARAAIKWAQDHVDKDWKEWTGTD

SEQ ID NO: 2650 - protein, 181 aa, Brassica oleracea
MASSDVALFSSMIQFRSSSSIRNALPTIFNLSSPAASSCAIKSTQILNRRLRAKSTNLSLSSLPRRGFVCRAAEYKFPDPIPEFAEAETKKFRDHMTKKLSKRDLFEDSVDEIVGVCTEIFETFLRSEYGGPGTLLVVPFIDMADTLNERELPGGPQAARAAIKWAQDHVDKDWKEWTGTD

SEQ ID NO: 2651 - protein, 179 aa, Raphanus sativus
MASLDAALCSTRLQFHSSIRCALPTIFNLSSRAGSSCAIKPTQFLHRRLTAKSTNFSLSSLPRRGFLCRAAEYKFPDPIPEFAEAETKKFKDHMTKKLSKRDLFEDSVDEIVGVCTEIFETFLRSEYGGPGTLLVIPFIDMADTLNERELPGGPQAARAAIKWAQDHVDKDWKEWTGTD

SEQ ID NO: 2652 - protein, 167 aa, Raphanus sativus
  misc_feature (157)..(157): Xaa can be any naturally occurring amino acid
  misc_feature (167)..(167): Xaa can be any naturally occurring amino acid
MASLDAALFSPRLQFHSSIRCALPTIFNLSSQAGSSCAIKPTQFLHRRLRAKSTNFSFSSLPRRGFVCRAAEYKFPDPIPEFAEAETKKFKDHMTKKLSKRDLFEDSVDEIVGVCTEIFETFLRSEYGGPGTLLVIPFIDMADTSMKGNCLEVHKPXVQLSNGLRIX

SEQ ID NO: 2653 - protein, 179 aa, Raphanus sativus
  misc_feature (86)..(86): Xaa can be any naturally occurring amino acid
  misc_feature (117)..(117): Xaa can be any naturally occurring amino acid
  misc_feature (170)..(170): Xaa can be any naturally occurring amino acid
MASLDAALFSTRLQFHSSIRCALPTIFNLSSPAASSCVIKPTQFLQRRLISKSTNFSLSSLPRRGFVCRAAEYKFPDPIPEFAEAXTKKFKDHMTKKLSKRDLFEDSVDEIVGVCTXIFETFLRSEYGGPGTLLVIPFIDMADTLNERELPGGPQAARAAIKWAQDHVDXDWKEWTGTD

SEQ ID NO: 2654 - protein, 86 aa, Brassica juncea
MAKKLSKRDLFEDSVDEIVGVCTEIFETFLRSEYGGPGTLLVIPFIDMADTLNERELPGGPQAARAAIKWAQDHVDKDWKEWTGTD

SEQ ID NO: 2655 - protein, 179 aa, Arabidopsis thaliana
MASMHEALFSSRLLQVNSSFSFRCALPIISSPAAVSCAIKSTQFFKQRCRTKVRDFSLSSLSRRGFVCRAAEYKFPDPIPEFAEAETEKFRDHMLNKLSKRDLFEDSVDEIVGVCTEIFETFLRSEYGGPGTLLVIPFIDMADTLNERELPGGPQAARAAIKWAQDHVDKDWKEWTGTD

SEQ ID NO: 2656 - protein, 190 aa, Unknown
  Sequence found in Organisms: Thellungiella halophila, Eutrema halophilum
MASLHEALFSSRLQFYTSSIISTSSSSSSFRCALPVFSNLSSPAASSCGIKSTQFLRRRSRAKLTDFSLSSLSRRGFVCRASEYKFPDPIPEFAEAETEKFRDHMLKKLSKRDLFEDSVDEIVGVCTEIFGTFLRSEYGGPGTLLVIPFIDMADTLNERELPGGPQAARAAIKWAQDHVDKDWKEWTGTD

SEQ ID NO: 2657 - protein, 322 aa, Brassica rapa
MFLLKTWRSTAFGIYGYMNFTKNGFLDHSKKFKPEDMQIQIQGKNCVVTGANSGIGYAAAEGLASRGATVYMVCRNKERGEEALSKIQNSTGNQNVYLEVCDLSSVNDIKSFASSFASKDVPVHVLVNNAGLLENKRTTTPEGFELNFAVNVLGTYTMTELMLPLLEKASPDSKVITVSSGGMYTSPLTTDLQFSGEKFDGVLQYARNKRIQVALTEKWAEKYKNKGIGFYSMHPGWAETPGVARSLPSFKESFSGKLRTSEEGADTVVWLALQPKEKLVSGAFYFDRAEAPKHLTLAGTSKSHDLIDSVIDTLHSMAALDP

SEQ ID NO: 2658 - protein, 322 aa, Brassica napus
MFLLKTWRSTAFGIYGYMNFTKNGFLDHSKKFKPEDMQIQIQGKNCVVTGANSGIGYAAAEGLASRGATVYMVCRNKERGEEALSKIQNSTGNQNVYLEVCDLSSVNDIKSFASSFASKDVPVHVLVNNAGLLENKRTTTPEGFELNFAVNVLGTYTMTELMLPLLEKASPDSKVITVSSGGMYTSPLTTDLQFSGEKFDGVLQYARNKRIQVALTEKWAEKYKNKGIGFYSMHPGWAETPGVARSLPSFKESFSGKLRTSEEGADTVVWLALQPKEKLVSGAFYFDRAEAPKHLTLAGTSKSHDLIDSVIDTVHSMAALDP

SEQ ID NO: 2659 - protein, 322 aa, Brassica rapa
MFLLKTWRSTAFGIYGYMNFTKNGFLDHSKKFKPEDMQIQIQGKNCVVTGANSGIGYAAAEGLASRGATVYMVCRNKERGEEALSKIQNSTGNQNVYLEVCDLSSVNDIKSFASSFASKDVPVHVLVNNAGLLENKRTTTPEGFELNFAVNVLGTYTMTELMLPLLEKASPDSKVITVSSGGMYTSPLTTDLQFSGEKFNGVLQYARNKRIQVALTEKWAEKYKNKGIGFYSMHPGWAETPGVARSLPSFKESFSGKLRTSEEGADTVVWLALQPKEKLVSGAFYFDRAEAPKHLTLAGTSKSHDLIDSVIDTLHSMAALDP

SEQ ID NO: 2660 - protein, 322 aa, Brassica juncea
MFLLKTWRSTAFGIYGYMNFTKNGFLDHSKKFKPEDMQIQIQGKNCVVTGANSGIGYAAAEGLASRGATVYMVCRNKERGQEALSKIQNSTGNQNVYLEVCDLSSVNDIKSFASSFASKDVPVHVLVNNAGLLENKRTTTPEGFELNFAVNVLGTYTMTELMLPLLEKASPDSKVITVSSGGMYTSPLTPDLQFSGEKFDGVLQYARNKRIQVALTEKWADKYRNKGIGFYSMHPGWAETPGVARSLPSFKESFSGKLRTSEEGADTVVWLALQPKEKLVSGAFYFDRAEAPKHLTLAGTSKSHDIIDSVVDTVHSMAALDP

SEQ ID NO: 2661 - protein, 320 aa, Raphanus sativus
MFLLKTWRSTAFGIYGYMNFTKNGFLDHSKKFKPEDMQIQIQGKNCVVTGANSGIGYAAAEGLASRGANVYMVCRNKERGEEALSKIQNSTGNQNVYLEVCDLSSVNDIKSFASTFASKDVPVHVLVNNAGLLENKRTTTPEGFELNFAINVLGTYTMTELMLPLLEKASPDSKVITVSSGGMYTSPLTTDLQFSGEKFDGVLQYARNKRIQVALTEKWADKYKNKGIGFYSMHPGWAETPGVARSLPSFKESFSGKLRTSEEGADTVVWLALQPKEKLVSGAFYFDRAEAPKHLTLAGTSKSHDLIDSVIDSVHSMAAL

SEQ ID NO: 2662 - protein, 322 aa, Eutrema parvulum
MFLLKTWRSTAFGFYGYMNFTKNGFLDHSKKFKPEDMQIQIEGKNCVVTGANSGIGYAAAEGLAARGATVYMVCRNKERGQEALSKIQSSTGNQNVYLEVCDLSSVNDIKSFATSFASKDVPVHVLVNNAGLLENKRTTTPEGFELNFAVNVLGTYTMTELMVPLLEKASPDSKVITVSSGGMYTSPLTTDLQFSGEKFDGVLQYARNKRIQVALTEKWADKYKNKGIGFYSMHPGWAETPGVARSLPSFKESFSGKLRTSEEGADTIVWLALQAKDKLVSGSFYFDRAEAPKHLTLAGTSKSHDLIDSVIDTVHSMAALDP

SEQ ID NO: 2663 - protein, 322 aa, Unknown
  Sequence found in Organisms: Thellungiella halophila, Eutrema halophilum
MFLLKTWRSTAFGIYGYMNFTKNGFLEHSKKFKPEDMQIQIEGKNCVVTGANSGIGYAAAEGLASRGANVYMVCRNKERGQEALTKIQSSTGNQNVYLEVCDLSSVNEIKSFATSFASKDVPVHVLVNNAGLLENKRTITPEGFELNFAVNVLGTYTMTKLMLPLLEKASPDAKVITVSSGGMYTSPLTTDLQFSGENFDGVLQYARNKRIQVALTEKWAEKFKNKGIGFYSMHPGWAETPGVAKSLPSFNESFSGKLRTSEEGADTIVWLALQPKEKLVSGSFYFDRAEATKHLTLAGTSKSHDLIDSVIDTVHSMAALDP

SEQ ID NO: 2664 - protein, 322 aa, Arabidopsis thaliana
MFLLKTWRSTAFGVYGYMNFTKSGFLDHSKKFKPEDMQLQIEGKNCVVTGANSGIGFAAAEGLASRGATVYMVCRNKERGQEALSKIQTSTGNQNVYLEVCDLSSVNEIKSFASSFASKDVPVHVLVNNAGLLENKRTTTPEGFELSFAVNVLGTYTMTELMLPLLEKATPDAKVITVASGGMYTSPLTTDLQFSGEKFDGVEQYARNKRIQVALTEKWADKYKNKGIGFYSMHPGWAETPGVAKSLPSFSESFAGKLRTSEQGADTIVWLALQPKEKLVSGAFYFDRAEAPKHLKLAGTSKSHDLIDSVIDSVHSMAALNP

SEQ ID NO: 2665 - protein, 322 aa, Arabidopsis lyrata
MFLLKTWRSTAFGVYGYMNFTKNGFIEHSKKFKPEDMQLQIEGKNCVVTGANSGIGYAAAEGLASRGATVYMVCRNKERGQEALSKIQTSTGNQNVYLEVCDLSSVNEIKSFASSFASKDVPVHVLVNNAGLLENKRTTTPEGFELNFAVNVLGTYTMTELMLPLLEKATPDAKVITVASGGMYTSPLTTDLQFSGEKFDGVEQYARNKRIQVALTEKWADKYKEKGIGYYSMHPGWAETPGVAKSLPSFSESFAGKLRTSEQGADTIVWLALQPKEKLVSGSFYFDRAEAPKHLKLAGTSKSHDLIDSVIDTVHSMAALDP

SEQ ID NO: 2666 - protein, 328 aa, Cleome spinosa
MFLLKAWRSTAFGAYGYLNFTKNGFVEHSKRFNPEDMQIQIDGKNCVVTGANSGIGYATAKGLASQGATVYMVCRNKERGEEALSKIQSSTGNKNLHLEVCDLSSVQEIKSFASRFASKDVPVHVLVNNAGLLENKRITTPEGYELNFAVNVLGTYTMTELMLPLLEKAAPDAKVITVSSGGMYTSPLTTDLQFSEERFNGVEQYARNKRLQVALTEKWAEKYKNKGIGFYSMHPGWAETPGVANSLPSFNQSFSGKLRTSEEGADTIVWLALQPKEKLVEGAFYFDRAEAPKHLKFAGTSKSHSLIDSITGTLHSVASLDSSNPPLS

SEQ ID NO: 2667 - protein, 321 aa, Tropaeolum majus
MFLVKTWRSTVFGVFGYLNFTRNGFLEHSKKFKPEDMQIRIEGKNCIVTGANSGIGYATAEGLASRGATVYMVCRNKERGEAAVSKIQSATGNSNVHLEVCDLSSVNEIKSLASRFASKDVPVHVLVNNAGLLENKRSTTPEGFEFSFAVNVLGTYAMTELMLPMLEKAAPDAKVITVSSGGMYSVPLTTDLQFSEEKYDGVVQYARNKRVQVALTEKWADMYKNKGIGFYSMHPGWAETPGLTKSLPDFTTSFSKKLRTSEEGADTVVWLALQPKERLVSGAFYFDRAEATKHLVSAATAKSDRLIEPIVDTLRSMALLS

SEQ ID NO: 2668 - protein, 325 aa, Heritiera littoralis
MFLLKTWRASVFGVYGYLNFTRNGFLDHSKRFQPEDMQIRIEGKNCIVTGANSGIGFATAEGLASRGATVYMVCRNKERGEAALSKIQSSTGNPNVHLEICDLSSISEIKSFASRFSSKDVPVHVLVNNAGLIEHKRVSTSEGFEFNFAVNVLGTYATTESMLPLLEKAAPDARVITVSSGGMYTAPLTSDLQFSDGKFDGVEQYARNKRVQVALTEKWAEMYKNKGIGFYSMHPGWAETPGVARSLPGFNNSLSGKLRTSEEGADTVIWLGLQPKEKLVSGGFYFDRAEAPKHLKLAATSQSHAIIDSIVDTLRSMLASHDSKI

SEQ ID NO: 2669 - protein, 662 aa, Eutrema parvulum
MASRTLHALSVSPLFLLILLFAASSPAEAQQPYVNNHQLACEVRDYDNITNGFTCNGPSSCRSYLTFWSQPPYNTANSIAGLLNVSATEIQSINNLTSVTAIIPTRRLVVIPANCSCSGGGLYQHNATYRHSGRQETYFSVANDTYQALSTCQAMMSQNPYGEKNLTAGLDLLVPLRCACPTENQTAAGFKYLLTYLVARGDSISAIAEMFRSTSDAVTNGNELTSDNIFYFTPLLVPLRTEPTRIEISPSPPPPVATPPQSSPVEPPGSSSHKWVFVGIGIGAGLLLLISILALVFCFYKRKSKSPSSSTEQNKLTDSSTKQSVPTTGTNQWSIDLSKSSEKSGLKSAIESLTLYRFHDLQSATSNFSDENKIKGSVYRATINGDDAAVKVIKADVSSSEISLLKKLNHSNIIRLSGFCIREGTSYLVYEYSENGSISDWLHSSEKKKTLTWKQRVEIARDIAEALDYLHNYITPPHIHKNLESTNVLLDSNFRAKISNFGVARILDEGDLDLQLTRHVEGTQGYLAPEYVENGVITPKLDVFAFGVVVLELLSGKEAVTIQKEKEKEEQVEMLCKEINNVLGGENVREKLKTFMDPSLGNEYPLELAYTMAQLAKSCVATDLNSRPSISQVLTTLLMIVSSSIDWEPSHDLLHDSGSLCN

SEQ ID NO: 2670 - protein, 651 aa, Eutrema halophilum
MASLSISTLFLLLLFATSSPAEAQQPYVNNRQLDCENRAFDNITNGNTCNGPTSCRSYLTFWSHPPYNTANSIAGLLNVSAAEIQSINNLTTVTATITPRQLVIIPANCSCSGAGFYQHNATYRISRHETYFSVANDTYQALSTCQAMISQNSYGEKNLVPGSDLLVPLRCACPTVNQTAAGFNYLLTYLVSQGDSVSTIADMFRSTTDAVLDGNELKSSDLIYFFTPLSVPLRTEPTRIVTSPSPPPPVATPPQSPPVEPPGSSSSHKWVFVGIGIGAGLLLLISLFALFFFFYKRRSKPEQNKLTDSSTKHSVLTTTPPQWSIDLSKSSDTFGLKSAIESLTIYRFHDLQSATSNFSEENKIKGSVYRATINGDDAAVKVIKGDVSSSEISLLKKLNHSNIIRLSGFCIREGTSYLVYEYSENGSIGDWLHSSDKKRTLTWKQRVEIARDIAEALDYLHNYVTPPHIHKNLESTNILLDSNFRAKISNFGVARILDDGDLDLQLTRHVEGTQGYLAPEYVENGVITPKLDVFAFGVVVLELLSGKEVVTIQKEKGEEEVEMLCKEIKNVLGGENVREKLKAFMDPSLENEYPLELAYTMAQLAKSCVAPDLNSRPSIAQVLTKLLMIVSSSMDWEPSHDLLHDSGSLGD

SEQ ID NO: 2671 - protein, 672 aa, Arabidopsis lyrata
MAARTLHALSVSTLFLLLLFFAASPAKAQQPYVNNHQLACEVRDFDNITNGFTCNGPISCRSYLTFYSQPPYNTADSIAKLLNVSAAEIQSINKLPTVTTRIRTRDLVVIPANCSCSSSSSSSGGFYQHNATYNLSGNRGEETYFSVANDTYQALSTCQAMMSQNRYGEKELTPGLNLLVPLRCACPTAKQTAAGFKYLLTYLVARGDSISVIADRFNSTTAAITEGNELTSEDTIYFFTPVLVPLRTEPTKIVISPSPPPPPVIATPPQTPVDPPGSSSSSHKSIYIGIGIGAGLLLLISILALCFYKRRSKNKSSSSSLPEENKLFDSSTKQSIPTTTTQWSIDLSNSSEAFGLKSAIESLTLYRFNDLQSATSNFSDENRIKGSVYRATINGDDAAVKVIKGDVSSSEINLLKKLNHSNIIRLSGFCIREGTSYLVFEYSENGSISDWLHSSDKKVLTWKQRVEIARDVAEALDYLHNYITPPHIHKNLESTNILLDSNFRAKIANFGVARILDEGDLDLQLTRHVEGTQGYLAPEYVENGVITPKLDVFAFGVVVLELLSGREAVTIHKKKEKEEEEEVEMLCKVINNVLGGENVREKLKEFMDPSLGNEYPLELAYTMAQLAKSCVATDLNSRPSVTQVLTTLSMIVSSSIDWEPSDDLLRSGSLGN

SEQ ID NO: 2672 - protein, 664 aa, Arabidopsis thaliana
MAACTLHALSVTLFLLLFFAVSPAKAQQPYVNNHQLACEVRVYDNITNGFTCNGPPSCRSYLTFWSQPPYNTADSIAKLLNVSAAEIQSINNLPTATTRIPTRELVVIPANCSCSSSSGGFYQHNATYNLSGNRGDETYFSVANDTYQALSTCQAMMSQNRYGERQLTPGLNLLVPLRCACPTAKQTTAGFKYLLTYLVAMGDSISGIAEMFNSTSAAITEGNELTSDNIFFFTPVLVPLTTEPTKIVISPSPPPPPVVATPPQTPVDPPGSSSSHKWIYIGIGIGAGLLLLLSILALCFYKRRSKKKSLPSSLPEENKLFDSSTKQSIPTTTTTQWSIDLSNSSEAFGLKSAIESLTLYRFNDLQSATSNFSDENRIKGSVYRATINGDDAAVKVIKGDVSSSEINLLKKLNHSNIIRLSGFCIREGTSYLVFEYSENGSISDWLHSSGKKSLTWKQRVEIARDVAEALDYLHNYITPPHIHKNLESTNILLDSNFRAKIANFGVARILDEGDLDLQLTRHVEGTQGYLAPEYVENGVITSKLDVFAFGVAVLELLSGREAVTIHKKKEGEEEVEMLCKVINSVLGGENVREKLKEFMDPSLGNEYPLELAYTMAQLAKSCVATDLNSRPSVTQVLTTLSMIVSSSIDWEPSDDLLRSGSLGN

SEQ ID NO: 2673 - protein, 871 aa, Brassica rapa
MAYRFPLHSPSPHSHFLSPSNHPRKHPSSISISCHNTNDPHHDDDEEKSKINLLAIPITLTLISASLPQPSLAAAAAATKKRSLKKPQEALKPEQLKSWSKDLPVVSKRIPYTDLLTLKSQNKLKHVIKPQSLTLRQKPEPVLIVLEDSHVLRTVLPSIDGNKRFWEQWDELNIDSVCVNAYSPPVKKPPVPSPYLGFLWRVPSYMLTLAKPKKESKRAAELKRMREDFKRQRKEEMERMNEESEEMEKAIKAQKKMQERKKRKALRKKKYEESLVEARRNYRDMGLMWARLAEDSNVATALGLVFFYIFYRVVVLNYRKQKKDYDDRLKIEKAEAEERKKMRELEREMEGVELDDEEEEGGGSGEKNPYLQMAKQFMKSGARVRRASSNRRMPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSSETWRQVAINEAAMAVVAVNFPDLKNIEFLTINPRAGRELGYVRVKMDHIKFKEGMLSRQSLLDHITVQLAPRAADELWYGEDQLSTIWAETSDNARSAARSLVLGGLSEKHHGLNNFWMADRINDIDVEALRILNMCYDRAKEILQKNRTLMDEVVEKLVQKKSLSKQEFFTLVELYGSIKPMPPSILELRKIKRLQLQEAVMKQDMTSARNS

SEQ ID NO: 2674 - protein, 880 aa, Eutrema halophilum
MACRFPLHSSPHSQFLSPENRPRILRFPRNYPSISCQNISATKDVHDEDGDNEKAKANQVNLLAIPITLTVISASLAQPSLAAAATKVSERKKTQKKPQEALTLEQLKAWSKDLPVVSKRIPYTDILSLKDEGKLKHVIKPSGLSLRQKAEPVLVVLEDSQVLRTVLPSLEGNKRFWEQWDELGIDVACVNAYTPPVKKPPVPTPYLGFLWKVPSYMLTWVKPKKESRRAAELKRMREDFKRQRKEEMERMKEEREMMEKTMKAQKKQQERKKRKALRKKKYDESLREARRNYRDMADMWARLAQDSNVATALGLVFFYIFYRVVVLNYRKQKKDYEDRLKIEKAEADERKKMRELEREMEGIEEVDEELEEGTGEKNPYLQMAMQFMKSGARVRRASNRRLPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSSETWRQVAINEAAMAVVAVNFPDLKNIEFLTINPRAGRELGYVRVKMDHIKFKEGMLSRQSLLDHITVQLAPRAADELWYGEDQLSTIWAETSDNARSAARSLVLGGLSEKHHGLNNFWVADRINDIDMEALRILNMCYERAKEILQRNRTLMDEVVEKLVQKKSLSKQEFFTLVELYGSIKPVPPSILELRKIKRLQLEETVMKLDMTTARNS

SEQ ID NO: 2675 - protein, 881 aa, Eutrema parvulum
MACRFPLHSLPYSQFLSPENRQRILRFPRNYPSISCQNNSATNDAHDDGGDNEKAKAKQVNLLAIPITLTVFSGSLAQPSLAAAATKVSERKKSQKKPQEALTLEQLKAWSKDLPVVSKRIPYTDILSLKVEGKLKHVIKPSGLSLRQKAEPVLVVLEDSQVLRTVLPSLEGNKRFWEQWDELGIDVACVNAFNPPVKKPPVPTPYLGFLWKVPAYMLTWVKPKRESKRAAELKRMREDFKRQRKEEIERMKEEREMMEKTMKAQKKQQERKKRKALRKKKYEESLREARRNYRDMADMWARLAQDPNVATALGLVFFYIFYRVVVLNYRKQKKDYEDRLKIEKAEADERKKMRELEREMEGIEEDDEEIEEGTGEKNPYLQMAMQFMKSGARVRRASNKRLPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEVAAINMMRDGRTELTTDDLLQAAQIEERGMLDRKDRSSETWRQVAINEAAMAVVAVNFPDLKNIEFLTINPRAGRELGYVRVKMDHIKFKEGMLSRQSLLDHITVQLAPRAADELWYGEDQLSTIWAETSDNARSAARSLVLGGLSEKHHGLNNFWVADRINDIDLEALRILNMCYERAKEILQRNRTLMDEVVEKLVQKKSLSKQEFFTLVELYGSIKPVPPSILELRKTKRLQLDDKVMKVNTMTVRNSS

SEQ ID NO: 2676 - protein, 874 aa, Arabidopsis lyrata
MACRFPLHSSPPSQFLSPENRQRLPRNYPSISCQNNSADVHDDGDENEKVKTSQVNLLAIPITLTVISASLAQPSFAAAKVSERKRTQKKPQEALTIEQLKAWSKDLPVVSNRIPYTDILSLKAQGKLKHVIKPPNLSLRQKAEPVLVVLEDSRVLRTVLPSLEGNKRFWEEWDELGIDGQCVNAYTPPVKRPPVPSPYLGFLWKVPAYMLTWVKPKKESKRAAELKKMREDFKRQRKEEIERMKEERAMMEKTMKAQKKQQERKKRKAVRKKKYEESLREARRNYRDMADMWARMAQDPNVATALGLVFFYIFYRVVVLNYRKQKKDYEDRLKIEKAEADERKKMRELEREMEGIEEEDEELEEGTGEKNPYLQMAMQFMKSGARVRRASNKRLPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSLKIWRQVAINEAAMAVVAVNFPDLKNIEFLTINPRAGRELGYVRVKMDHIKFKEGMLSRQSILDHITVQLAPRAADELWYGEDQLSTIWAETSDNARSAARSLVLGGLSDKHHGLNNFWVADRINDIDLEALRILNMCYERAKEILGRNRTLMDEVVEKLVQKKSLSKQEFFTLVELYGSIKPMPPSILELRKIKRLELEETVLKLDMTTAKNSS

SEQ ID NO: 2677 - protein, 250 aa, Brassica napus
MAITRLTLAPLLLIAAVILSTETSAQPAAPAPGPAGPINLTAILEKGGQFTTFIHLLKITQVGEQVNIQVNSSSEGMTVFAPTDNAFQNLKAGTLNKLSADEQVKLILYHVSPKFYTLDDLLSVSNPVRTQASGRDNGVYGLNFTGEANQVNVSTGYVETRVSNALRSQRPLAVYVVDMVLLPGEMFGEHKLSPIAPAPKSPTTGVSDDDTKSNSTKKAAAPADKSASGERRAGLGFGFGLVVLSLKFLF

SEQ ID NO: 2678 - protein, 248 aa, Raphanus sativus
MAITRLTLAPLLLIAAVLLSTETSAQPAAPAPGPAGPINLTAILEKGGQFTTFMHLLKITQIGSQVDTQVNSSSEGMTVFAPTDNAFQNLKAGTLNKLSADEQVKLILYHVSPKFYTLDDLLSVSNPVRTQASGRDNGVYGLNFTGEANQVNVSTGYVETRVSNALRSQRPLAVYVVDMVLLPGEMFGEHKLSPIAPAPKSPTTGVSDDNTNSTKKAPASADKSASGERRVGLGFGFGLVILCLKFIF

SEQ ID NO: 2679 - protein, 251 aa, Eutrema parvulum
MAITRLTLAPLLLIATVLLSTETSAQPAAPAPGPAGPINLTAILVKGGQFTTFIHLLDITQVGSQVNIQVNSSSEGMTVFAPTDNAFQNLKPGTLNKLSADEQVKLILYHVSPKFYTLDDLLSVSNPVRTQASGRDNGVYGLNFTGQTNQINVSTGYVETRVSNALRVQRPLAVYVVDMVLLPGEMFGKHKLSPIAPAPESPSTGVSDDDSKSNSTKKAAASPADTSASGERRVGLGFGFGLVVLCLKFLF

SEQ ID NO: 2680 - protein, 248 aa, Eutrema halophilum
MDITRLTIAPLLIIAALLLTTETSAQPAAPAPGPAGPINLTAILEKGGQFTTFIHLLNITQVGSQVNIQVNSSSEGMTVFAPTDNAFQNLKPGTLNKLSADEQVKLILYHVSPKFYSLDDLLSVSNPVRTQASGRDNGVYGLNFTGQANQVNVSTGYVETRVSNPLRQQRPLAVYVVDMVLLPGEMFGEHKLSPVAPAPKSPSSGVSDDSNSTKKAAASPADKSGSCERKVGLGFVLGLVFLCLKFLF

SEQ ID NO: 2681 - protein, 247 aa, Arabidopsis lyrata
MATTRLTLAPLLLIALVLLVTKATAQPAAPAPGPAGPINLTAILEKGGQFTTFIHLLNITQVGSQVNIQVNSSSEGMTVFAPTDNAFQNLKPGTLNQLTPDEQVKLILYHVSPKFYSMDDLLSVSNPVRTQASGRDNGVYGLNFTGQTNQINVSTGYVETRVSNALRQQRPLAVYVVDMVLLPGEMFGEHKLSPIAPAPKSKSGGVSDDSGSTKKAASPSDKSGSGEKKVGLGFGLGLVVLCLKFLF

SEQ ID NO: 2682 - protein, 247 aa, Arabidopsis thaliana
MATTRLTLAPLLLIAAVLLATKATAQPAAPAPEPAGPINLTAILEKGGQFTTFIHLLNITQVGSQVNIQVNSSSEGMTVFAPTDNAFQNLKPGTLNQLSPDDQVKLILYHVSPKYYSMDDLLSVSNPVRTQASGRDNGVYGLNFTGQTNQINVSTGYVETRISNSLRQQRPLAVYVVDMVLLPGEMFGEHKLSPIAPAPKSKSGGVTDDSGSTKKAASPSDKSGSGEKKVGLGFGLGLIVLCLKFLF

SEQ ID NO: 2683 - protein, 250 aa, Eutrema parvulum
MATIHLTLAPLLLLAAIFLSTEVTAQPAAPAPGPAGPVNITAILEKGGQFVTFIRLLNTTQIGNQVNIQVNSSSEGMTVFAPTDNAFQNLKPGTLNKLSPDDQVKLILYHVSPKFYTLDDLLSVSNPVRTQASGRDGGAVYGLNFTGQGNQVNVSTGVIETRVSNALRQERPLAVYVVDMVLLPEEMFGERKISPVAPAPKSKSPGVSDDSDDTSKKAAAPSEKSGSGEMKAGLGFGLGLVLLCLKFIVN

SEQ ID NO: 2684 - protein, 252 aa, Brassica rapa
MAAAKAGILPWLIPSSSATSSPLFSAAVKLPGVWRVKGRKAEKDVSVSVAFNPSGNFDISAFDSHDDTDKVEPPMPPTSGRYEVVIDNDSIQRLDLSPFQTATGITSPSSADPREYLDRSIGFTINYRREDAGDPRELSEYPDIRLWFVRLDAMYPWLPLLLDWRAGELARYAAMLVPHQMSLRMGVVFNPEALELFVMSKVFVVYPWLKRHAVPKPRLKTSDMARMLGFGIGDQLFDLIDQYDLQTTTDSL

SEQ ID NO: 2685 - protein, 244 aa, Raphanus sativus
  misc_feature (35)..(35): Xaa can be any naturally occurring amino acid
  misc_feature (37)..(38): Xaa can be any naturally occurring amino acid
MAAAKTGLLLSWLIPSSSAAAPLFSVAVKLPVVRXRXXEKDVSVSVAFNPSGNFDISALDSHDDSDKVEPPMPPTSGRYEVVIDNDSIQRLDLSPFQTATGITSPSSADPREYMDRSIGFTINYKREDPGDPRELSEYPDIRLWFVRLDAMYPWLPLLLDWRAGELARYAAMLVPHQMSLRMGVVFNPEALELFVMTKVFVVYPWLKRHGVPKPRLKTSDMARMLGFGIGDQLFDLIDHHTDSL

SEQ ID NO: 2686 - protein, 116 aa, Brassica rapa
MAAAKAGILPWLIPSSSATSSPLFSAAVKLPGVWRVKGRKAEKDVSVSVAFNPSGNFDISAFDSHDGTDKVEPPMPPTSGRYEVVIDNDSIQRLDLSPFQTATGITSPSSGNQSHF

SEQ ID NO: 2687 - protein, 277 aa, Brassica rapa
ERKERPHHTKCIRQRERESFEVGSPMAAAKAGILPWLIPSSSATSSPLFSAAVKLPGVWRVKGRKAEKDVSVSVAFNPSGNFDISAFDSHDDTDKVEPPMPPTSGRYEVVIDNDSIQRLDLSPFQTATGITSPSSADPREYLDRSIGFTINYRREDAGDPRELSEYPDIRLWFVRLDAMYPWLPLLLDWRAGELARYAAMLVPHQMSLRMGVVFNPEALELFVMSKVFVVYPWLKRHAVPKPRLKTSDMARMLGFGIGDQLFDLIDQYDLQTTTDSL

SEQ ID NO: 2688 - protein, 110 aa, Eutrema parvulum
MAGAAGKAGLVPWLIPSSLCPVVQLAALESGPGVWRVRRRKAEDVSVSVAFNPSGNFDISAFDSHDDSDKVEPPMPPTTGRYEVVIDNDSIRRLDLSPFQTATGITSPEG

SEQ ID NO: 2689 - protein, 363 aa, Eutrema halophilum
MGPLPISSIRIGKIEDVQELIKSKPNKVPERFIREANERGLLVSLKTHPHQHIPVIDLSKLSEPHTHDDHLFEILKLSQACEDWGFFQVINHGIEVKVVEDIEKVAKEFFEMPLEEKKKYPMEPGTVQGYGQAFIFSEDQKLDWCNMFALGVHPPSIRNPKLWPSKPARFSENLEGYSKEIRKLCKKLLKYIAISLGLNEERFEEMFGEAVQAVRMNYYPPCSSPDLVLGLSPHSDGSALTVLQQSKNSCVGLQILKDNTWVPVLPLPSALVINIGDTIEVLTNGKYKSVEHRAVTNRERERLTIVTFYAPNYEVEIEPMGELVDDETNPCKYRSYNHGDYSYHYVSNKLQGKKSLDFARILN

SEQ ID NO: 2690 - protein, 240 aa, Gossypium hirsutum
MASLQQASISLQPKLLSSSQHPRSLPSLNLSFSATFPSLKLSTTRPLHGGAKMSASAASSYATALADVAKSNNTLDATSSDVEKVETIFSDPQVLEFFTNPTIDVLKKRQVLDEIVSSSELQPHTANFLNILVDAKRIDLIKEIVKEFELVYNQLTDTELAVVSSVVKLESQHLAQIAKQVQKLTGAKNVRIKTMIDPSLVAGFTIRYGSSGSKLIDMSVKKQLEEIAAQLDLGDIQLAV

SEQ ID NO: 2691 - protein, 473 aa, Gossypium hirsutum
MPNIVASALLFGGHSPPKCLARRTRSSEDVHVLSMRQKEILIHDVDTEVMREQERDDGMHKNHKTNFESSYEGFESYSCSASAKDWIVPVSDDVSPMKMLQEELRVLNQNELTGKDFKIKRIEDWVSGLQHVRPSEDSVELSYPNDQVKAEPAVSNDLTAAKVDVKVTPGMEAAKRYISSLSTSASTAQLANHGLVVIPFLSAFVSLKVLNLSGNAIARITAGALPRGLHMLNLSRNNISTIEGLRELTRLRVLNLSYNRIFRIGHGLASCSSLKELYLAGNKISEVEGLHRLLKLTVLDLRFNKISTAKCLGQLAANYNSLQAIGLEGNPAQKNVGDENLKKHLQGLLPNLVYFNRQAIKVSTVKDGAERSVRLGISAHQFDRGLRSEHRATRKNSHGTSIHRPSSSSTRGHKSQVASPMQSRGRHGRYPPSGAKATNNRQNHHVDLGSKVLNFKSELSMRRTQSEGTLGLL

SEQ ID NO: 2692 - protein, 666 aa, Gossypium raimondii
MHTTIEDFSQVQAPKESTKAANMESFCPETQTTAEIHESVEPVTVSSSPYPSWKSEDVKDRVILDSSSRVLQNPHYLKKCRSLGSGLCLEGRVPGQNDTDDETDQGFSSDSHDHGLVEDGRKHIAVSQNASFSESVQVSSNHVYNELVFSIGDSLLPEKDGRDISNLPLPCECANASGDHTPNNAPVIVKSCSMPNIVASALLFGGHSPPKCLARRTRSSEDVHVLSMRQKEILIHDVDTEVMREQERDDGMHKNHKTNFESSYEGFESYSCSASAKDWIVPVSDDVSPMKMLQEELRVLNQNELTGKDFKIKRIEDWVSGLQHVRPSEDSVELSYPNDQVKAEPAVSNDLTAAKVDVKVTPGMEAAKRYISSLSTSASTAQLANHGLVVIPFLSAFVSLKVLNLSGNAIARITAGALPRGLHMLNLSRNNISTIEGLRELTRLRVLNLSYNRIFRIGHGLASCSSLKELYLAGNKISEVEGLHRLLKLTVLDLRFNKISTAKCLGQLAANYNSLQAIGLEGNPAQKNVGDENLKKHLQGLLPNLVYFNRQAIKVSTVKDGAERSVRLGISAHQFDRGLRSEHRATRKNSHGTSTYRPSSSSTRGHKSQVASPMQSRGRHGRYPPSGAKATNNRRNHHVDLGSKVLNFKSELSMRRTQSEGTLGLL

SEQ ID NO: 2693 - protein, 357 aa, Cajanus cajan
MASIIFGRSAFLTFLLICTFLSVSTIKVCEAQAKPPTAKGLSYTFYDKSCPKLESIIRKELKKIFKNDIGQAAGLLRLHFHDCFVQGCDGSVLLDGSASGPSEKDAPPNLTLRAEAFKIIEDLRSLLEKSCGRVVSCSDITALAARDAVFLSGGPEYEIPLGRRDGLTFATRNDTLANLPPPSSNATTILDSLATKNLDPTDVVALSGGHTIGISHCNSFSDRLFPTQDPVMDKTFGKNLRLTCPTNTTVNTTVLDIRSPNTFDNKYYVDLMNRQGLFNSDQDLYTDKRTKGIVTSFAVNQSLFYEKFVFAMLKMGQLSVLTGTQGEIRANCSVRNTDTKSFLTTIVGDVVEQIIEM

SEQ ID NO: 2694 - protein, 183 aa, Trigonella foenum-graecum
MSAIARLRAIAPSLKTLKSILHRPFGSAAALQYNYDEEEDEKFEYNTPRGMLDTEGSAPERGVQWVMIGEPGAKRHVFAERLSKLLEVPHISMASLLHQELNPRSSLYQQIASALDHGKIVPEEIIFALLSKRLEDGCDRGETGFILDGIPRTRMQAEILNHIAHVDLVVNFKSPQEDLMKKL

SEQ ID NO: 2695 - protein, 269 aa, Cicer arietinum
MSAIARLRAIAASLKTLKFNLNRPFGSAAAVQYDYDDDEEEQFEHSAPRGMLNTEGSAPERGVQWVMIGEPGVKRHLFSERLSKLLEVPHISMASLLHQELNPRSSLYQQIASALDHGKLVPEEIIFALLSKRLEDGYYRGETGFILDGIPRSRIQAEILDHIAHVDLVVNFKFPQEDFMKKKLGLRKFTSCQEHVFTTSSWTPTKQSQDEHVHSRSEESMMLEDYYRKQKKLLNFEVAGGPGETWQGLLTALHLQHINALNSSQKLTA

SEQ ID NO: 2696 - protein, 352 aa, Cicer arietinum
MASASTITLSSFLYTKTPNPEKSSSLNRSTLSVGSQRKQCVSVSASAKSSPPPYDLNSFKFNPIKESIVSREMTRRYMTDMVTHADTDVVIVGAGSAGLSCAYELSKNPSIKIAIIEQSVSPGGGAWLGGQLFSAMVVRKPAHLFLNEIGVEYDEKDDYVVIKHAALFTSTIMGKILARPNVKLFNAVAAEDLIVKNDRVAGVVTNWALVSMNHDTQSCMDPNVMEAKVVVSSCGHDGPFGATGVKRLKSIGLIDSVPGMKALDMNTAEDAIVRLTREVVPGMIVTGMEVAEIDGAPRMGPTFGAMMISGQKAAHLVLRSLGLPNAVDHAGDINTQPELVLAAADSVEIADA

SEQ ID NO: 2697 - protein, 342 aa, Cajanus cajan
MASITTSSFLFQKPTPSFNVTRALRPLPHAPRASMSAAASPPPPYDLGSFKFAPIKESMVAREMTRRYMTDMVTHADTDVVIVGAGSAGLSCAYELSKNPSVKVAIVEQSVSPGGGAWLGGQLFSAMVVRKPANLFLDELGLEYDEQDNYVVMKHAALFTSTIMSKLLARPNVKLFNAVAAEDLIVKNGRVGGVVTNWALVSMNHDTQSCMDPNVMEAKVVVSSCGHDGPFGATGVKRLKSIGLIDTVPGMKALDMNKAEDAIVRLTREVVPGMIVTGMEVAEIDGAPRMGPTFGAMMISGQKAAHLALRALGLPNSLDYAGNVHPELILAAADQSAEIAEA

SEQ ID NO: 2698 - protein, 350 aa, Glycine max
MASSTITSSFLTSHPSSLFNKSSSSSFPSFHATPTLRPHRPRASMSAAAPPPPYDFGSFRFEPIRESIVSREMTRRYMTDMVTHADTDVVVVGAGSAGLSCAYELSKNPSVNIAIVEQSVSPGGGAWLGGQLFSAMVVRKPAHLFLDELGLEYDEQDNYVVIKHAALFTSTIMSKLLARPNVKLFNAVAAEDLIVKNGRVGGVVTNWALVSMNHDTQSCMDPNVMEAKVVVSSCGHDGPFGATGVKRLKSIGLIDSVPGMKALDMNKAEDAIVKLTREVVPGMIVTGMEVAEIDGAPRMGPTFGAMMISGQKAAHLALRSLGLPNALDSVGNVHPELVLAAAESAEIADA

SEQ ID NO: 2699 - protein, 347 aa, Euphorbia esula
MASMAAAAFTALSAKPQKLSIFDSPSLRLHPSPKSFSVSMSAFSSPSSPQYDLNAFKFDPIKESIVSREMTRRYMTDMISHADTDVVIVGAGSAGLSCAYELSKNPDVKVAIIEQSVSPGGGAWLGGQLFSAMVVRKPAHRFLDELEIEYDEADHYVVIKHAALFTSTIMSKLLARPNVKLFNAVAAEDLIVKEGRVGGVVTNWALVAMNHNTQSCMDPNVMESKVVVSSCGHDGPFGATGVKRLKSIGLIDTIPGMKALDMNTAEDAIVRHTREVVPGMIVTGMEVAEIDGAPRMGPTFGAMMISGQKAAHLALRALGLPNALDGTFAMHPELVLAAAESADIVDA

SEQ ID NO: 2700 - protein, 364 aa, Lotus japonicus
MASTTTTTFTSSSSSSSFLHTKIPTPSSLSSFNKPLTFQSMKPSLRKLCMSMAASSAPSPPPPYDLGSFKFAPIKESIVSREMTRRYMTDMVTFADTDVVIVGAGSAGLTCAYELSKNPNVQVAIIEQSVSPGGGAWLGGQLFSAMVVRKPAHLFLNELGVDYDEQDNYVVIKHAALFTSTIMSKLLARPNVKLFNAVAAEDLIVKNGRVGGVVTNWALVSMNHDTQSCMDPNVMEAKVVVSSCGHDGPFGATGVKRLKSIGLIDRVPGMKALDMNTAEDAIVRLTREVVPGMIVTGMEVAEIDGAPRMGPTFGAMMISGQKAAHLALRSLGLPNAVDKNNAAGKIHPELVLAAATESAEIADA

SEQ ID NO: 2701 - protein, 357 aa, Unknown
  Sequence found in Organisms: Gossypium hirsutum, Gossypium raimondii
MASSIATTLTSSSKLCRNTSLFESSFHGVPIKPLSFHFKTKSSPCNASISMSAASPPPYDLNNFRFDPIKESIVSREMTRRYMMDMITYADTDVVVVGAGSAGLSCAYELSKNPSVQIAIVEQSVSPGGGAWLGGQLFSAMVVRKPAHRFLDELAIEYDEQDDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALKSLGLPNAIDGTYVGSIHPELILAAADSAETADA

SEQ ID NO: 2702 - protein, 357 aa, Eucalyptus grandis
MAAATITSSLSSKPKLSLSSFHGTPLAPAAQSLRLPAPRSSAHSSGISMSAAAANPPPYDLNAFRFDPIKESIVSREMTRRYMMDMITYADTDVVVVGAGSAGLSCAYELSKNPDVQVAIIEQSVSPGGGAWLGGQLFSAMVVRKPAHRFLDELEIEYDEQDNYVVIKHAALFTSTIMSKLLARPNVKLFNAVAAEDLIVKNDRVGGVVTNWALVSMNHDTQSCMDPNVMEAKVVVSSCGHDGPFGATGVKRLRSIGMIDSVPGMKALDMNTAEDAIVRLTREIVPGMIVTGMEVAEIDGSPRMGPTFGAMMISGQKAAHLALKALGLPNALDGSYVGSIQPELILAAADSAEIAEA

SEQ ID NO: 2703 - protein, 357 aa, Gossypium hirsutum
MASSIATTLTSSSKLCRNTSLFGSSFHGVPIKPLSFHFKTKSSPCNASISMSAASPPPYDLNNFRFDPIKESIVSREMTRRYMMDMITYADTDVVVVGAGSAGLSCAYELSKNPSVQIAIVEQSVSPGGGAWLGGQLFSAMVVRKPAHRFLDELAIEYDEQDDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALKSLGLPNAIDGTYVGSIQPELILAAADSAETADA

SEQ ID NO: 2704 - protein, 357 aa, Gossypium hirsutum
MASSMATTLTSSSKLCRNTSLFESSFHGVPIKPLSFHFKTKSSHCNASISMSAASPPPYDFNNFRFDPIKESIVSREMTRRYMMDMIIYADTDVVVVGAGSAGLSCAYELSKNPSVQIAIVEQSVSPGGGAWLGGQLFSAMVVRKPAHRFLDELAIEYDEQDDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALKSLGLPNAIDGTHVGTIHPELILAVADSAETADA

SEQ ID NO: 2705 - protein, 349 aa, Euphorbia peplus
MATMAAAAAFTSLSSATPQKQSLFSVRLQNPSPKSFSVSMSAFSSSSSSSAQYDLNAFKFDPIKESIVSREMTRRYMTDMISHADTDVVIVGAGSAGLSCAYELSKNPDVKVAIIEQSVSPGGGAWLGGQLFSAMVVRKPAHRFLDELEIEYDEADHYVVIKHAALFTSTIMSKLLARPNVKLFNAVAAEDLIVKEGRVGGVVTNWALVAMNHNTQSCMDPNVMESKVVVSSCGHDGPFGATGVKRLKSIGMIDSIPGMKALDMNTAEDAIVRNTREVVPGMIVTGMEVAEIDGAPRMGPTFGAMMISGQKAAHLALRALGLPNALDGTLAMHPELVLAAAESADIVDA

SEQ ID NO: 2706 - protein, 354 aa, Arachis hypogaea
MASTTISSPSFTKTASPSSLLSHNTVFRLNPQQHARKNFNLSLRASMSASSPSPPPYDLQSFKFEPIRESIVSREMTRRYMTDMVTHADTDVVIVGAGSAGLSCAYELSKNPSVNIAIIEQSVSPGGGAWLGGQLFSAMVVRKPAHLFLDELGIEYDEQENYVVIKHAALFTSTIMSKLLARPNVKLFNAVAAEDLIVKNNRVGGVVTNWALVSMNHDTQSCMDPNVMEAKVVVSSCGHDGPFGATGVKRLKSIGMIDSVPGMKALDMNAAEDAIVKLTREIVPGMIVTGMEVAEIDAAPRMGPTFGAMMISGQKAAHLALRALGLPNAMDYAANIPHLELVLAAAQSPHVVDA

SEQ ID NO: 2707 - protein, 351 aa, Valeriana officinalis
MATMATTTFTSSLSSKANSLYGVPLSSSSLSLRVKSTPQNLSSVSMSASNTPYDLNAFEFSPIKESIVAREMTRRYMTDMITYADTDVVIVGAGSAGLSCAYELSKNPDVQVAIIEQSVSPGGGAWLGGQLFSAMVVRKPAHLFLDELNIDYDEADNYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNTAEDAIVRLTREIVPGMIVTGMEVAEIDGSPRMGPTFGAMMISGQKAAHLALKALGLPNALDGNYVGTVQPELILAAADAAEIVDA

SEQ ID NO: 2708 - protein, 311 aa, Cajanus cajan
RASMSAAASPPPPYDLGSFKFAPIKESMVAREMTRRYMTDMVTHADTDVVIVGAGSAGLSCAYELSKNPSVKVAIVEQSVSPGGGAWLGGQLFSAMVVRKPANLFLDELGLEYDEQDNYVVMKHAALFTSTIMSKLLARPNVKLFNAVAAEDLIVKNGRVGGVVTNWALVSMNHDTQSCMDPNVMEAKVVVSSCGHDGPFGATGVKRLKSIGLIDTVPGMKALDMNKAEDAIVRLTREVVPGMIVTGMEVAEIDGAPRMGPTFGAMMISGQKAAHLALRALGLPNSLDYAGNVHPELILAAADQSAEIAEA

SEQ ID NO: 2709 - protein, 357 aa, Populus trichocarpa
MATMATTLTSLSTKSQKLSPFDTSSSFHGTPISKPTLRMQPTKSSSSPNVSISMSSPPYDLNAFKFEPIKESIVSREMTRRYMMDMITHADTDVVIVGAGSAGLSCAYELSKNPSVKIAIVEQSVSPGGGAWLGGQLFSAMVVRKPAHLFLNELGIEYDEQEDYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNAAEDAIVKLTREVVPGMIVTGMEVAEIDGSPRMGPTFGAMMISGQKAAHLALKSLGMPNALDGTFVGGIHPELILAAVESAEIAET

SEQ ID NO: 2710 - protein, 358 aa, Actinidia deliciosa
  misc_feature (337)..(337): Xaa can be any naturally occurring amino acid
  misc_feature (353)..(353): Xaa can be any naturally occurring amino acid
MATMATTFTPSLSSKSKPSFLDSRQPSSSFCGAPIWSSSRLQPLKSSISVSAAAQSPAYDLGSFKFEPIKESIVSREMTRRYMTDMITYADTDVVVVGAGSAGLSCAYELSKNPSVQVAIIEQSVSPGGGAWLGGQLFSAMVVRKPAHLFLDELDIEYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDSVPGMKALDMNAAEDAIVRLTREIVPGMIVTGMEVAEIDGSPRMGPTFGAMMISGQKAAHLALKALGLPNAMDGNYXGSIHPELILASADAAXEIVDA

SEQ ID NO: 2711 - protein, 353 aa, Castanea mollissima
MATMASTLTSKPQTLAFFDSSSFHGTPLAPPSSLRVHQPAKSSVAPHAISMSASPPPYDLKGFTFEPIKESIVSREMTRRYMTDMITFADTDVVVVGAGSAGLSCAYELSKNPSVQVAIIEQSVSPGGGAWLGGQLFSAMVVRKPAHLFLDELEIEYDEQDNYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALKALGLPNALDEGAIHPELILAAADSAEIAEA

SEQ ID NO: 2712 - protein, 280 aa, Primula obconica
MTRRYMTDMITYADTDVVVVGAGSAGLSCAYELSKNPNIQVAIIEQSVSPGGGAWLGGQLFSAMVVRKPAHLFLDELNIEYDEKDTYVVIKHAALFTSTIMSKLLARPNVKLFNAVAAEDLIVKGNRVAGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALKALGEPNALDGTFVGSIHPELILAAADGAETAEA

SEQ ID NO: 2713 - protein, 356 aa, Platanus occidentalis
MATMATALTSSLSKPKIPLLDNQSSFHGVPISSRAQSIRSSSPQNLSISMSSSPPYDLRSFQFEPIKESIVSREMSRRYMMDMITHADTDVVIVGAGSAGLSCAYELSKNPSIQIAIIEQSVSPGGGAWLGGQLFSAMVVRKPAHRFLDELDIEYDEQDNYVVIKHAALFTSTIMSKLLARPNVKLFNAVAAEDLIVKEGRVAGVVTNWALVSMNHGTQSCMDPNVMESKVVVSSCGHDGPFGATGVKRLKSIGMVDSVPGMKALDMNTAEDAIVRLTREVVPGMIVTGMEVAEIDGAPRMGPTFGAMMISGQKAAHLALKALGLPNAMDGNYSDMGSIHPELILAAAESGDIADA

SEQ ID NO: 2714 - protein, 342 aa, Brassica juncea
SLPLFHQASAPFRLLFPWLIHLLRRTCSVGLKPRSLSVRATAGYDLNAFTFEPIKESIVSREMTRRYMTDMITYAETDVVVVGAGSAGLSCAYEISKNPNVQVAIIEQSVSPGGGAWLGGQLFSAMIVRKPAHLFLDEIGVPYDEQDNYVVIKHAALFTSTIMSKLLARPNVKLFNAVAAEDLIVKGNRVGGVVTNWALVSMNHDTQSCMDPNVMEAKIVVSSCGHDGPFGATGVKRLKSIGLIDHVPGMKALDMNTAEDAIVRLTREVVPGMIVTGMEVAEIDGAPRMGPTFGAMMISGQKAAHLALKALGQPNVLDGSYVGNLSPELVLAAADSAETVDA

SEQ ID NO: 2715 - protein, 351 aa, Fraxinus spp
MATMTSTLASKTTFLDAKKSSFNGIPISSPIRVQPIKSTSQNLSISASSPPYDLKSFEFQPIKESIVSREMTRRYMMDMITYADTDVVIVGAGSAGLSCAYELSKNPSVQVAIIEQSVSPGGGAWLGGQLFSAMVVRKPAHHFLDELEIEYDEQDDYVVIKHAALFTSTIMSKLLARPNVKLFNAVAAEDLIVKGGRVSGVVTNWALVSMNHDTQSCMDPNVMEAKVVVSSCGHDGPFGATGVKRLKSIGMIDNVPGMKALDMNTAEDAIVRLTREIVPGMIVTGMEVAEIDGAPRMGPTFGAMMISGQKAAHLALRSLGLPNELDGTNVGNVQPELILAAADDGNEIVEA

SEQ ID NO: 2716 - protein, 352 aa, Scabiosa columbaria
MATMATLTSSLSSVSSKTNSFYGVPVFSQTRLRSVKSNPQNLSISMSATSTPYDLSAFEFSPIKESIVAREMTRRYMTDMITFADTDVVIVGAGSAGLSCAYELSKNPDVQVAIIEQSVSPGGGAWLGGQLFSAMVVRKPAHLFLDELDIEYDETDNYVVIKHAALFTSTIMSKLLARPNVKLFNAVAAEDLIVKGGRVGGVVTNWALVSMNHDTQSCMDPNVMEAKVVVSSCGHDGPFGATGVKRLRSIGMIESVPGMKALDMNTAEDAIVRLTREIVPGMIVTGMEVAEIDGSPRMGPTFGAMMISGQKAAHLALRALGLPNALDGNYVGSVQPELILAAADAAADIVDA

SEQ ID NO: 2717 - protein, 581 aa, Trigonella foenum-graecum
MAAVTSSCSTAISASSKTLAKPATTSFAAANLSFSKLHPQSVKARRCIAVGGALGARMVSAPPATLPVSLDFETSIFKKERVNLAGHEEYIVKGGRDLFHLLPDAFKGIKQIGVIGWGSQGPAQAQNLRDSLAEAKSDIVVKIGLRKGSRSFNEAREAGFTEESGTLGDIWETISASDLVLLLISDSAQADNYEKIFSHMKPNSILGLSHGFLLGHLQSVGLDFPKHFSVIAVCPKGMGPSVRRLYVQGKEINGAGINSSFAVHQDVDGRATDVALGWSVALGSPFTFATTLEQEYKSDIFGERGILLGAVHGIVESLFRRYTENGMSEDLAYKNTVESITGVISKTISTKGMLAVYNALSEDGKREFEKAYSASFYPCMDILYECYEDVASGSEIRSVVLAGRRFYEKEGLPAFPMGKIDQTRMWKVGELVRSTRPAGDLGPLYPFTAGVFVALMMAQIEILRKKGHSYSEIINESVIESVDSLNPFMHARGVSFMVDNCSTTARLGSRKWAPRFDYILTQQALVAVDNGAPINQDLISNFMSDPVHGAIEVCAQLRPTLDISVPADADFVRPELRQSSN

SEQ ID NO: 2718 - protein, 581 aa, Pisum sativum
MAAVTSSCSTAISASSKTLAKPVAASFAPTNLSFSKLSPQSIRARRSITVGSALGATKVSAPPATHPVSLDFETSVFKKERVNLAGHEEYIVRGGRDLFHLLPDAFKGIKQIGVIGWGSQGPAQAQNLRDSLVEAKSDIVVKVGLRKGSSSFNEAREAGFSEEKGTLGDIWETISGSDLVLLLISDSAQADNYEKIFSHLKPNSILGLSHGFLLGHLQSIGLDFPKNFSVIAVCPKGMGPSVRRLYVQGKEINGAGINSSFGVHQDVDGRATNVALGWSVALGSPFTFATTLEQEYKSDIFGERGILLGAVHGIVESLFRRYTENGMSEDLAYKNTVESITGVISKTISTQGMLAVYNALSEDGKKEFEKAYSASFYPCMEILYECYEDVASGSEIRSVVLAGRRFYEKEGLPAFPMGKIDQTRMWKVGERVRSTRPAGDLGPLYPFTAGVFVALMMAQIEVLRKKGHSYSEIINESVIESVDSLNPFMHARGVSFMVDNCSTTARLGSRKWAPRFDYILTQQALVAVDSGAPINQDLISNFVSDPVHGAIQVCAELRPTLDISVPADADFVRPELRQSSN

SEQ ID NO: 2719 - protein, 581 aa, Cajanus cajan
MAAATSCSSAISAASETLPKPPSAAFSATSLALPSSSSKLAFKSLRLRPCASALGARMVSAPPVKAPALLDFDTNIFKKEKINLAGHDEYIVRGGRDLFHLLPDAFKGIKQIGVIGWGSQGPAQAQNLRDSLAEAKSDIVVKIGLRKGSRSFAEARAAGFSEENGTLGDIYETVSGSDLVLLLISDSAQADNYEKIFSYMKPNSILGLSHGFLLGHLQSQGLDFPKNISVIAVCPKGMGPSVRRLYVQGKEINGAGINSSFAVHQDVDGRATDVALAWSVALGSPFTFATTLEQEYRSDIFGERGILLGAVHGVVESLFRRFTEHGMNEDLAYKNTVESITGIISKTISTKGMLAVYNSLSEDEKKEFEKAYSASYYPCMEILYECYEDVASGSEIRSVVLAGRRFYEKEGLPAFPMGNIDQTRMWKVGERVRSTRPAGDQGPLYPFTAGVFVALMMAQIEILRKKGHSYSEIINESVIEAVDSLNPFMHARGVSFMVDNCSTTARLGSRKWAPRFDYILTQQALVAVDSGKPINRSLISNFLSDPVHAAIKVCAELRPTVDISVSADADFVRPELRQSNN

SEQ ID NO: 2720 - protein, 586 aa, Fragaria vesca
MAAATSSFSPALTAPPSSSSAAASKTYPAPSSLGFSSALSKSLHPLRARATRAAANGSALGARMVSVPAIKTPLSLDFETSVFKKEKINLAGHDEYIVRGGRDLFHLLPDAFKGIKQIGVIGWGSQGPAQAQNLRDSLAEAKSDIVVKIGLRKGSRSFNEARAVGFTEESGTLGDIWETVSSSDLVLLLISDSAQADNYEKIFSHMKPNSILGLSHGFLLGHLQSVGLDFPKNISVIAVCPKGMGPSVRRLYVQGKEINGAGINSSFAVHQDVDGRATDVALGWSVALGSPFSFVTTLEQEYKSDIFGERGILLGAVHGIVESLFRRYTDSGMSEDSAYKNTVECVTGIVSRTISTKGMLEIYNSLSEADKKEFEAAYSASYYPCMDILYECYEDVASGSEIRSVVLAGRRFYEKDGLPAFPMGKIDQTRMWKVGERVRATRPAGDLGPLHPFTAGVFVALMMAQIEVLRKKGHSYSEIINESVIESVDSLNPFMHARGVSFMVDNCSTTARLGSRKWAPRFDYILTQQALVAVDNGTPINQDLISNFLSDPVHGAIEVCAQLRPTVDISVPADADFVRPELRSSN

SEQ ID NO: 2721 - protein, 585 aa, Lippia dulcis
MAATAPTCFSNTATSSKTLTQQSKTPALSVGFLSSRSLKPLRAAAAASRGASVSGSGLSARMVSAPTIKPPASLDFETSIFTKEKVNLAGHDEYIVRGGRNLFKLLPDAFKGIKQIGVIGWGSQGPAQAQNLRDSLAEVKSDIVVKIGLRKGSKSFAEARAAGFTEESGTLGDIWETVSSSDLVMLLISDAAQADNYEKIFSHMKPNSILGLSHGFLLGHLQSMGLDFPKNISVIAVCPKGMGPSVRRLYVQGKEINGAGINSSFAVHQDVDGRATDVALGWSVALGSPFTFATTLEQEYKSDIFGERGILLGAVHGVVECLFRRFTEKGMSEDLAYKNTVESITGIISRTISTKGMLAVYNSLDEQGKKDFETAYSSSYYPCMDILYECYEDVASGSEIRSVVLAGRRFHEKDGLPSFPMGKIDQTRMWKVGERVRATRPAGDLGPLYPFTAGVFVALMMAQIEILRKKGHSYSEIINESVIEAVDSLNPFMHARGVSFMVDNCSTTARLGSRKWAPRFDYVLTQQALVAVDNGTPVNRDLISNFLSDPVHGAIDVCAQLRPTVDISVTADADFVRPELRQSAN

SEQ ID NO: 2722 - protein, 272 aa, Euonymus alatus
MAAATSSISSAISTGSSSSRSKDLKVPATPAGVSLGFLASSSMALKPLKASRCIGGSALGARMVSVPSSVKPLTSLDFETSVFKKEKVTLAGHDEYIVRGGRDLFPLLSDAFKGIKQIGVIGWGSQGPAQAQNLRDSLAEAKSDVVVKIGLRKGSHSFAEARAVGFTEENGTLGDIWETVSGSDLVLLLISDAAQADNYEKIFSHMKPNSILGLSHGFLLGHLQSMGLDFPKNISVIAVCPKGMGPSVRRLYVQGKEINGAESMPVLESTRT

SEQ ID NO: 2723 - protein, 587 aa, Euonymus alatus
MAAATSSISSAISTGSSSSRSKDLKVPATPGGVSLGFLSSSSMALKPLKASRCIGGSALGARMVSVPSSVKPLTSLDFETSVFKKEKVTLAGHDEYIVRGGRDLFPLLSDAFKGIKQIGVIGWGSQGPAQAQNLRDSLAEAKSDVVVKIGLRKGSHSVAEARAVGFTEENGTLGDIWETVSGSDLVLLLISDAAQADNYEKIFSHMKPNSILGLSHGFLLGHLQSMGLDFPKNISVIAVCPKGMGPSVRRLYVQGKEINGAGINASFGVHQDVDGRATDVALGWSVALGSPFTFATTLEQEYKSDIFGERGILLGAVHGIVESLFRRFTEHGMSEETAYNNTVECITGNISRTISTQGMLAVYNSLSEEGKRDFEIAYSASYYPLMDILYECYEDVACGSEIRSVVLAGRRFHEKDGLPAFPMGKIDQTRMWKVGERVRSVRPAGDLGPLYPFTAGVYVALMMAQIEILRKKGHSYSEIINESVIESVDSLNPFMHARGLSFMVDNCSTTARLGSRKWAPRFDYILTQQALVAVDNGTPVNGDLISNFLSDQVHGAIEVCAQLRPTVDISVPADADFVRPELRQSSS

SEQ ID NO: 2724 - protein, 591 aa, Tripterygium wilfordii
MAAATSSISSAISTARSSSSKCKALKAPATPAGVSLGFLASSSRALKPLRSSRCVGGGNGSALGARMVSAPASVKPLTSLDFETSVFKKEKVTLAGNDEYIVRGGRDLFPLLPDAFKGIKQIGVIGWGSQGPAQAQNLRDSLAEAKSDVVVKIGLRKGSRSFAEARAAGFTEENGTLGDIWDTISGSDLVLLLISDSAQADNYEKVFSHMKPNSILGLSHGFLLGHLQSMGLDFPKNISVIAVCPKGMGPSVRRLYVQGKEINGAGINASFAVHQDVDGSATDVALGWSVALGSPFTFATTLEQEYKSDIFGERGILLGAVHGIVESLFRRFTEHGMSEETAYKNTVECITGNISRTISTQGMLAVYNSLSEEGKRDFEIAYSASYYPLMDILYECYEDVASGNEIRSVVLAGRRFYEKDGLPAFPMGNIDQTRMWKVGERVRSVRPAGDLGPLYPFTAGVFVALMMAQIEILRKKGHSYSEIINESVIESVDSLNPFMHARGLSFMVDNCSTTARLGSRKWAPRFDYILTQQALVAVDNGTSVNGDLISNFLSDQVHGAIEVCAQLRPTVDISVPADADFVRPELRQSSG

SEQ ID NO: 2725 - protein, 590 aa, Orobanche aegyptiaca
MAAAAPTSFSTSTHTPIATPSSKALIPPTRAPTISLGFLSSSSPSHKPLRAAAASRAASGSAVAARMVADPAIKTPEFLDFDTSVFTKEKINLAGHDEYIVRGGRDLFKLLPDAFKGIKQIGVIGWGSQGPAQAQNIRDSLGEVKSDIVVKIGLRKGSSSFAEARAAGFTEENGTLGDIWETVSSSDLVLLLISDAAQADNYEKVFSHMKPNSILGLSHGFLLGHLQSMGLNFPQNISVIAVCPKGMGPSVRRLYVQGKEINGAGINASFAVHQDVDGRATDVALGWSVALGSPFTFATTLEQEYKSDIFGERGILLGAVHGVVESLFRRYTENGMSEDLAYKNTVESITGIISKTISTKGMLAVYNALSEGDKKEFEAAYSASYYPCMDILYECYEDVASGSEIRSVVLAGRRFYEKEGLPAFPMGKIDQTRMWKIGERVRATRPAGDLGPLYPFTAGVFVALMMAQIEILRKKGHSYSEIINESVIESVDSLNPFMHARGVSFMVDNCSTTARLGSRKWAPRFDYILTQQALVAVDSAAPINRDLISNFLSDPIHGAIQVCAQLRPTVDISVPADADFVRPELRQSGN

SEQ ID NO: 2726 - protein, 583 aa, Citrus clementina
MVAGTLPSSPSIPKFSPSPSSETLKGAFKHLNLAFFSSTAKSLRALKTTRGRGSALGAQMASETALKTPFLLDFETSVFKKDAISLANRDEFIVRGGRDLFKLLPDAFNGINQIGVIGWGSQGPAQAQNLRDSLAEAKSDIVVKVGLRKGSRSFAEARAAGFTEENGTLGDIYETISGSDLVLLLISDAAQADNYEKIFSCMKPNSILGLSHGFLLGHLQSIGLDFPKNISVIAVCPKGMGPSVRRLYVQGKEINGAGINSSFAVHQDVDGRATNVALGWSVALGSPFTFATTLEQEYKSDIFGERGILLGAVHGIVESLFRRFTENGMSEDLAYKNTVECITGIISKIISTQGMLAVYNSFSGEDKKEFEKAYSASYYPCMEILYECYEDVAAGSEIRSVVLAGRRFYEKEGLPAFPMGKIDQTRMWKVGERVRSTRPAGDLGPLHPFTAGVYVALMMAQIEILRKKGHSYSEIINESVIESVDSLNPFMHARGVSFMVDNCSTTARLGSRKWAPRFDYILTQQALVAVDNDAPINGDLISNFLSDPVHGAIEVCAQLRPTVDISVPPDADFVRPELRQGSN

SEQ ID NO: 2727 - protein, 583 aa, Citrus sinensis
MVAGTLPLSPSIPKLSPSPSSETLKGALKHLNLAFFSSTAKSLRALKTTRGRGSALGARMASETALKTPFLLDFETSVFKKDAISLADRDEFIVRGGRDLFKLLPDAFNGINQIGVIGWGSQGPAQAQNLRDSLAEAKSDIVVKVGLRKGSRSFAEARAAGFTEENGTLGDIYETISGSDLVLLLISDAAQADNYEKIFSCMKPNSILGLSHGFLLGHLQSMGLDFPKNISVIAVCPKGMGPSVRRLYVQGKEINGAGINSSFAVHQDVDGRATNVALGWSVALGSPFTFATTLEQEYKSDIFGERGILLGAVHGIVESLFRRFTENGMSEDLAYKNTVECITGIISKIISTQGMLAVYNSFSGEDKKEFEKAYSASYYPCMEILYECYEDVAAGSEIRSVVLAGRRFYEKEGLPAFPMGKIDQTRMWKVGERVRSTRPAGDLGPLHPFTAGVYAALMMAQIEILRKKGHSYSEIINESVIESVDSLNPFMHARGVSFMVDNCSTTARLGSRKWAPRFDYILTQQALVAVDNDAPINGDLISNFLSDPVHGAIEVCAQLRPTVDISVPPDADFVRPELRQGSN

SEQ ID NO: 2728 - protein, 578 aa, Oryza sativa
MAASTTLALSHPKTLAAAAAAAPKAPTAPAAVSFPVSHAACAPLAARRRAVTAMVAAPPAVGAAMPSLDFDTSVFNKEKVSLAGHEEYIVRGGRNLFPLLPEAFKGIKQIGVIGWGSQGPAQAQNLRDSLAEAKSDIVVKIGLRKGSKSFDEARAAGFTEESGTLGDIWETVSGSDLVLLLISDAAQADNYEKIFSHMKPNSILGLSHGFLLGHLQSAGLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTEQGMDEEMAYKNTVEGITGIISKTISKKGMLEVYNSLTEEGKKEFNKAYSASFYPCMDILYECYEDVASGSEIRSVVLAGRRFYEKEGLPAFPMGNIDQTRMWKVGEKVRSTRPENDLGPLHPFTAGVYVALMMAQIEVLRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSS

SEQ ID NO: 2729 - protein, 583 aa, Unknown
  Sequence found in Organisms: Citrus clementina, Citrus sinensis
MAAATLPFSRPIPKFSPSPSSETLKEALKHLNLASFSSTAKSLRALKTTTGRGSALSAWMASETALKTPFLLDFETSVFKKDMISLADRDEYIVRGGRDLFNLLPDAFNGINQIGVIGWGSQGPAQAQNLRDSLAEAKSDIVVKVGLRKGSRSFAEARAAGFTEENGTLGDIYETISGSDLVLLLISDAAQADNYEKIFSCMKPNSILGLSHGFLLGHLQSMGLDFPKNIGVIAVCPKGMGPSVRRLYVQGKEINGAGINSSFAVHQDVDGRATNVALGWSVALGSPFTFATTLEQEYRSDIFGERGILLGAVHGIVESLFRRFTENGMNEDLAYKNTVECITGIISKIISTQGMLAVYNSFSGEDKKEFEKAYSASYYPCMEILYECYEDVAAGSEIRSVVLAGRRFYEKEGLPAFPMGKIDQTRMWKVGERVRSTRPAGDLGPLHPFTAGVYAALMMAQIEILRKKGHSYSEIINESVIESVDSLNPFMHARGVSFMVDNCSTTARLGSRKWAPRFDYILTQQALVAVDNDAPINGDLISNFLSDPVHGAIEVCAQLRPTVDISVPPDADFVRPELRQGSN

SEQ ID NO: 2730 - protein, 342 aa, Vaccinium corymbosum
MGPSVRRLYVQGKQINGAGINSSFAVHQDVDGRATDVALGWSVALGSPFTFATTLEQEYKSDIFGERGILLGAVHGIVETLFRRFTENGISEDLAYKNTVECITGVISRTISTQGMLALYNSLSEDGKKEFEAAYSASYYPSMDILYECYEDVAAGSEIRSVVLAGRRFYEKDGLPAFPMGKIDQTRMWKVGERVRAVRPEGDLGPLYPFTAGVYVALMMAQIEVLRKKGHSYSEIINESVIEAVDSLNPFMHARGVSFMVDNCSTTARLGSRKWAPRFDYILTQQALVAVDNGAPINRDLVSNFLSDPVHGAIEVCASLRPTVDISVPADADFVRPELRSN

SEQ ID NO: 2731 - protein, 283 aa, Antirrhinum majus
  misc_feature (239)..(239): Xaa can be any naturally occurring amino acid
  misc_feature (253)..(253): Xaa can be any naturally occurring amino acid
MPQGMGPSVRRLYVQGKEINGAGINASFAVHQDVDGRATDVALGWSVALGSPFTFATTLEQEYKSDIFGERGILLGAVHGIVESLFRRFTENGMSEDDAYKNTVESITGIISKTISTKGMLAVYNSLSEEGKRDFEAAYSASYYPCMDILYECYEDVASGSEIRSVVLAGRRFYEKDGLPAFPMGKIDQTRMWKVGERVRATRPAGDLGPLYPFTAGVFVALMMAQIEVLRKKGHSYSXIINESVIESVDSLXPFMHARGVSFMVDNCSTTARLGSRKWAPRS

SEQ ID NO: 2732 - protein, 588 aa, Manihot esculenta
MAAAAAKLALSAPSLSPPSSSLKPNASRSSLGFASSSSPSLKSLVSRVHTRQIASSSGSSSLSVKMVSVPSIAQTSLDFDTSVFKKEKVTLAGHDEYIVRGGRDLFPMLPDAFKGIKQIGVIGWGSQGPAQAQNLRDSLAEAKSDIVVKIGLRKGSRSFAEARAAGFTEESGTLGDIWETIAGSDLVLLLISDAAQADNYEKIFSHMKPNSILGLSHGFLLGHLQSSGLHFPKNISVIAVCPKGMGPSVRRLYVQGKEINGAGINSSFAVHQDVDGRATDVALGWSVALGSPFTFATTLEQEYRSDIFGERGILLGAVHGVVECLFRRYTENGMNEDLAYKNTVECITGIISKTISTKGMLAVYNSLSEEGKRDFETAYSASYYPCMDILYECYEDVASGSEIRSVVLAGRRFYEKEGLPAFPMGKIDQTRMWKVGERVRATRPKGDLGPLYPFTAGVFVALMMAQIEVLRKKGHSYSEIINESVIEAVDSLNPFMHARGVSFMVDNCSTTARLGSRKWAPRFDYILTQQAFVAVDAGAPLNQDLISNFLSDSVHGAIEVCAQLRPTVDISVPPDADFVRPELRQSGN

SEQ ID NO: 2733 - protein, 569 aa, Tripterygium wilfordii
SKSKALKGPASLGAVSLGSLASSSRALKPLRASRCIGGGNGSALMVSVPASVKPLTSLDFETSVFKKEKVTLSGHDEYIVRGGRDLFPLLPDALKGIKQIGVIGWGSQGPAQAQNLRDSLAEAKSEVVVKIGLRKGSRSFAEARAAGFIEENGTLGDIWETVSGSDLVLLLISDAAQADNYEKIFSHMKPNSILGLSHGFLLGHLQSIGLDFPKNISVIAVCPKGMGPSVRRLYIQGKEINGAGINASFAVHQDVDGRATDVALGWSVALGSPFTFATTLEQEYKSDIFGERGILLGAVHGIVESLFRRFTEHGMSEETAYKNTVECITGNISRTISTQGMLAVYNSLSEEGKRDFEIAYSASYYPLMDILYECYEDVACGSEIRSVVLAGRRFYERDGLPAFPMGKIDQTRMWKVGERVRSVRPAGDLGPLHPFTAGVYVALMMAQIEILRKKGHSYSEIINESVIESVDSLNPFMHARGLSFMVDNCSTTARLGSRKWAPRFDYILTQQAMVAVDNGTPVNGDLISNFLSDQVHGAIEVCAQLRPTVDISVPPDADFVRPELRQSSG

SEQ ID NO: 2734 - protein, 587 aa, Gossypium hirsutum
MAATTTTTSFKAALLSTPSISSSTKSTVLKTRFTSSSSSRYSPIPKSLIAHHVSTKTNAIVAKMGTVPSPVSETTSLDFHTSVFQKEKISLAGHEEYIVRGGRHLFPLLDDAFKGIKQIGVIGWGSQGPAQAQNLRDSLAEAKSDVVVKIGLRKGSRSFAEARAAGFTEENGTLGDIWETVAGSDLVLLLISDSAQADNYEKVFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYKSDIFGERGILLGAVHGVVECLFRRYVEDGMSEELAYKNTVECITGIVSKTISTKGMLAVYNSLSEEGKKRFEVAYSASYYPCMEILYECYEDVASGSEIRSVVLAGRRFYEKEGLPAFPMGKIDQTRMWKVGERVRATRAKDDLGPLCPFTSGVFVALMMAQIEVLRKKGHSYSEIINESLIEAVDSLNPFMHARGVSFMVDNCSTTARLGSRKWAPRFDYNLTQQAFVAVDSGAPINQDLISNFLSDPVHEAIEVCAKLRPTVDISVPPDADFVRPELRQSS

SEQ ID NO: 2735 - protein, 524 aa, Papaver somniferum
MSVSAPTKPLTTLDFETSVFNKEKVTLAGNDEYIVRGGRDLFHLLPEAFKGIKQIGVIGWGSQGPAQAQNLRDSLVEAKSDIVVKIGLRKGSASFAEARSVGFTEETGTLGDIYETVAGSDLVLLLISDAAQADNYEKIFSHMKPNSILGLSHGFLLGHLQSQGVDFPKNMSVIAVCPKGMGPSVRRLYVQGKEINGAGINASFAVHQDVDGRATDVALGWSVALGSPFTFATTLESEYKSDIFGERGILLGAVHGIVESLFRRYTENGMAEDLAYKNTVECITGIVSRTISTEGMLSVYNSLSEQGKKDFHAAYSASYYPCMDILYECYEDVASGNEIKSVVLAGRRFYEKEGLPAFPMGKIDQTRMWLVGEKVRATRPEGDLGPLYPFTAGVFVALMMAQIEVLRKKGHSYSEIINESVIEAVDSLNPFMHARGVSFMVDNCSTTARLGSRKWAPRFDYILTQQALVAVDNNAPINQDLVSNFLSDPVHGAIEVCAQLRPTVDISVPVDADFVRVELRQSSN

SEQ ID NO: 2736 - protein, 587 aa, Gossypium raimondii
MAATTTTTSFKAALLSTPSISSSTKSTVLKTRFTSSSSSRYSPIPKSLIAHHVSTRTNAIVAKMGTVPSPVSETTSLDFHTSVFQKEKISLAGHEEYIVRGGRHLFPLLDDAFKGIKQIGVIGWGSQGPAQAQNLRDSLVEAKSDIVVKIGLRKGSRSFAEARAAGFTEENGTLGDIWETVAGSDLVLLLISDSAQADNYEKVFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYKSDIFGERGILLGAVHGVVECLFRRYVEDGMSEELAYKNTVECITGIVSKTISTKGMLAVYNSLSEEGKKRFEVAYSASYYPCMEILYECYEDVASGSEIRSVVLAGRRFYEKEGLPAFPMGKIDQTRMWKVGERVRATRAKDDLGPLCPFTSGVFVALMMAQIEVLRKKGHSYSEIINESLIEAVDSLNPFMHARGVSFMVDNCSTTARLGSRKWAPRFDYNLTQQAFVAVDSGAPINQDLISNFLSDPVHEAIEVCAKLRPTVDISVPPDADFVRPELRQYS

SEQ ID NO: 2737 - protein, 587 aa, Gossypium hirsutum
MAATTTTTSFKAALLSTPSISSSTKSTVLKTRFTSSSSSRYSPIPKSLIAHHVSTRTNAIVAKMGTVPSAVSETTSLDFHTSVFQKEKISLADHEEYIVRGGRHLFPLLDDAFKGIKQIGVIGWGSQGPAQAQNLRDSLVEAKSDIVVKIGLRKGSRSFAEARAAGFTEENGTLGDIWETVAGSDLVLLLISDSAQADNYEKVFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYKSDIFGERGILLGAVHGVVECLFRRYVEDGMSEELAYKNTVECITGIVSKTISTKGMLAVYNSLSEEGKKRFEVAYSASYYPCMEILYECYEDVASGSEIRSVVLAGRRFYEKEGLPAFPMGKIDQTRMWKVGERVRATRAKDDLGPLCPFTSGVFVALMMAQIEVLRKKGHSYSEIINESLIEAVDSLNPFMHARGVSFMVDNCSTTARLGSRKWAPRFDYNLTQQAFVAVDSGAPINQDLISNFLSDPVHESIEVCAKLRPTVDISVPPDADFVRPELRQYS

SEQ ID NO: 2738 - protein, 522 aa, Nicotiana tabacum
  misc_feature (3)..(3): Xaa can be any naturally occurring amino acid
  misc_feature (7)..(8): Xaa can be any naturally occurring amino acid
  misc_feature (12)..(12): Xaa can be any naturally occurring amino acid
  misc_feature (22)..(22): Xaa can be any naturally occurring amino acid
  misc_feature (26)..(26): Xaa can be any naturally occurring amino acid
  misc_feature (53)..(53): Xaa can be any naturally occurring amino acid
  misc_feature (289)..(289): Xaa can be any naturally occurring amino acid
  misc_feature (307)..(307): Xaa can be any naturally occurring amino acid
MVXAPAXXKAPXSLDFETSVFXKEKXTLAGHDEYIVRGGRDLFKYLPDAFKGXKQIGVIGWGSQGPAQAQNLRDSLAEAKSDIVVKIGLRKGSSSFAEARAAGFSEENGTLGDIYETISGSDLVLLLISDAAQADNYEQVFSHMKPNSILGLSHGFLLGHLQSMGLDFPKNISVIAVCPKGMGPSVRRLYVQGKEINGAGINASFAVHQDIDGRATDVALGWSVALGSPFTFATTLEQEYKSDIFGERGILLGAVHGVVESLFRRFTENGMNDELAYKNTVECITGIIXKTISTKGMLAVYNSLTEXGKKEFEAAYSASYYPCMEILYECYEDVATGSEIRSVVLAGRRFYEKEGLPAFPMGKIDQTRMWKVGERVRAKRPAGDLGPMYPFTAGVFVALMMAQIEILRKKGHSYSEIINESVIESVDSLNPFMHARGVSFMVDNCSTTARLGSRKWAPRFDYILTQQALVAVDNNATINGDLISNFLSDPIHGAIEVCAQLRPTVDISVTADADFVRPELRQ

SEQ ID NO: 2739 - protein, 511 aa, Vaccinium corymbosum
MIDFETSVFNKEKITLAGHDEYIVRGGRDLFPLLPEAFKGVKQIGVIGWGSQGPAQAQNLRDSLGEAKSDIVVKIGLRKGSRSFAEARAAGFTEENGTLGDIWETISGSDLVLLLISDAAQADNYEKVFSHMKPNSILGLSHGFLLGHLQSVGLDFPKNISVIAVCPKGMGPSVRRLYVQGKQINGAGINSSFAVHQDVDGRATDVALGWSVALGSPFTFATTLEQEYKSDIFGERGILLGAVHGIVETLFRRFTENGMSEDLAYKNTVECITGVISRTISTQGMLALYNSLSEDGKKEFEAAYSASYYPSMDILYECYEDVAAGSEIRSVVLAGRRFYEKDGLPAFPMGKIDQTRMWKVGERVRAVRPAGDLGPLYPFTAGVYVALMMAQIEVLRKKGHSYSEIINESVIEAVDSLNPFMHARGVSFMVDNCSTTARLGSRKWAPRFDYVLTQQALVAVDNGAPFNRDLISNFLSDPVHGAIEVCASLRPTVDISVPADADFVRPELRSN

SEQ ID NO: 2740 - protein, 335 aa, Trigonella foenum-graecum
MATVLRTPTFRPSPPLLTTSATSSNHPKTSRVSIASSRRKPSPLKYHRFASFRSLRFVKLVPFAFDGDTEAPQVQESPEVQVLDSSDGAVGVEDSTRDDEFSDAGEIPASPLIVLLQSYKEALANNDEVKVAELESSLKSIDDEIVGLEGKIASLSEELSIEKDRKLRIGADFDNYRKRTDRDRLSLVTNAQGEVVESLLPVLDNFERAKAQIKVETEGEEKINNSYQSIYKQFIEILNSLGVEPVETVGKPFDPMLHEAIMREDSDEFEDGIILQEFRKGFKLGDRLLRPSMVKVSAGPGPAKSEQEVQQEEQVTNEISQDSKETDGNTETESA

SEQ ID NO: 2741 - protein, 352 aa, Trifolium pratense
QPSPYLSLLHSSLFPPMATVLQTPTFRPSLTLLTTTTAATSSNHPKTSRVSITSSRRKLSSLKSLRFHSIPSLRFVKLIPFAFDGDTEAPQVQEQPEVQVLDSSDGAVAVEDSTGDDEFSDAVEIPSSPLLVLLQSYKEALVNNDEVKVAELESSLKSIDDEIAGLEGKIASLSEELSIEKDRKLRIGADFDNYRKRTDRDRLSLVTNAQGEVVESLLPVLDNFERAKAQIKVETEGEEKINNSYQSIYKQFIEILNSLGVEPVETVGSPFDPMLHEAIMREDSDEFEEGIILQEFRKGFKLGDRLLRPSMVKVSAGPGPAKPEQASQEEQVTNEISEDGKEIDGSTETESA

SEQ ID NO: 2742 - protein, 922 aa, Glycine max
MALTKQIMGSSLLERSMFVPSSSSPSSFFNSTRFLVPLENKRVVRMKRAAKFPVAAISEDLMKGSSSSPSSSSSSSSVSTEKPVKFKVRAVITVRNKIKEDFKETIVKHIDALTDRIGRNVVLELVSTEIDPKTKSAKKSNEAVLKDWSKKSNLKAERVNYTAEFIVDSSFGEPGAITVTNKHQKEFFLESITIEGFASGPVHFPCNSWVQSRKDLPGKRIFFSNKPYLPGDTPAGLRLLREKELRNLRGDGKGVRNLSDRIYDYDIYNDLGNPDKGIELARPNLGGSDMYPYPRRCRTGREPSDTDMYAESRVEKPLPMYVPRDERFEESKQNTFTVKRLKAVLHNLIPGLKASLSSSNQDFNEFSDVDGLYSEGLLIKLGWGLQDDVLKKIPFVSKIQESSQGLLKYDTPKIISKDKFAWLRDDEFARQAIAGVNPVNIERLQVFPPVSKLDPEIYGPQESALKEEHILNQLNGMTVQEAINENKLFMIDYHDIYLPFLEGINALDGRKSYATRTIFFLTPRSTLKPVAIELSLPHAGPNSRSKRVVTPPVDATTNWMWQLAKAHVCSNDAGVHQLVNHWLRTHANLEPFILAAHRQLSAMHPIFKLLDPHMRYTLEINTLARQSLIHADGIIENCFTPGRYAMEISSAAYKNFWRFDMDSLPADLIRRGMAVADPTQPHGLKLILEDYPYAADGILIWSAIEDWVRTYVNHYYPHSSLICNDKELQSWYSESINVGHADLRHENWWPTLNNSEDLVSILSTLIWNASAQHAALNFGQYPYGGYVPNRPPLMRRLIPEEGDPEYASFIADPQKYFLNALPSLLQATKFMAVVDTLSTHSPDEEYLGERQQPSIWSGDAEIVEAFYDFSAKVQQIEKVIDGRNLDRTLRNRCGAGVLPYELLAPSSEPGVTCRGVPNSVST

SEQ ID NO: 2743 - protein, 927 aa, Glycine max
MALTKQILGSSLLERSMFVPSSSPSSLLNQTRFLVPLENKRVVRVKRAAKFPVAAISEDLMKGSSSSPSSSSSSSSSSSSSSVSTEKPVKFKVRAVITVRNKIKEDFKETIVKHIDALTDRIGRNVVLELVSTEIDPKTKSAKKSNEAVLKDWSKKSNLKAERVNYTAEFIIDSSFGEPGAITVTNKHQKEFFLDSITIEGFASGPVHFPCNSWVQSRKDLPGKRIFFSNKPYLPGDTPAGLRLLREKELRNLRGDGKGVRNLSDRIYDYDIYNDLGNPDKGIELARPNLGGSDMYPYPRRCRTGREPSDTDMYAESRVEKPLPMYVPRDERFEESKQNTFTVKRLKAVLHNLIPGLKASLSSSNQDFNEFSDVDGLYSEGLLIKLGWGLQDDVLKKIPFVSKIQESSQGLLKYDTPKIISKDKFAWLRDDEFARQAIAGVNPVNIEKLQVFPPVSKLDPEIYGPQESALKEEHILNQLNGMTVQEAINENKLFMIDYHDIYLPFLEGINALDGRKSYATRTIFFLTPRGTLKPVAIELSLPHAGPNSRSKRVVTPPVDATTNWMWQLAKAHVCSNDAGVHQLVNHWLRTHANLEPFILAAHRQLSAMHPIFKLLDPHMRYTLEINALARQSLINADGIIENCFTPGRYAMEISSAAYKNFWRFDMDSLPADLIRRGMAVPDPTQPHGLKLILEDYPYAADGILIWSAIEDWVRTYVNHYYPHSSLICNDKELQSWYSESINVGHADLRHESWWPTLNNSEDLVSILSTLIWNASAQHAALNFGQYPYGGYVPNRPPLMRRLIPEEGDPEYASFHADPQKYFLNALPSLLQATKFMAVVDTLSTHSPDEEYLGERQQPSIWSGDAEIVEAFYDFSAKVRQIEKVIDSRNLDRTLRNRCGAGVLPYELLAPSSEPGVTCRGVPNSVST

SEQ ID NO: 2744 - protein, 919 aa, Phaseolus coccineus
MTLTKQIMGSSLLERSLFVPSSPSSLLNQTRFLVPLESKRVVRVRKAAKFPVAAISEDLVKSSSSSSSPSSSSTSSVSAEKPVKFKVRAVITVRNKIKEDFKETIVKHIDALTDRIGRNVVFELVSTEIDPKTKAAKKSNEAVLKDWSKKSNLKVERVNYTAEFIVDSNFGEPGAITVTNKHQKELFLESITIEGFANGPVHFPCNSWVQARKDHPGKRIFFSNKPYLPGDTPAGLRLLREKELKNLRGDGKGVRNLSDRIYDYDIYNDLGNPDKGIEYARQNLGGSDMYPYPRRCRTGREPSDTDMYAESRVEKPLPMYVPRDERFEESKQNTFTVKRLKAVLHNLIPGLKASLSASNQDFNEFSDVDGLYSEGLLIKLGLQDDMLKKIPFVSKIQESSQGLLKYDTPKIISKDKFAWLRDDEFARQAIAGVNPVSIEKLKVFPPVSKLDPQIYGPQESALKEEHILTQLNGMTVQEAINENKLFIVDYHDIYLPFLEGINALDGRKSYATRTIFFSTPRGTLKPVAIELSLPFAGPSSRSKRVVTPPVDATTNWMWMLAKAHVCSNDAGVHQLVNHWLRTHANLEPFILAAHRQLSAMHPIYKLLDPHMRYTLEINALARQSLINADGIIENCFTPGRYAMEISSAAYKNFWRFDMDSLPADLIRRGMAVPDPTQPHGLKLTLEDYPYAADGILIWSAIEDWVRTYVNHYYPHSSLICNDKELQAWYSESINVGHADLRHESWWPTLNNSEDLVSILSILIWNASAQHAALNFGQYPYGGYVPNRPPLTRRLIPEEGDPEYASFLADPQKYYLNALPSLLQATKFMAVVDTLSTHSPDEEYLGDRQQPSIWSGDAEIIEAFYDFSAKIRQIEKVIDSRNLDKTLRNRCGAGVLPYELLAPSSESGVTCRGVPNSVST

SEQ ID NO: 2745 - protein, 922 aa, Cajanus cajan
MALTKQIMGSSLLERSFFVPSTSSSFQLNQTRFLVPLDKEKVLRVRKDAKFPVAAISEDLVKGSSSSPPSPSSASSTSLVSTEKPVKFKVRAVITVRNKIKEDFKETIVKHIDAITDRIGRNVVLELVSTEIDPKTKAAKKSSEAVLKDWAKKSNVKAERVNYTAEFIVDSSFGEPGAITVTNKHQKEFFLESITIEGFASGPVHFPCNSWVQARKDHPGKRIFFSNKPYLPGDTPAGLRLLREKELRNLRGDGKGVRKLSDRVYDYDIYNDLGNPDKGIDLARPNLGGSDMYPYPRRCRTGREPSDTDMYAESRVEKPLPMYVPRDERFEESKQNTFSVKRLKAVLHNLIPGLKASLSANNQDFNEFKDVDGLYSEGLLIKLGLQDDMLKKIPFVSKIQESSQGLLKYDTPKIISKDKFAWLRDDEFARQTIAGVNPVNIESLKVFPPVSKLDPEIYGPPESALKEEHILSQLNGMTVQEAIDENKLFIIDYHDIYLPFLEGINALDGRKSYATRTIFFSTPRGALKPVAIELSLPPAGPSSRSKRVVTPPVDATTNWMWQLAKAHVCSNDAGVHQLVNHWLRTHACMEPFILAAHRQLSAMHPIFKLLDPHMRYTLEINALARQGLINADGIIENCFTPGRYAMEISSAAYKNIWRFDMDSLPADLIRRGMAVPDSTQPHGLKLILEDYPYAADGILIWSAIEDWVRTYVNHYYPHSSLICNDKELQSWYSESINVGHADLRHESWWPTLNNSEDLVSILSILIWNASAQHAALNFGQYPYGGYVPNRPPLMRRLIPEESDPEYASFLADPQKYFLNALPSLLQATKYMAVVDTLSTHSPDEEYLGERQQPSIWSGDAEIIEAFYDFSAKIRQIEKVIDGRNLDRNLRNRCGAGVLPYELLAPSSEPGVTCRGVPNSVST

SEQ ID NO: 2746 - protein, 915 aa, Cajanus cajan
MGSSLLERSFFVPSTSSSFQLNQTRFLVPLDKEKVLRVRKDAKFPVAAISEDLVKGSSSSPPSPSSASSTSLVSTEKPVKFKVRAVITVRNKIKEDFKETIVKHIDAITDRIGRNVVLELVSTEIDPKTKAAKKSSEAVLKDWAKKSNVKAERVNYTAEFIVDSSFGEPGAITVTNKHQKEFFLESITIEGFASGPVHFPCNSWVQARKDHPGKRIFFSNKPYLPGDTPAGLRLLREKELRNLRGDGKGVRKLSDRVYDYDIYNDLGNPDKGIDLARPNLGGSDMYPYPRRCRTGREPSDTDMYAESRVEKPLPMYVPRDERFEESKQNTFSVKRLKAVLHNLIPGLKASLSANNQDFNEFKDVDGLYSEGLLIKLGLQDDMLKKIPFVSKIQESSQGLLKYDTPKIISKDKFAWLRDDEFARQTIAGVNPVNIESLKVFPPVSKLDPEIYGPPESALKEEHILSQLNGMTVQEAIDENKLFIIDYHDIYLPFLEGINALDGRKSYATRTIFFSTPRGALKPVAIELSLPPAGPSSRSKRVVTPPVDATTNWMWQLAKAHVCSNDAGVHQLVNHWLRTHACMEPFILAAHRQLSAMHPIFKLLDPHMRYTLEINALARQGLINADGIIENCFTPGRYAMEISSAAYKNIWRFDMDSLPADLIRRGMAVPDSTQPHGLKLILEDYPYAADGILIWSAIEDWVRTYVNHYYPHSSLICNDKELQSWYSESINVGHADLRHESWWPTLNNSEDLVSILSILIWNASAQHAALNFGQYPYGGYVPNRPPLMRRLIPEESDPEYASFLADPQKYFLNALPSLLQATKYMAVVDTLSTHSPDEEYLGERQQPSIWSGDAEIIEAFYDFSAKIRQIEKVIDGRNLDRNLRNRCGAGVLPYELLAPSSEPGVTCRGVPNSVST

SEQ ID NO: 2747 - protein, 91 aa, Trigonella foenum-graecum
MAWRSGSLSRSIYSAARSIPARSSLQHSSTSSIRSHLLLHPRRPLLTVPRTLGILGCTQSLMPLHNADAAARLTSHISVELRACCELSQGT

SEQ ID NO: 2748 - protein, 92 aa, Cicer arietinum
MAWRCGSLSRSIFSASRTIPTRSSPSLQRSSSSLLRSHLLHPRRPLVTVPRTLGILGCTQSLMPLHNADAAARLTSHISVELRACCELSQGT

SEQ ID NO: 2749 - protein, 90 aa, Pisum sativum
MAWRSGSLSRSIFSAARTIPTRSSLQNSSASSIRSHLLHPRRPHATLPRSLGILGCTQSLMPLYNADAAARLTSHISVDFRACCELSQGT

SEQ ID NO: 2750 - protein, 87 aa, Lotus japonicus
MALRSGSLSRSLLSAARTIPRRSSIPRPSIRSHLLHPRRPLVTVPRTMGILGCTQSLLPLHSADAAARLTSHISVELRACCELSQGT

SEQ ID NO: 2751 - protein, 183 aa, Trigonella foenum-graecum
MVCIRKATVNDLLAMQACNLFCLPENYQMKYYLYHILSWPQLLYVAEDYNGRIVGYVLAKMEEETNECHGHITSLAVLRTHRKLGIATKLMTAAQNAMEQVFGAEYVSLHVRKSNRAAFNLYTETLGYKIHDVEAKYYADGEDAYDMRKQLKGKTIHPPQHHHHHHHHGGGCCSGETKGNAKG

SEQ ID NO: 2752 - protein, 188 aa, Cicer arietinum
MVCIRKATVNDLLAMQACNLFCLPENYQMKYYLYHILSWPQLLYVAEDYNGRIVGYVLAKMEEETNECHGHITSLAVLRTHRKLGLATKLMTAAQNAMEQVFGAEYVSLHVRKSNRAAFNLYTETLGYKIHDVEAKYYADGEDAYDMRKQLKGKQIHQHQHHHHHHHHGGGCCSGDMKAETKGNAKAI

SEQ ID NO: 2753 - protein, 182 aa, Pisum sativum
RKATVNDLLAMQACNLFCLPENYQMKYYLYHILSWPQLLYVAEDYNGRIVGYVLAKMEEETNECHGHITSLAVLRTHRKLGIATKLMTAAQNAMEQVFGAEYVSLHVRKSNRAAFNLYTETLGYKIHDVEAKYYADGEDAYDMRKQLKGKQLPQHQHQHHHHHHHHGGGCCSGETKGNAKAT

SEQ ID NO: 2754 - protein, 180 aa, Cicer arietinum
MVCIRKATVNDLLAMQACNLFCLPENYQMKYYLYHILSWPQLLYVAEDYNGRIVGYVLAKMEEETNECHGHITSLAVLRTHRKLGLATKLMTASQNAMEQVFGAEYVSLHVRKSNRAAFNLYTETLGYKIHDVEAKYYADGEDAYDMRKQLKGKQIHQHQHHHHHHHHGGGCCSGDMKAE

SEQ ID NO: 2755 - protein, 187 aa, Vigna unguiculata
MVCIRKATVKDLLAMQACNLFCLPENYQMKYYLYHILSWPQLLYVAEDYNGRIVGYVLAKMEEETTDCHGHITSLAVLRTHRKLGLATKLMTAAQNAMEQVFGAEYVSLHVRKSNRAAFNLYTETLGYKIHDVEAKYYADGEDAYDMRKQLKGKQHHHHHNHHHHHLHHEHGGGCCSGEVKGNAKAT

SEQ ID NO: 2756 - protein, 186 aa, Glycine max
MVCIRKATVKDLLAMQACNLFCLPENYQMKYYLYHILSWPQLLYVAEDYNGRIVGYVLAKMEEETTDCHGHITSLAVLRTHRKLGLATKLMTAAQNAMEQVFGAEYVSLHVRKSNRAAFNLYTETLGYKIHDVEAKYYADGEDAYDMRKQLKGKQHHHHHHHHHHRHEHGGGCCSGEPKGNVAKAT

SEQ ID NO: 2757 - protein, 190 aa, Glycine max
MVCIRKATVKDLLAMQACNLFCLPENYQMKYYLYHILSWPQLLYVAEDYNGRIVGYVLAKMEEETTDCHGHITSLAVLRTHRKLGLATKLMTAAQNAMEQVFGAEYVSLHVRKSNRAAFNLYTETLGYKIHDVEAKYYADGEDAYDMRKQLKGKQHHHHHHNHHHHHHHHHEHSGGCCSGEAKGNPAKAT

SEQ ID NO: 2758 - protein, 191 aa, Phaseolus coccineus
MVCIRKATVKDLLAMQACNLFCLPENYQMKYYLYHILSWPQLLYVAEDYNGRIVGYVLAKMEEETTDCHGHITSLAVLRTHRKLGLATKLMTAAQNAMEQVFGAEYVSLHVRKSNRAAFNLYTETLGYQIHDVEAKYYADGEDAYDMRKQLKGKQQHHQHHHHHHHHHHHHHHEHGGGCCSGDVKGNAKAT

SEQ ID NO: 2759 - protein, 191 aa, Phaseolus coccineus
MVCIRKATVKDLLAMQACNLFCLPENYQMKYYLYHILSWPQLLYVAEDYNGRIVGYVLAKMEEETTDCHGHITSLAVLRTHRKLGLATKLMTAAQNAMEQVFGAEYVSLHVRKSNRAAFNLYTETLGYQIHDVEAKYYADGEDAYDMRKQLKGKQHHHQHHHHHHHHHHHHHHEHGGGCCSGDVKGNAKAT

SEQ ID NO: 2760 - protein, 191 aa, Vigna unguiculata
MVCIRKATVKDLLAMQACNLFCLPENYQMKYYFYHILSWPQLLYVAEDYNGRIVGYVLAKMEEETTDCHGHITSLAVLRTHRKLGLATKLMTAAQNAMEQVFGAEYVSLHVRKSNRAAFNLYTETLGYKIHDVEAKYYADGEDAYDMRKQLKGKQQHQQHHHHHHHHHHHHHHEHGGMCCSGEVKGNAKAT

SEQ ID NO: 2761 - protein, 66 aa, Cirsium arvense
MVCIRKATIDDLLAMQACNLFCLPENYQMKYYFYHILSMAAAPLRRRRLWRQDRWICACQDGRREH

SEQ ID NO: 2762 - protein, 181 aa, Helianthus annuus
MVCIRKATMDDLLAMQACNLFCLPENYQMKYYFYHILSWPQLLYVAEDYGGKIVGYVLAKMEEETTECHGHITSLAVLRTHRKLGLATKLMVAAQNAMEQVFGAEYVSLHVRKSNRAAFNLYTETLGYKIHDMEAKYYADGEDAYDMRKELKGKPQHQHQHQHHHHHHHGGGCCSGEAKAE

SEQ ID NO: 2763 - protein, 201 aa, Fagopyrum esculentum
MVCIRKATMDDLLAMQACNLLCLPENYQMKYYLYHILSWPQLLYVAEDYNGRIVGYVLAKMEEETTECHGHITSLAVVRTHRKLGLATKLMTAAQNAMEQVYGAEYVSLHVRKSNRAAFNLYTGTLNYKIHDVEAKYYADGEDAYDMRKQLKGKSVGHGSAHHHHHHHGGGCCSGGHATAKSEGKVNHSGGKAEAKSGVAE

SEQ ID NO: 2764 - protein, 90 aa, Orobanche aegyptiaca
MVCIRKATVDDLLAMQECNLFCLPENYQMKYYLYHILSWPQLLYVAEDYNGKIVGYVLAKMEEESNECHGHITSLAVLRTHRNSALPLSS

SEQ ID NO: 2765 - protein, 180 aa, Ambrosia trifida
MVCIRKATMDDLLAMQACNLFCLPENYQMKYYLYHILSWPHLLYVAEDYGGKIVGYVLAKMEEETTECHGHITSLAVLRTHRKLGLATKLMLAAQNAMEQVFEAEYVSLHVRKSNRAAFNLYTETLGYKIHDMEAKYYADGEDAYDMRKELKGKPQHQHQHHHHHHHHGGGCCSGEAKAE

SEQ ID NO: 2766 - protein, 180 aa, Taraxacum officinale
MVCIRKATIDDLLAMQACNLFCLPENYQMKYYFYHILSWPQLLYVAEDYGGKIVGYVLAKMEEETTECHGHITSLAVLRTHRKLGLATKLMAAAQNAMEQVFGAEYVSLHVRKSNRAAFNLYTETLGYKIHDMEAKYYADGEDAYDMRKELKGKTQHQNHHHHHHHHHGGGCCSGDAKAE

SEQ ID NO: 2767 - protein, 179 aa, Senecio madagascariensis
MVCIRKATIDDLLAMQACNLFCLPENYQMKYYFYHILSWPQLLYVAEDYGGKIVGYVLAKMEEETTECHGHITSLAVLRTHRKLGLATKLMAAAQNAMEQVFGAEYVSLHVRKSNRAAFNLYTETLGYKIHDMEAKYYADGEDAYDMRKELKGKQLHHQHQHHHHHHGGGCCSGEAKAE

SEQ ID NO: 2768 - protein, 177 aa, Tragopogon dubius
MVCIRKATIDDLLAMQACNLFCLPENYQMKYYFYHILSWPQLLYVAEDYGGKIVGYVLAKMEEETTECHGHITSLAVLRTHRKLGLATKLMAAAQNAMEQVFGAEYVSLHVRKSNRAAFNLYTETLGYKIHDMEAKYYADGEDAYDMRKQLKGKTQHHHHHHHHHAGGCCSGDAKPE

SEQ ID NO: 2769 - protein, 194 aa, Cajanus cajan
MVCIRKATVKDLLAMQACNLFCLPENYQMKYYLYHILSWPQLLYVAEDYNNRIVGYVLAKMEEETSDCHGHITSLAVLRTHRKLGLATKLMTAAQNAMEQVFGAEYVSLHVRKSNRAAFNLYTETLGYKIHDVEAKYYADGEDAYDMRKQLKGKQHHQHHHNHHHHHHHHHHHHHHDHGGGCCSGEAKGNAKSA

SEQ ID NO: 2770 - protein, 200 aa, Fagopyrum esculentum
MVCIRKATMDDLLAMQACNLLCLPENYQMKYYLYHILSWPQLLYVAEDYNGRIVGYVLAKMEEETTECHGHITSLAVVRTHRKLGLATKLMTAAQNAMEQVYGAEYVSLHVRKSNRAAFNLYTGTLNYKIHDVEAKYYADGEDAYDMRKQLKGKSVGHASAHHHHHHGGGCCSGGHATAKPEGKVNHSGGKAEAKTGTAE

SEQ ID NO: 2771 - protein, 181 aa, Flaveria ramosissima
MVCIRKATIDDLLAMQACNLFCLPENYQMKYYFYHILSWPQLLYVAEDYGGKIVGYVLAKMEEETTECHGHITSLAVLRTHRKLGLATKLMIAAQNAMEQVYGAEYVSLHVRKSNRAAFNLYTETLGYKIHDLEAKYYADGEDAYDMRKRLKGKPQHQQQHHHHRHHHHGGGCCSGEAKAE

SEQ ID NO: 2772 - protein, 180 aa, Carthamus tinctorius
MVCIRKATIDDLLAMQACNLFCLPENYQMKYYFYHILSWPQLLYVAEDYGGKIVGYVLAKMEEESTECHGHITSLAVLRTHRKLGLATKLMAAAQNAMEQVFGAEYVSLHVSKSNRAAFNLYTETLGYKIHGMEAKYYADGEDAYDMRKQLKGKHQHQHQHHHHHHHHGGGCCSGEAKTE

SEQ ID NO: 2773 - protein, 125 aa, Lippia dulcis
MVCIRKATVDDLLAMQACNLFCLPENYQMKYYFYHILSWPQLLYVAEDYNGKIVGYVLAKMEEETTECHGHITSLAVLRLTGSSARHQTHDCCYKMPWNRCMQQNMCHCMLGKAIELPLIYTPRH

SEQ ID NO: 2774 - protein, 183 aa, Centaurea maculosa
MVCIRKATIDDLLAMQACNLFCLPENYQMKYYFYHILSWPQLLYVAEDYGGKIVGYVLAKMEEESTECHGHITSLAVLRTHRKLGLATKLMAAAQNAMEQVFGAEYVSLHVRKSNRAAFNLYTETLGYKIHDMEAKYYADGEDAYDMRKQLKGKHQHQHQHQHQHHHHHHHGGGCCSGEAKAE

SEQ ID NO: 2775 - protein, 183 aa, Helianthus annuus
MVCIRKATMDDLLAMQACNLFCLPENYQMKYYFYHILSWPQLLYVAEDYGGKIVGYVLAKMEEETTECHGHITSLAVLRTHRKLGLATKLMVAAQNAMEQVFGAEYVSLHVRKSNRAAFNLYTETLGYKIHDMEAKYYADGEDAYDMRKELKGKPQHQHQHQHQHHHHHHHGGGCCSGEAKAE

SEQ ID NO: 2776 - protein, 187 aa, Phaseolus coccineus
MVCIRKATVKDLLAMQACNLFCLPENYQMKYYFYHILSWPQLLHVAEDYNGRIVGYVLAKMEEETTDCHGHITSLAVLRTHRKLGLATKLMTASQNAMEQVFGAEYVSLHVRKSNRAAYNLYTETLGYKIHDVEAKYYADGEDAYDMRKQLKGKQPQQQQHHHHHHHHHHHHEHGGMCCSGGNAKAT

SEQ ID NO: 2777 - protein, 184 aa, Helianthus annuus
MVCIRKATMDDLLAMQACNLFCLPENYQMKYYFYHILSWPHLLYVAEDYGGKIVGYVLAKMEEETTECHGHITSLAVLRTHRKLGLATKLMTAAQNAMEQVFGAEYVSLHVRKSNRAAFNLYTETLGYKIHDIEAKYYADGEDAYDMRKQLKGKHQHQHQHQHQHHHHHHHHGGGCCSGDAKAE

SEQ ID NO: 2778 - protein, 184 aa, Cynara scolymus
MVCIRKATIDDLLAMQACNLFCLPENYQMKYYFYHILSWPQLLYVAEDYGGKIVGYVLAKMEEESTECHGHITSLAVLRTHRKLGLATKLMAAAQNAMEQVFGAEYVSLHVRKSNRAAFNLYTETLGYKIHDMEAKYYADGEDAYDMRKQLKGKHQHQHQHQHQHQHHHHHHGGGCCSGEAKTE

SEQ ID NO: 2779 - protein, 184 aa, Flaveria ramosissima
MVCIRKATMDDLLAMQACNLFCLPENYQMKYYFYHILSWPHLLYVAEDYGGKIVGYVLAKMEEETTECHGHITSLAVLRTHRKLGLATKLMTAAQNAMEQVFGAEYVSLHVRKSNRAAFNLYTETLGYKIHDIEAKYYADGEDAYDMRKQLKGKHQDQHQHHHQHHHHHHHHGGGCCSGDAKAE

SEQ ID NO: 2780 - protein, 195 aa, Vitis vinifera
MVCIRKATIDDLLAMQACNLLCLPENYQMKYYLYHILSWPQLLYVAEDYNGRIVGYVLAKMEEESSECHGHITSLAVLRTHRKLGLATKLMTAAQNAMEQVFGAEYVSLHVRKSNRAAFNLYTETLGYKIHDVEAKYYADGEDAYDMRKQLKGKQVGHHHHHHHHHHHHHGGGCCGGEPKLVETKGEAKAEAKAE

SEQ ID NO: 2781 - protein, 174 aa, Lotus japonicus
MVCIRKATVNDLLAMQACNLFCLPENYQMKYYLYHILSWPQLLYVAEDYNGRIVGYVLAKMEEETNECHGHITSLAVLRTHRKLGLATKLMTAAQNAMEQVFGAEYVSLHVRKSNRAAFNLYTETLGYKIHDVEAKYYADGEDAYDMRKQLKGKQLHQHQHPHPHHHHHHHHHH

SEQ ID NO: 2782 - protein, 183 aa, Cleome gynandra
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYEAEYVSLHVRRSNRAAFNLYTQTLGYKIHDIEAKYYADGEDAYDMRKQLKGKQSHQHGHHHHHHHGGGCCSGDVKAADTNQ

SEQ ID NO: 2783 - protein, 122 aa, Ambrosia trifida
MEEETTECHGHITSLAVLRTHRKLGLATKLMTAAQNAMEQVFGAEYVSLHVRKSNRAAFNLYTETLGYKIHDIEAKYYADGEDAYDMRKQLKEKPQHQHQHQHHHHHHHHGGGCCSGDAKAE

SEQ ID NO: 2784 - protein, 189 aa, Sesamum indicum
MVCIRKATVDDLLAMQACNLFCLPENYQMKYYLYHILSWPQLLYVAEDYNGKIVGYVLAKMEEETTECHGHITSLAVLRTHRKLGLATKLMTAAQNAMEQVYAAEYVSLHVRKSNRAAFNLYTETLGYKIHDVEAKYYADGEDAYDMRKQLKGRKHHHHHHHHHHHGGGCCSAETKADEKPGSTEAKTE

SEQ ID NO: 2785 - protein, 178 aa, Artemisia annua
MVCIRKATMDDLLAMQACNLFCLPENYQMKYYFYHILSWPHLLYVADDYGGKIVGYVLAKMEEETTECHGHITSLAVLRTHRKLGLATKLMTAAQNAMEQVFGAEYVSLHVRKSNRAAFNLYTVTLGYKINDIEAKYYADGEDAYDMRKQLKGKPQHQHHHHHHHHAGGCCSGDAKAH

SEQ ID NO: 2786 - protein, 179 aa, Petunia hybrida
MVCIRKATIDDLLAMQACNLLCLPENYQMKYYFYHILSWPQLLYVAEDYNGKIVGYVLAKMEEETSECHGHITSLAVLRTHRKLGIATKLMTAAQNAMGEVFGAEYVSLHVRKSNRAAFKLYTETLQYKIHDMEAKYYADGEDAYDMRKQLKGKKHHQHAHHHHHAGGCCSGEAKVGAT

SEQ ID NO: 2787 - protein, 184 aa, Flaveria ramosissima
MVCIRKATIDDLLAMQACNLFCLPENYQMKYYFYHILSWPQLLYVAEDYGGKIVGYVLAKMEEETTECHGHITSLAVLRTHRKLGLATKLMLAAQNAMEQVYGAEYVSLHVRKSNRAAFNLYTETLGYKIHDMEAKYYADGEDAYDMRKQLKGKQQHQQQHHHHHHHHHHHHHGGGCCSGEAKA

SEQ ID NO: 2788 - protein, 183 aa, Triphysaria pusilla
MVCIRKATVDDLLAMQECNLFCLPENYQMKYYLYHILSWPQLLYVAEDYNGKIVGYVLAKMEEESNECHGHITSLAVLRTHRKLGIATKLMTAAQNAMDQVYEAEYVSLHVRKSNRAAFNLYTETLGYKIHDVEAKYYADGEDAYDMRKQLKGRKQHHHHHHHGGGCCSGDLKADGPAEAKTV

SEQ ID NO: 2789 - protein, 73 aa, Sarracenia psittacina
NNHGVHTQGHRRRPPSYASLQPLLPPRKLQMKYYFYHILSWPQLLYVAEDYGGKIVGYVLAKMEEEPPSATAT

SEQ ID NO: 2790 - protein, 188 aa, Capsicum annuum
MVCIRKATIDDLLAMQACNLLCLPENYQMKYYFYHILSWPQLLYVAEDYNGKIVGYVLAKMEEETTECHGHITSLAVVRTHRKLGLATKLMTAAQNAMEQVFGAEYVSLHVRKSNRAAFKLYTETLGYKIHDMEAKYYADGEDAYDMRKELKGKKHHHHHHHHHHGGGCCSGEVKFVPKEGAAEAKAV

SEQ ID NO: 2791 - protein, 192 aa, Salvia sclarea
MVCIRKATVDDLLAMQACNLFCLPENYQMKYYFYHILSWPQLLYVAEDYNGKIVGYVLAKMEEETTECHGHITSLAVLRTHRKLGLATKLMTAAQNAMEQVYGAEYVSLHVRKSNRAAFNLYTETLGYKIHDVEAKYYADGEDAYDMRKQLKGRKHHHQHQHQHHHHHHGGGCCSADAKSVEKPGSAEMKSE

SEQ ID NO: 2792 - protein, 189 aa, Nicotiana tabacum
MVCIRKATIDDLLAMQACNLLCLPENYQMKYYFYHILSWPQLLYVAEDYNGKIVGYVLAKMEEETSECHGHITSLAVLRTHRKLGIATKLMTAAQNAMEQVFGAEYVSLHVRKSNRAAFKLYTETLQYKIHDMEAKYYADGEDAYDMRKQLKGKKHHQHHHHHHHHAGGCCSGEVKVVATERTAEGKKE

SEQ ID NO: 2793 - protein, 195 aa, Coffea canephora
MVCIRKATVDDLLAMQACNLFCLPENYQMKYYFYHILSWPQLLYVAEDYNGKIVGYVLAKMEEESSECHGHITSLAVLRTHRKLGLATKLMTAAQNAMEQVYGAEYVSLHVRKSNRAAFNLYTETLGYKIHDVEAKYYADGEDAYDMRKQLKGKKHQHHHHHHHHHHHHHHHGGGCCSGEAKVEGKAGEPEAKAE

SEQ ID NO: 2794 - protein, 192 aa, Catharanthus roseus
MVCIRKATVDDLLAMQACNLFCLPENYQMKYYFYHILSWPQLLYVAEDYNGKIVGYVLAKMEEESSECHGHITSLAVLRTHRKLGLATKLMTAAQNAMEQVYGAEYVSLHVRKSNRAAFNLYTGTLGYEIHDVEAKYYADGEDAYDMRKQLRLKRHHHQHQHHHHHHHHGGGCCSGEVKIGGKATETEAKAE

SEQ ID NO: 2795 - protein, 211 aa, Unknown
  Sequence found in Organisms: Citrus sinensis, Citrus sinensis
MVCIRKATVDDLLAMQACNLFCLPENYQMKYYFYHILSWPQLLYVAEDYNGRIVGYVLAKMEEESNECHGHITSLAVLRTHRKLGLATKLMNAAQSAMEQVFGAEYVSLHVRKSNRAAFNLYTETLGYKIHDVEAKYYADGEDAYDMRKQLKGKQSHQHGHHHHHHHHHHHHHGGGCCSGEVKSAETRGAEARGDAKSDSKASTKSDSKAS

SEQ ID NO: 2796 - protein, 211 aa, Citrus clementina
MVCIRKATVDDLLAMQACNLFCLPENYQMKYYFYHILSWPQLLYVAEDYNGRIVGYVLAKMEEESNECHGHITSLAVLRTHRKLGLATKLMNAAQSAMEQVFGAEYVSLHVRKSNRAAFNLYTETLGYKIHDVEAKYYADGEDAYDMRKQLKGKQSHQHGHHHHHHHHHHHHGGGGCCSGEVKSAETRGAEARGDAKSDSKASTKSDSKAS

SEQ ID NO: 2797 - protein, 189 aa, Solanum lycopersicum
MVCIRKATIDDLLAMQACNLLCLPENYQMKYYFYHILSWPQLLYVAEDYNGKIVGYVLAKMEEETTECHGHITSLAVVRTHRKLGLATKLMTAAQNAMEQVFGAEYVSLHVRKSNRAAFKLYTETLGYKIHDMEAKYYADGEDAYDMRKELKGKKHHQHHHHHHHHGGGCCSGEVKVGPKEGAAETKAA

SEQ ID NO: 2798 - protein, 171 aa, Ipomoea nil
MVCIRKATIDDLLAMQACNLMCLPENYQMKYYFYHILSWPQLLYVAEDYNGKIVGYVLAKMEEETSECHGHITSLAVLRTHRKLGIATKLMTAAQNAMEQVFGAEYVSLHVRKSNRAAFKLYTETLGYKIHDVEAKYYADGEDAYDMRKQLKGKKHHQHHHHHHHHHHHHH

SEQ ID NO: 2799 - protein, 194 aa, Quercus alba
MVCIRKATIDDLLAMQTCNLFCLPENYQMKYYLYHILSWPQLLYVAEDYNGKIVGYVLAKMEEESTECHGHITSLAVLRTHRKLGLATKLMSAAQNAMEQVFGAEYVSLHVRKSNRAAFNLYTETLGYKIHDVEAKYYADGEDAYDMRKQLKGKQYHGHGHGHGGHGHHHHHHHEHGGGCCSGERVEPKGTGKK

SEQ ID NO: 2800 - protein, 194 aa, Tabernaemontana elegans
MVCIRKATVDDLLAMQACNLFCLPENYQMKYYFYHILSWPQLLYVAEDYNGKIVGYVLAKMEEESSECHGHITSLAVLRTHRKLGLATKLMTAAQNAMEQVYGAEYVSLHVRKSNRAAFNLYTGTLGYEIHDVEAKYYADGEDAYDMRKQLKGRKHQHQHQHQHHHHHHHHGGGCCSGEVKTGGKATEAEAKAE

SEQ ID NO: 2801 - protein, 183 aa, Lactuca sativa
MVCIRKATMDDLFAMQACNLFCLPENYQMKYYFYHILSWPQLLHVAEDYGGKIVGYVLAKMEEETTECHGHITSLAVLRTHRKLGLATKLMTASQNAMEQVFGAEYVSLHVRKSNRAAFHLYTETLGYQIHDIEAKYYADGEDAYDMRKQLKGKHQHQHQHQHQHHHHHHHAGGCCSGDAKAE

SEQ ID NO: 2802 - protein, 204 aa, Tropaeolum majus
MVCIRKATMDDLLAMQACNLMCLPENYQMKYYLYHILSWPQLLYVAEDYNGRIVGYVLAKMEEESNECHGHITSLAVLRTHRKLGLATKLMSAAQAAMEQVFGAEYVSLHVRKSNRAAFNLYTGTLGYQINDVEAKYYADGEDAYDMRKQLKGKQTHHHGHNHNHHHHGGGCCSGDAKSGDATQVRGEAKSDSKASTKSESKAG

SEQ ID NO: 2803 - protein, 177 aa, Artemisia annua
MVCIRKATVDDLLSMQACNLFCLPENYQMKYYFYHILSWPHLLYVAEDYGGKIVGYVLAKMDEESTTECHGHITSLAVLRTHRKLGLATKLMAAAQNAMEQVFGAEYVSLHVRKSNRAAFNLYTETLGYQIHDMEAKYYADGEDAYDMRKQLKGKPQQQPQHHHHHSGGCCSGHAKA

SEQ ID NO: 2804 - protein, 188 aa, Cichorium intybus
MVCIRKATIDDLLAMQACNLFCLPENYQMKYYFYHILSWPQLLYVAEDYGGKIVGYVLAKMEEETTECHGHITSLAVLRTHRKLGLATKLMAAAQNAMEQVFGAEYVSLHVRKSNRAAFNLYTETLGYKIHDMEAKYYADGEDAYDMRKQLKGKSQHQHQHQHQHQNQHHHHHHHHAGGCCSGDAKAE

SEQ ID NO: 2805 - protein, 190 aa, Solanum melongena
MVCIRKATIDDLLAMQACNLLCLPENYQMKYYFYHILSWPQLLYVAEDYNGKIVGYVLAKMEEETTECHGHITSLAVVRTHRKLGLATKLMTAAQNAMEQVFGAEYVSLHVRKSNRAAFKLYTETLGYKIHDMEAKYYADGEDAYDMRKELKGKKHHHHHHHHHHHHGGGCCSGDVKVGAKEGAAEAKAA

SEQ ID NO: 2806 - protein, 190 aa, Utricularia gibba
MVCIRKATLEDLLAMQACNLFCLPENYQMKYYFYHILSWPQLLYVAEDYNGKIVGYVLAKMEEESTECHGHITSLAVLRTHRKLGLATKLMTAAQNAMEQVYGAEYVSLHVRKSNRAAFNLYTETLGYKIHDVEAKYYADGEDAYDMRKQLKGKKQHQHHHHHHHHHGGGCCMPIAKPDEKIAPAEGKAE

SEQ ID NO: 2807 - protein, 185 aa, Vaccinium corymbosum
MVCIRKATIDDLLAMQACNLFCLPENYQMKYYFYHILSWPQLLYVAEDYGGKIVGYVLAKMEEESSECHGHITSLAVLRTHRKLGLATKLMTAAQNAMEQVFGADYVSLHVRKSNRAAFHLYTETLRYKIHDMEAKYYADGEDAYDMRKQLKGKQYHTHHHHHHGGGCCSGEAVKSGDAKTVAAE

SEQ ID NO: 2808 - protein, 174 aa, Taraxacum officinale
MVCIRKATMDDLFAMQACNLFCLPENYQMKYYFYHILSWPQLLHVAEDYGGKIVGYVLAKMEEETTECHGHITSLAVLRTHRKLGLATKLMTASQNAMEQVFGAEYVSLHVRKSNRAAFHLYTETLGYKIHDIEAKYYADGEDAYDMRKQLKGKHQHLHHHHAGGCCSGNAKTE

SEQ ID NO: 2809 - protein, 171 aa, Lactuca sativa
MVCIRKATIDDLLAMQTCNLFCLPENYQMKYYFYHILSWPQLLYVAEDYGGKIVGYVLAKMEEETTECHGHITSLAVLRTHRKLGLATKLMAAAQNAMEQVFDAEYVSLHVRKSNRAAFNLYTETLGYQIHDMEAKYYADGEDAYDMRKQLKEKTQHQHQNHHHHHGGGCC

SEQ ID NO: 2810 - protein, 204 aa, Ricinus communis
MVCIRKATIDDLLAMQACNLLCLPENYQMKYYFYHILSWPQLLYVAEDYNGRIVGYVLAKMEEESNECHGHITSLAVLRTHRKLGLATKLMSAAQTAMEQVFGAEYVSLHVRKSNRAAFNLYTETLGYKIHDVEAKYYADGEDAYDMRKQLKGKQIHHHGHHHHHHHHHHHGGGCCAADIKSVEARPDSKSEAKASAKSEPKAG

SEQ ID NO: 2811 - protein, 181 aa, Plantago ovata
MVCIRKATVDDLLAMQECNLFCLPENYQMKYYFYHILSWPQLLYVAEDYNGKIVGYVLAKMEEETTECHGHITSLAVLRTHRKLGLATKLMTAAQNAMEQVYGSEYVSLHVRKSNRAAFNLYTGTLGYKIHDIEAKYYADGEDAYDMRKQLKGRKHHHHHHGGGCCSGEVRSDDKASLTEA

SEQ ID NO: 2812 - protein, 188 aa, Brassica napus
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYGAEYVSLHVRRSNRAAFNLYTETLGYQINDVEAKYYADGEDAYDMRKNLKGKQIHHHASHGHHHHHGGGCCSGDAKVVEQLKLKML

SEQ ID NO: 2813 - protein, 207 aa, Unknown
  Sequence found in Organisms: Gossypium hirsutum, Gossypium raimondii
MVCIRKATMDDLLAMQACNLLCLPENYQMKYYFYHILSWPQLLYVAEDYNGRIVGYVLAKMEDESNECHGHITSLAVLRTHRKLGLATKLMNAAQAAMEQVFGAEYVSLHVRKSNRAAFNLYTQTLGYKIHDVEAKYYADGEDAYDMRKQLKGKTNHHHGHHHHHHHHHHHGGGCCSGDARSGEAAHTRGDSKSESKASTKSDSKTG

SEQ ID NO: 2814 - protein, 611 aa, Eutrema halophilum
MAIASRSWVATVNHHANPHSFSSPKKPVFFLSQKPHISHVCSSRCSLVLEEDEKKSPSSKQDKWPFFEPVPDGLNLVLSRLLRDPETQKLSSEFYEKAKENSELRTTKHLINYLVNAKNWDLLVSLCEDLREYNALPDAHTCSQLIRSCIRERKFRVAHCLLSVFRSDKTLAVFATDSAMKGFNKLQMYSSTIQVFDRMKQYVGVEPSPGCYCRIMEAHERIGDNQKVVELFQEFKSKRLSFLAKESGSIYTILCTSLAKSGRAFEALEFLEEMKDKGIQETSALYSTLIRALAGAREVTTVEKLFKEAGEKKLLKDPEMCLKVVLMYVREGKMERTLEVVAAMRKNDLRVSDCILCAIVNGFSKQRGFAEAVRAYEWLKKQECEAGQVTYAITINAYCRLEEYEKAEMLFDEMVNKGFDKCVVAYSNIIDMYGKTRRLSDAVKLMAKMKQRGCKPNIWIYNSLIDMHGRAMDLRRVEKIWKEMKRMKVLPDKVSYTSMIGACNRAKELERCVELYNEFRMNRGKIDRAMAGIMVGVFSKTSRIDELMRLLQDMKVERTKLDARLYSSALNALRDAGLNSQIRWLQESFDTAQTGASRYSNTKSKTTLQGS

SEQ ID NO: 2815 - protein, 188 aa, Unknown
  Sequence found in Organisms: Solanum tuberosum, Solanum phureja
MVCIRKATIDDLLAMQACNLLCLPENYQMKYYFYHILSWPQLLYVAEDYNGKIVGYVLAKMEEETTECHGHITSLAVVRTHRKLGLATKLMTAAQNAMEQVFGAEYVSLHVRKSNRAAFKLYTETLGYKIHDMEAKYYADGEDAYDMRKELKGKKHHQHHHHHHHGGGCCSGEVKVGPKEGAAETKAA

SEQ ID NO: 2816 - protein, 196 aa, Unknown
  Sequence found in Organisms: Castanea mollissima, Quercus alba
MVCIRKATIDDLLAMQTCNLFCLPENYQMKYYLYHILSWPQLLYVAEDYNGKIVGYVLAKMEEESTECHGHITSLAVLRTHRKLGLATKLMSAAQNAMEQVFGAEYVSLHVRKSNRAAFNLYTETLGYKIHDVEAKYYADGEDAYDMRKQLKGKQYHGHGHGHGHGGHGHHHHHHHEHGGGCCSGERVEPKGTGKK

SEQ ID NO: 2817 - protein, 169 aa, Vinca minor
MVCIRKATVDDLLAMQACNLFCLPENYQMKYYFYHILSWPQLLYVAEDYNGKIVGYVLAKMEEESSECHGHITSLAVLRTHRKLGLATKLMTAAQNAMEQVYGADYVSLHVRKSNRAAFNLYTGTLGYEIHDMEAKYYADGEDAYDMRKQLKGRKHQHQHHHHHGGGCC

SEQ ID NO: 2818 - protein, 171 aa, Valeriana officinalis
MQACNLFCLPENYQMKYYFYHILSWPQLLYVAEDYGGKIVGYVLAKMEEESTECHGHITSLAVLRTHRKLGLATKLMTAAQNAMEQVFGADHVALHVRKSNRAAFNLYTETLGYKIHDIEAKYYADGEDAYDMRKQLAGKRDKVHSHAHHHHGGGCCSGESKPESTAGSSA

SEQ ID NO: 2819 - protein, 207 aa, Gossypium hirsutum
MVCIRKATMDDLLAMQACNLLCLPENYQMKYYFYHILSWPQLLYVAEDYNGRIVGYVLAKMEDESNECHGHITSLAVLRTHRKLGLATKLMNAAQAAMEQVFGAEYVSLHVRKSNRAAFNLYTQTLGYKIHDVEAKYYADGEDAYDMRKQLKEKTNHHHGHHHHHHHHHHHGGGCCSGDARSGEAAHTRGDSKSESKASTKSDSKTG

SEQ ID NO: 2820 - protein, 185 aa, Lactuca sativa
MVCIRKATMDDLFAMQACNLFCLPENYQMKYYFYHILSWPQLLHVAEDYGGKIVGYVLAKMEEETTECHGHITSLAVLRTHRKLGLATKLMTASQNAMEQVFGAEYVSLHVRKSNRAAFHLYTETLGYQIHDIEAKYYADGEDAYDMRKQLKGKNQHQHQHQHQHQHHHHHHHAGGCCSGDAKAE

SEQ ID NO: 2821 - protein, 194 aa, Fragaria vesca
MVCIRKATMDDLLAMQACNLFCLPENYQMKYYLYHILSWPQLLYVAEDYNGRIVGYVLAKMEEESNECHGHITSLAVLRTHRKLGLATKLMSAAQNAMEQVFAAEYVSLHVRKSNRAAFNLYTETLGYKIHDIEAKYYADGEDAYDMRKELKGKKVHAHSHHGHHHHHHHHHEGGCCSAEAKPAETKSKAGSAK

SEQ ID NO: 2822 - protein, 211 aa, Eucalyptus grandis
MVCIRKATVDDLLAMQACNLMCLPENYQMKYYLYHILSWPQLLYVAEDYNGRIVGYVLAKMEEETNECHGHITSLAVLRTHRKLGLATKLMNAAQNAMEQVYGAEYVSLHVRKSNRAAFNLYTETLGYKIHDVEAKYYADGEDAYDMRKQLKGKQNHHHHHHHRHGHGHGHGHGHHHHHHHHHGDGCCSGDIKSGGIEAGQKLDSKANKAG

SEQ ID NO: 2823 - protein, 164 aa, Lactuca sativa
MVCIRKATIDDLLAMQACNLFCLPENYQMKYYFYHILSWPQLLYVAEDYGGKIVGYVLAKMEEETTECHGHITSLAVLRTHRKLGLATKLMAAAQNAMEQVFGAEYVSLHVRKSNRAAFNLYTETLGYKIHDMEAKYYADGEDAYDMRKELKGKTLHQHHHHHH

SEQ ID NO: 2824 - protein, 194 aa, Bruguiera gymnorhiza
MVCIRKATIDDLLAMQACNLLCLPENYQMKYYFYHILSWPQLLYVAEDYNGRIVGYVLAKMEEESNECHGHITSLAVLRTHRKLGLATKLMNAAQTAMEQVFGAEYVSLHVRKSNRAAFNLYTGTLGYKIHDVEAKYYADGEDAYDMRKQLKGKQTHHHGHHHHHPHHHHHGGGCCGGAGADAKPVEGKSKPDA

SEQ ID NO: 2825 - protein, 207 aa, Arachis hypogaea
MVCIRKATVDDLLAMQACNLFCLPENYQMKYYLYHILSWPQLLYVAEDYNGRIVGYVLAKMEEETSECHGHITSLAVLRTHRKLGLATKLMTAAQNAMEQVFGAEYVSLHVRKSNRAAFNLYTETLGYKIHDVEAKYYADGEDAYDMRKQLKGKQTHQHQHHHSGGHHHHHHHHHHHHHHHHHEHGGGCCSSEAKAEKTENRNAKAT

SEQ ID NO: 2826 - protein, 168 aa, Platanus occidentalis
MVCIRKATIDDLLAMQACNLLCLPENYQMKYYFYHILSWPQLLYVAEDYGGRIVGYVLAKMEEESSECHGHITSLAVLRTHRKLGLATKLMTAAQNAMEQVFGAEYVSLHVRRSNRAAFNLYTETLGYKIHDVEAKYYADGEDAYDMRKQLKGKQYQHQHHHHHHHHH

SEQ ID NO: 2827 - protein, 193 aa, Raphanus sativus
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYGAEYVSLHVRRSNRAAFNLYTETLGYQINDVEAKYYADGEDAYDMRKNLKGKQIHQHHSAGHAHHHHGGGCCSADAKPVETTTQAEATSSK

SEQ ID NO: 2828 - protein, 182 aa, Tripterygium wilfordii
ATMDDLLAMQACNLLCLPENYQMKYYLYHTLSWPQLLYVAEDYNGKIVGYVLAKMEEESNECHGHITSLAVLRTHRKLGLATKLMKAAQAAMEQVFGAEYVSLHVRKSNRAAFNLYTETLGYKIDDVEAKYYADGEDAYDMRKQLKGKQNHHHGHHHHHHHQHGGGCCSGEPRSAEPRGEAK

SEQ ID NO: 2829 - protein, 192 aa, Eutrema parvulum
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYEAEYVSLHVRRSNRAAFNLYTETLGYKIHDVEAKYYADGEDAYDMRKHLKGKQNHQHGHGHHHHGGGCCSGDAKVVETAQAEDAKATSSK

SEQ ID NO: 2830 - protein, 209 aa, Humulus lupulus
MVCIRKATIDDLLAMQACNLFCLPENYQMKYYLYHILSWPQLLYVAEDYNGRIVGYVLAKMEEESNECHGHITSLAVLRTHRKLGLATKLMSAAQNAMEQVFGAEYVSLHVRKSNRAAFNLYTQTLGYKIHDIEAKYYADGEDAYDMRKELKGKKIHQHVHAHGHSHGHGHHHHHHGHGGGCCSGGEPKSVEARGGTKAEKAKADSKTG

SEQ ID NO: 2831 - protein, 193 aa, Brassica oleracea
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYGAEYVSLHVRRSNRAAFNLYTETLGYQINDVEAKYYADGEDAYDMRKNLKGKQIHHHASHGHHHHHHGGGCCSGDAKVVETTQAEDAKATS

SEQ ID NO: 2832 - protein, 191 aa, Eutrema halophilum
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYEAEYVSLHVRRSNRAAFNLYTETLGYKIHDVEAKYYADGEDAYDMRKHLKGKQNHHHGHGHHHHGGGCCSGDAKVVETAQAEEAKASSK

SEQ ID NO: 2833 - protein, 193 aa, Actinidia deliciosa
  misc_feature (131)..(131): Xaa can be any naturally occurring amino acid
  misc_feature (153)..(153): Xaa can be any naturally occurring amino acid
  misc_feature (172)..(172): Xaa can be any naturally occurring amino acid
  misc_feature (178)..(178): Xaa can be any naturally occurring amino acid
  misc_feature (183)..(184): Xaa can be any naturally occurring amino acid
  misc_feature (186)..(186): Xaa can be any naturally occurring amino acid
MVCIRKATIDDLLAMQACNLFCLPENYQMKYYFYHILSWPQLLYVAEDYGGKIVGYVLAKMEEETSECHGHITSLAVLRTHRKLGLATKLMTAAQNAMEQVFGAEYVSLHVRKSNRAAFNLYTETLGYKIXDVEAKYYADGEDAYDMRKQLKXKQHHHHHHHHHGGGCCSGXAVKSGXAKTEXXEXWARVPIL

SEQ ID NO: 2834 - protein, 188 aa, Olea europaea
MVCIRKATVDDLLAMQECNLFCLPENYQMKYYFYHILSWPQLLYVAEDYNGKIVGYVLAKMEEESSECHGHITSLAVLRTHRKLGLATKLMTAAQNAMEQVYGAEYVSLHVRKGNKAAFNLYTETLGYTIHDVEAKYYADGEDAYDMRKQLKERKHHHHHHHHHHGGACCSGDLKPGEKAASTEAKAE

SEQ ID NO: 2835 - protein, 192 aa, Arabidopsis thaliana
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYEAEYVSLHVRRSNRAAFNLYTETLGYKINDVEAKYYADGEDAYDMRKNLKGKQNHHHAHGHHHHHGGGCCSGDAKVVETAQAVDGKAVSK

SEQ ID NO: 2836 - protein, 199 aa, Carica papaya
MVCIRKATVDDLLAMQACNLMCLPENYQMKYYLYHILSWPQLLYVAEDYNGRIVGYVLAKMEEESNECHGHITSLAVLRTHRKLGLATKLMNAAQAAMEQVFGAEYVSLHVRKSNRAAFNLYTETLGYKIHDVEAKYYADGEDAYDMRKQLKGKQIHHHSHHHHHHHHHHHQHPHQHGGGCCAGDAKNTESTQARGEAK

SEQ ID NO: 2837 - protein, 191 aa, Arabidopsis lyrata
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYEAEYVSLHVRRSNRAAFNLYTETLGYKINDVEAKYYADGEDAYDMRKNLKGKQNHHHAHGHHHHGGGCCSGDAKVVETAQAVDAKAVSK

SEQ ID NO: 2838 - protein, 201 aa, Musa acuminata
MVCIRQATVEDLLAMQACNLLCLPENYQIKYYLYHILSWPQLLFVAEDYGGRIVGYVLAKMEEDASEPCHGHITSLAVLRTHRKLGIATKLMTAAQNAMESVFGAEYVSLHVRRSNRAALVLYTSTLGYLIHDVEAKYYADGEDAYDMRKQFKVRPHTHGHGHHHHHHHRGGCCSVEAKNAVAASAGTSASAPAPASASGE

SEQ ID NO: 2839 - protein, 189 aa, Antirrhinum majus
MVCIRKATVDDLLAMQECNLFCLPENYQMKYYFYHILSWPQLLYVAEDYNGKIVGYVLAKMEEEPTECHGHITSLAVLRTHRKLGLATKLMTAAQNAMEQIYRAEYVSLHVRKSNRAAFHLYTETLGYKIHDLEAKYYADGEDAYDMRKQLKGKRHHHHHHHHHHGGGCCSADAKPDEKVASTEAKTAQ

SEQ ID NO: 2840 - protein, 207 aa, Elaeis guineensis
MVCIRQATVEDLLAMQACNLLCLPENYQMKYYLYHILSWPQLLFVAEDYGGKIVGYVLAKMEEDASEPCHGHITSLAVLRTHRKLGLATKLMTAAQNAMESVFGAEYVSLHVRRSNRAAINLYTSTLGYKIHDVEAKYYADGEDAYDMRKQLKGRPAPHHHGHGHHHAGGACCSGDAGKPVEADTGTGASASASAPANAGERRAGGV

SEQ ID NO: 2841 - protein, 211 aa, Zingiber officinale
  misc_feature (156)..(156): Xaa can be any naturally occurring amino acid
  misc_feature (200)..(200): Xaa can be any naturally occurring amino acid
MVCIRQATVDDLLAMQACNLLCLPENYQMKYYLYHILSWPQLLFVAEDYDGRIVGYVLAKMEEDASEPCHGHITSLAVLRTHRKLGLATKLMTAAQNAMESVFGAEYVSLHVRRSNRAAFTLYTSSLSYRIHDVEAKYYADGEDAYDMRKQLKGRXHAHSHSHGHHHHHHHGGCCSGESKAASPVDVGAAADPGTGASGXNSSAPASAAGA

SEQ ID NO: 2842 - protein, 201 aa, Manihot esculenta
MVCIRKATIDDLLAMQACNLLCLPENYQMKYYFYHILSWPQLLYVAEDYNGRIVGYVLAKMEEESNECHGHITSLAVLRTHRKLGLATKLMSAAQTAMEQVFGAEYVSLHVRKSNRAAFNLYTETLGYKIHDVEAKYYADGEDAYDMRKQLKGKQIHHHGHHHHHHHHGGGCCAGDTKPVEARADTKSEAKAGTKSESKAG

SEQ ID NO: 2843 - protein, 192 aa, Picea glauca
MVCIRQATIDDLLAMQTCNLMCLPENYQMKYYFYHILSWPQLLYVAEDYNKKIVGYVLAKMEEESTECHGHITSLAVLRTHRKLGLATKLMTAAQKAMHEVFGAEYVSLHVRKSNRAAFHLYTQTLGYKIHDIEAKYYADGEDAYDMRKQLKVKSDGKHHHHHHHHQHSGGCCSGDGGDGKLQSAVDKKSKE

SEQ ID NO: 2844 - protein, 194 aa, Brassica rapa
MVCIRRATVDDLLAMQACNLMCLPENYQMKYYLYHILSWPQLLYVAEDYNGRIVGYVLAKMEEESNECHGHITSLAVLRTHRKLGLATKLMTAAQAAMEQVYGAEYVSLHVRRSNRAAFNLYTETLGYQINDVEAKYYADGEDAYDMRKNLKGKQIHHHASHGHHHHHGGGCCSGDAKVVETTQAEDAKATSSK

SEQ ID NO: 2845 - protein, 198 aa, Camellia sinensis
MVCIRKATVDDLLAMQACNLFCLPENYQMKYYLYHILSWPQLLYVAEDYGGKIVGYVLAKMEEESSECHGHITSLAVLRTHRKLGLATKLMTAAQNAMEQVYGAEYVSLHVRKSNRAAFNLYTETLGYKIHDVEAKYYADGEDAYDMRKLLKGKQHHHQHHPHHPHPHHHHHHVGGCCSGEAVKSGDTNSESKAGSSE

SEQ ID NO: 2846 - protein, 192 aa, Brassica napus
MVCIRRATVDDLLAMQACNLMCLPENYQMKYYLYHILSWPQLLYVAEDYNGRIVGYVLAKMDEESNECHGHITSLAVLRTHRKLGLATKLMTAAQAAMEQVYEAEYVSLHVRRSNRAAFHLYTETLGYKIHDVEAKYYADGEDAYDMRKYFKGKQNHQHSHGHHHHHHGGGCCSGDAVDTAQAEDAKATTSK

SEQ ID NO: 2847 - protein, 190 aa, Ipomoea batatas
MVCIRKATIDDLLAMQACNLLCLPENYQMKYYIYHILSWPQLLYVAEDYNGKIVGYVLAKMDEEATECHGHITSLAVLRTHRKLGLATKLMTAAQNAMEQVFGAEYVSLHVRKSNRAAFKLYTETLGYKIHDLEAKYYADGEDAYDMRKQLKGKKHQQHQHHHHHHSGRCRSGEVRTEGKDGVAEEKAQS

SEQ ID NO: 2848 - protein, 190 aa, Mimulus guttatus
MVCIRKATVDDLLAMQECNLFCLPENYQMKYYIYHILSWPQLLYVAEDYNGKIVGYVLAKMEEESTECHGHITSLAVLRTHRKLGIATKLMTAAQNAMEQVYGSEYVSLHVRKSNKAAFNLYTGTLGYQINDMEAKYYADGEDAYDMRKQLKGKKQHHHHGHHHHHHGGGCCSADVKSDEKHGSAEAKTE

SEQ ID NO: 2849 - protein, 192 aa, Aristolochia fimbriata
MVCIRQATIDDLLAMQACNLLCLPENYQMKYYFYHILSWPQLLYVAEDYGGRIVGYVLAKMEEESSECHGHITSLAVLRTHRKLGLATKLMTAAQNAMEQVYEAEYVSLHVRRSNRAAFNLYTETLGYKIHDVEAKYYADGEDAYDMRKQLKGKQHHHHHGHGHHHGHAHHHGACCSGHDGKGAEAKAGSVD

SEQ ID NO: 2850 - protein, 191 aa, Euphorbia peplus
MVCIRKATIDDLLAMQACNLLCLPENYQMKYYFYHILSWPQLLYVAEDYNSRIVGYVLAKMEEESNECHGHITSLAVLRTHRKLGLATKLMSAAQNAMEQVFGAEYVSLHVRKSNRAAFNLYTETLGYKIHDIEAKYYADGEDAYDMRKQLKEKQIHHHGHHHHGGGCCSADAKSVEGRPESKSEAKASTK

SEQ ID NO: 2851 - protein, 192 aa, Picea glauca
MVCIRQATIDDLLAMQTCNLMCLPENYQMKYYFYHILSWPQLLYVAEDYNKKIVGYVLAKMEEESTECHGHITSLAVLRTHRKLGLATKLMTAAQKAMHEVFGAEYVSLHVRKSNRAAFHLYTQTLGYKIHDIEAKYYADGEDAYDMRKQLKVKSDGKHHHHHHHHQHSGGCCGGDGGDGKLQSAVDKKSKE

SEQ ID NO: 2852 - protein, 208 aa, Amorphophallus konjac
MVCIRQATMDDLLAMQACNLMCLPENYQMKYYFYHILSWPQLLYVAEDYGGKIVGYVLAKMEEDSTEPCHGHITSLAVLRTHRKLGLATKLMTAAQNAMEGVYGAEYVSLHVRRSNRAALNLYTSTLGYKIHDIEAKYYADGEDAYDMRKQLNGRREHHHHHHHHHHSGGCCGGEAKSGRGGEAAAKSGGAPAAAAGGSSAGASASGE

SEQ ID NO: 2853 - protein, 188 aa, Brassica juncea
MVCIRRATVDDLLAMQACNLMCLPENYQMKYYLYHILSWPQLLYVAEDYNGRIVGYVLAKMDEESNECHGHITSLAVLRTHRKLGLATKPMTAAQAAMDQVYEAEYVSLHVRRSNRAAFHLYNETLGYEIHDVEAKYYADGEDAYDMRKYFKGKQNHQHSSHGGHHHHHHGGGCCSGDAVVVETAQAE

SEQ ID NO: 2854 - protein, 193 aa, Brassica napus
MVCIRRATVDDLLAMQACNLMCLPENYQMKYYLYHILSWPQLLYVAEDYNGRIVGYVLAKMDEESNECHGHITSLAVLRTHRKLGLATKLMTAAQSAMEQVYEAEYVSLHVRRSNRAAFHLYTETLGYKIHDVEAKYYADGEDAYDMRKYFKGKQNHQQSHGHHHHHHHGGGCCSGDAVEITQAEDAIATTSK

SEQ ID NO: 2855 - protein, 213 aa, Curcuma longa
MVCIRQATVDDLLAMQACNLLCLPENYQMKYYLYHILSWPQLLFVAEDYDGRIVGYVLAKMEEDASEPCHGHITSLAVLRTHRKLGLATKLMTAAQNAMESVFGAEYVSLHVRRSNRAAFTLYTSSLSYRIHDVEAKYYADGEDAYDMRKQLKGRPHAHSHSHSHGHHHHHHHGGCCSGESKAASPVDVGAAADPGTGASGSNSSAPASAAGA

SEQ ID NO: 2856 - protein, 194 aa, Populus trichocarpa
MVCVRKATMDDLLAMQACNLLCLPENYQMKYYFYHILSWPHLLYVAEDYNGRIVGYVLAKMEEESTECHGHITSLAVLRTHRKLGLATKLMKAAQTAMEQVFGAEYVSLHVRKSNRAAFNLYTETLGYKIHDVEAKYYADGEDAYDMRKQFKVKQSHHHHHHHHHGGGCCSADARPVEAQPESKSEAKASTKVE

SEQ ID NO: 2857 - protein, 199 aa, Manihot esculenta
MVCIRKATIDDLLAMQACNLLCLPENYQMKYYFYHILSWPQLLYVAEDYNGRIVGYVLAKMEEESNECHGHITSLAVLRTHRKLGLATKLMSAAQTAMEQVFGAEYVSLHVRKSNRAAFNLYTETLGYKIHDVEAKYYADGEDAYDMRKQLKGKQIHHHGHHHHHHGGGCCGGDTKSLEARPDPKSEAKASAKSESKAG

SEQ ID NO: 2858 - protein, 214 aa, Musa acuminata
MVCIRQATVEDLLAMQACNLLCLPENYQMKYYLYHILSWPQLLFVAEDYGGQIVGYVLAKMEEDTSEPCHGHITSLAVLRTHRKLGLATKLMTAAQNAMESVFGAEYVSLHVRRSNRAAFTLYTSTLGYRIHDVEAKYYADGEDAYDMRKQLKGRPHGHSHGHSHGHGQAHHHHHHHHHGGGCCSGEVKPPAAAGAYASASSASASASASASGE

SEQ ID NO: 2859 - protein, 185 aa, Elaeis guineensis
MVCIRRATIEDLLAMQACNLMCLPENYQMKYYLYHILSWPQLLFVAEDYGGRIVGYVLAKMEEDSSEPCHGHITSLAVLRSHRKLGIATKLMTAAQNAMESVFGAEYVSLHVRRSNRAAFNLYTSTLGFKIHDVEAKYYADGEDAYDMRKQFKGRHHHHHGDGCCSGDSKAAGSGSSSSSGEGKV

SEQ ID NO: 2860 - protein, 179 aa, Euphorbia peplus
KATIDDLLAMQACNLLCLPENYQMKYYFYHILSWPQLLYVAEDYNGRIVGYVLAKMEEESNECHGHITSLAVLRTHRKLGLATKLMSAAQNAMEQVFGAEYVSLHVRKSNRAAFNLYTETLGYKIHDIEAKYYADGEDAYDMRKQLKVKQISHHHHHHAGGCCSSDAKSVEGRPESKSD

SEQ ID NO: 2861 - protein, 190 aa, Abies balsamea
MVCIRQATIDDLLAMQTCNLMCLPENYQMKYYFYHILSWPQLLYVAEDYNKKIVGYVLAKMEEESTECHGHITSLAVLRTHRKLGLATKLMTAAQKAMQEVFGAEYVSLHVRKSNRAAFHLYTQTLGYKIHDIEAKYYADGEDAYDMRKQLKLKSDGKHQHHHHHHSGSCCGGDGGDGKLHSAVDKKSKE

SEQ ID NO: 2862 - protein, 183 aa, Distylium racemosum
MVCIRQATMDDLLAMQSCNLMCLPENYQMKYYFYHILSWPQLLYVAEDYNKKIVGYVLAKMEEESTECHGHITSLAVVRTHRKLGIATKLMNAAQRAMHEVFGAEYVSLHVRKSNRAAFHLYTETLGYKIHDVEAKYYADGEDAYDMRKQLKPKEDHRHHHCGGCCGAEGNAAGGDRKGKEGG

SEQ ID NO: 2863 - protein, 188 aa, Podocarpus macrophillus
MVCIRQATVDDLLSMQTCNLMCLPENYQMKYYFYHILSWPQLLYVAEDYNKKIVGYVLAKMEEESTECHGHITSLAVLRTHRKLGIATKLMTAAQKAMHEVFGAEYVSLHVRKSNRAAFHLYTETLGYKIHDVEAKYYADGEDAYDMRKQLKTKEVSKHHHCGGCCGGEAEAKTQATIVSAGGEKKGK

SEQ ID NO: 2864 - protein, 193 aa, Pseudotsuga menziesii
MVCIRQATIDDLLAMQTCNLMCLPENYQMKYYFYHILSWPQLLYVAEDYNKKIVGYVLAKMEEESTECHGHITSLAVLRTHRKLGLATQLMTAAQKAMQEVFGAEYVSLHVRKSNRAAFHLYTQTLGYKIHDIEAKYYADGEDAYDMRKQLKPKSDGKHQHHHHHHHHHSGACCGGDGGDGKLQSTADKKSKE

SEQ ID NO: 2865 - protein, 189 aa, Sciadopitys verticillata
MVCIRQATIDDLLAMQTCNLMCLPENYQMKYYFYHILSWPQLLYVAEDYNKKIVGYVLAKMEEESTECHGHITSLAVLRTHRKLGLATKLMSAAQKAMHQVFGAEYVSLHVRKSNRAAFHLYTETLGYKIHDVEAKYYADGEDAYDMRKQLKPKEDRHQHCGGCCGGEGDVKAHSSTSTGGDRKGKEVN

SEQ ID NO: 2866 - protein, 198 aa, Euonymus alatus
MVCIRKATMDDLLAMQACNLLCLPENYQMKYYLYHILSWPHLLYVAEDYNGRIVGYVLAKMEEESNECHGHITSLAVLRTHRKLGLATKLMSAAQAAMEQVFGAEYVSLHVRKSNRAAFNLYTGTLSYKIHDLEAKYYADGEDAYDMRKELKGKQNHHHGHHHHHHQHGGGCCSGEPRSAEPRGEAKSDSKASTKSVS

SEQ ID NO: 2867 - protein, 203 aa, Populus trichocarpa
MVCIRKATIDDLLAMQACNLLCLPENYQMKYYFYHILSWPHLLYVAEDYNGRIVGYVLAKMEEESNECHGHITSLAVLRTHRKLGLATKLMNAAQTAMEQVFGAEYVSLHVRKSNRAAFNLYTETLGYKTHDVEAKYYADGEDAYDMRKQLKGKQSHHHGHHHHHHHHHHGGGCCSGGARPMEARPELKSEAKAGTKAELKTG

SEQ ID NO: 2868 - protein, 200 aa, Tripterygium wilfordii
ATMEDLLAMQACNLLCLPENYQMKYYLYHILSWPQLLYVAEDYNGRIVGYVLAKMEEESNECHGHITSLAVLRTHRKLGIATKLMTAPKQPWSRCLESEYVSLHVRKSNRAAYNLYNGTLGYKINDVEAKYYADGEDAYDMRKQLKGKQNHHHGHHYHHHHHHHQHGGGCCSGEPRSAEPRGEAKSDSKDMTKSESKSAS

SEQ ID NO: 2869 - protein, 207 aa, Cannabis sativa
MVCIRKATIDDLLAMQACNLFCLPENYQMKYYLYHILSWPQLLYVAEDYNGRIVGYVLAKMEEESNECHGHITSLAVLRTHRKLGLATKLMSAAQNAMEQVFGAEYVSLHVRKSNRAAFNLYTETLGYKIHDIEAKYYADGEDAYDMRKELKGKKTHQHVHSHSHGHGHGHHHHGHGGGCCSGGEPKSVEAKGGAKAEKAKTDSKTG

SEQ ID NO: 2870 - protein, 206 aa, Phalaenopsis aphrodite
MVCIRQATMDDLLAMQACNLMCLPENYQMKYYFYHILSWPQLLFVAEDYGGKIVGYVLAKMEEESSEPCHGHITSLAVLRTHRKLGLATKLMNAAQNAMEGVFGAEYVSLHVRRSNRAAFNLYASTLGYKIHDLEAKYYADGEDAYDMRKQLKGRQQMQAITRGHQHHHHHGGGCCSGEVKPAVDGPGVATSSSEGKGSSLENKGE

SEQ ID NO: 2871 - protein, 203 aa, Cleome spinosa
MVCIRRATVDDLLAMQACNLMCLPENYQMKYYLYHILSWPQLLYVAEDYNGRIVGYVLAKMEEESNECHGHITSLAVLHTHRKLGLATKLMTAAQAAMEQVHEAEYVSLHVRKSNRAAFNLYTETLGYKIHDIEAKYYADGEDAYDMRKQLKGKQNHQHGHHHHHHHGGGCCSNDAKVAETSQAKGDSKADAKASSKSEAKTG

SEQ ID NO: 2872 - protein, 125 aa, Chelidonium majus
MVCIRQATIDDLLAMQACNLLCLPENYQMKYYFYHILSWPQLLYVAEDYGGRIVGYVLAKMDEESTDCHGHITSLAVLRTHRKLGLATKLMTAAQNAMEQVFGQSMFHFMFVGVIKLLFICIMRH

SEQ ID NO: 2873 - protein, 193 aa, Brassica napus
MVCIRRATVDDLLAMQACNLMCLPENYQMKYYLYHILSWPQLLYVAEDYNGRIVGYVLAKMDEESNECHGHITSPAVLRTHRKLGLATKLTTAAQSAMEQVYEAEYVSLHVRRSNRAAFHLYTETLGYKIHDVEAKYYADGEDAYDMRKYFKGKQNHQQSHGHHHHHHHGGGCCSGDAVDTTPAEDAIATTSK

SEQ ID NO: 2874 - protein, 213 aa, Prunus persica
MVCIRKATIDDLLAMQACNLFCLPENYQMKYYLYHILSWPQLLYVAEDYNGRIVGYVLAKMEEESNECHGHITSLAVLRTHRKLGLATKLMSAAQNAMEQVFAAEYVSLHVRKSNRAAFNLYTETLGYKIHDVEAKYYADGEDAYDMRKELKGKKVHGHSHGHGHGHGHAHHHHHHHHHEHGGGCCSGEAVKPEKTEAKKVERGNAKAEARAG

SEQ ID NO: 2875 - protein, 192 aa, Euphorbia esula
MVCIRKATIDDLLAMQACNLLCLPENYQMKYYFYHILSWPQLLYVAEDYNGRIVGYVLAKMEEESNECHGHITSLAVLRTHRKLGLATKLMSAAQNAMEQVFGAEYVSLHVRKSNRAAFNLYTETLGYKIHDIEAKYYADGEDAYDMRKQLKVKQISHHHHHHAGGCCSSDAKSVEGRPESKSDAKASTKSG

SEQ ID NO: 2876 - protein, 196 aa, Brassica rapa
MVCIRRATVDDLLAMQACNLMCLPENYQMKYYLYHILSWPQLLYVAEDYNGRIVGYVLAKMDEESNECHGHITSLAVLRTHRKLGLATKLMTAAQAAMEQVYEAEYVSLHVRRSNRAAFHLYTETLGYKIHDVEAKYYADGEDAYDMRKYFKGKQNHQQSHGHHHHHHHHHHGGGCCSGDAVDTTQAEDAIATTSK

SEQ ID NO: 2877 - protein, 206 aa, Theobroma cacao
MVCIRKATIDDLLAMQACNLLCLPENYQMKYYLYHILSWPQLLYVAEDYNGRIVGYVLAKMEEESNECHGHITSLAVLRTHRKLGLATKLMNAAQAAMEQVFGAEYVSLHVRKSNRAAFNLYTETLGYKIHDVEAKYYADGEDAYDMRKQLKGKQSHHHGHHHHHHHHHHGGGCCLGEARSTEVTQTRGDSKSESKASTKSDSKAA

SEQ ID NO: 2878 - protein, 201 aa, Linum usitatissimum
MVCIRKATMDDLLAMQACNLLCLPENYQMKYYFYHILSWPQLLYVAEDYNGRIVGYVLAKMEEESNECHGHITSLAVLRTHRKLGLATKLMTAAQSAMEQVFGAEYVSLHVRKSNRAAFHLYTETLGYSIQDVEAKYYADGEDAYDMRKQLKGKQIHQQHHHHHHHHHGGGCCAPQPKPIEAKPEPKTEGNPVAKAEAKAA

SEQ ID NO: 2879 - protein, 201 aa, Linum usitatissimum
MVCIRKATMDDLLAMQACNLLCLPENYQMKYYFYHILSWPQLLYVAEDYNGRIVGYVLAKMEEESNECHGHITSLAVLRTHRKLGLATKLMTAAQSAMEQVFGAEYVSLHVRKSNRAAFHLYTETLGYSIQDVEAKYYADGEDAYDMRKQLKGKEIHQQHHHHHHHHHGGGCCAPQPKPIEAKPEPKTEGKPTAKAEVKAP

SEQ ID NO: 2880 - protein, 200 aa, Papaver somniferum
MVCIRQATIDDLLAMQACNLLCLPENYQMKYYFYHILSWPQLLYVAEDYGGRIVGYVLAKMEEESTECHGHITSLAVLRTHRKLGLATKLMTAAQNAMEQVFGSEYVSLHVRRSNRAAFNLYTETLGYQIHDIEAKYYADGEDAYDMRKQLKGKQLHHRGHGHGHGHGHHHHHHGGGCCSSEAKPAKGGETKAIAAAPAE

SEQ ID NO: 2881 - protein, 205 aa, Euonymus alatus
MVCIRKATMEDLLAMQACNLLCLPENYQMKYYLYHILSWPHLLYVAEDYNGRIVGYVLAKMEEESNECHGHITSLAVLRTHRKLGLATKLMSAAQAAMEQVFGAEYVSLHVRKSNRAAFNLYTGTLGYKIHDVEAKYYADGEDAYDMRKQLKGKQNHHHGHHHHHHHHHQHGGGCCSGEPRSAEPRGEAKSDSKVMTKSESKSAN

SEQ ID NO: 2882 - protein, 183 aa, Silene vulgaris
MVCIRKATADDLLQMQACNLLCLPENYQMKYYLYHVLSWPQLLYVAEDYNGKIVGYVLAKMDEESSECHGHITSLAVLRTHRKLGLATKLMSAAQSAMDQVYGAEYVSLHVRKSNRAAFKLYTETLHYKIHDIEAKYYADGEDAYDMRKTFKPKAVQGHGHGHGHHHHHGGGCCSSSHASGGA

SEQ ID NO: 2883 - protein, 201 aa, Aquilegia formosa
MVCIRQATIDDLLAMQACNLLCLPENYQMKYYFYHILSWPQLLYVAEDYGGKIVGYVLAKMEEESTECHGHITSLAVVRTHRKLGLATKLMTAAQNAMGEVFGAEYVSLHVRRSNRAAFHLYTETLGYKISDIEAKYYADGEDAYDMRKQLKGRQHQTQPQHHHHHHHHHGGGCCSSGAKTTTSSGGGGGEAKASTSTSAA

SEQ ID NO: 2884 - protein, 192 aa, Picea glauca
MVCIRQATMEDLLSMQTCNLMCLPENYQMKYYFYHILSWPQLLYVAEDYNKKIVGYVLAKMDEESTECHGYITSLAVLRTHRKLGLATKLMTAAQKAMHEVFGAEYVSLHVRKSNRAAFHLYTHTLGYKINDIEAKYYADGEDAYDMRKQLKVKSDGKHHHHHHHHQHSGGCCSGDGGDGKLQSAVDKKSKE

SEQ ID NO: 2885 - protein, 381 aa, Cephalotaxus harringtonia
MVVEKKLMYINEIQCTVLEVKVIEGLGTTIDVILINGVLHEGDQIVVCGMQGPIVASIRALLTPHPMKELRVKGSYQHHKELKAAQGIKITAQGLEHAIAGTQLYVVGPDDDLDDIKEEAMQDMNNVMSRIDKSGEGVYVQASTLGSLEALLEFLKSPAVSIPVSGIGIGPVHKKDVMRASVMLEKKKKEYAAILAFDVKITPEARELADELGVKIFMADIIYHLFDQFKAYMDNLKEERKKDSAEDAVFPCVLGILPNCVFNKKDPIIVGVDVLEGIARVGTPLCVPTKDFIDIGKIASIEINHKAVEMAKKGEKVAMKIIGSNADEAQKMFGRHFEMEDEFVSHLTRRSIDILKENYRDDLSNDDWKLVVKLKKLLKIP

SEQ ID NO: 2886 - protein, 186 aa, Distylium racemosum
MVCIRQATLDDLLAMQSCNLMCLPENYQMKYYFYHILSWPQLLYVAEDYNKKIVGYVLAKMEEEATECHGHITSLAVLRTHRKLGLATKLMSAAQRAMHEVFGAEYVSLHVRKSNKAAFHLYTETLGYKIHDVEAKYYADGEDAYDMRKQLKPKEDHSHHHCGGCCGAELDAKATAGGDRKGKEGS

SEQ ID NO: 2887 - protein, 188 aa, Pinus pinaster
MVCIRQATIDDLLAMQTCNLMCLPENYQMKYYFYHILSWPQLLYVAEDYNKKIVGYVLAKMEEESTECHGHITSLAVLRTHRKLGLATKLMTAAQKAMQEVFGAEYVSLHVRKSNRAAFHLYTQTLGYKIHDIEAKYYADGEDAYDMRKQLRVKSDGKHHHHHHSGVCCGGDGGDGKLQSAADKKSKE

SEQ ID NO: 2888 - protein, 156 aa, Rosa hybrid cultivar
MVCIRKATMDDLLAMQACNLFCLPENYQMKYYLYHILSWPQLLYVAEDYNGRIVGYVLAKMEEESNECHGHITSLAVLRTHRKLGLATKLMSAAQNAMEQVFAAEYVSLHVRKSNRAAFNLYTETLGYKIHDVEAKYYADGEDAYDMRKELKGKKA

SEQ ID NO: 2889 - protein, 189 aa, Brassica napus
IRRATVDDLLAMQACNLMCLPENYQMKYYLYHILSWPQLLYVAEDYNGRIVGYVLAKMDEESNECHGHITSLAVLRTHRKLGLATKLMTAAQAAMEQVYEAEYVSLHVRRSNRAAFHLYTETLGYKIHDVEAKYYADGEDAYDMRKYFKGKQNHQQSHGHHHHHHGGGCCSGDAVDTTQAEDAIATTSK

SEQ ID NO: 2890 - protein, 200 aa, Papaver somniferum
MVCIRQATIDDLLAMQACNLLCLPENYQMKYYFYHILSWPQLLYVAEDYGGRIVGYVLAKMEEESTECHGHITSLAVLRTHRKLGLATKLMTAAQNAMEQVFGSEYVSLHVRRSNRAAFNLYTETLGYQIHDIEAKYYADGEDAYDMRKQLKGKQLHHRGHGHGHGHGHHHHHHGGGCCSSEVKPAKAGETKAIAAAPAE

SEQ ID NO: 2891 - protein, 189 aa, Beta vulgaris
MVCIRKATVDDLLQMQAANLLCLPENYQMKYYLYHILSWPQLLYVAEDYNGKIVGYVLAKMEEESTECHGHITSLAVLRTHRKLGLATKLMSAAQAAMEHVYSAEYVSLHVRKSNRAAFRLYTETLGYKIHDIEAKYYADGEDAYDMRKQLKAKSGHGHGHGHGHGHGHGHHHHGGECCSHGHGSVETE

SEQ ID NO: 2892 - protein, 198 aa, Cynodon dactylon
MVCIRQATIDDLLAMQACNLMCLPENYQMKYYLYHMLSWPQLLFVAEDYGGRIVGYVLAKMEEDPSEPCHGHITSLAVLRSHRKLGLATKLMSAAQAAMDQVFGAEYVSLHVRRSNRAAFNLYTSTLGYQIHDIEAKYYADGEDAYDMRKPLRQPQPKKHHHHHHHHGPGGCCSHDAPPAAAAGSSPSSGSSDKKANS

SEQ ID NO: 2893 - protein, 180 aa, Cicer arietinum
MGRRHGWELPFHTFQVVAITVYFLLCIAYYAFFAPFLGKEIYEYVAFGVYSVLALSVFVLYVRCTAIDPADLGVRLDCDQTSNNRSKHDEELTEPNKIGLKDERMSDRHDSNVCSKLGCCLCSSLQWKIAAAMKILFCNKNPERRRLCSVLYAKLRFGSSVSIVEVVTNVLMDSITIAGG

SEQ ID NO: 2894 - protein, 644 aa, Cajanus cajan
MARRHGWELPFHTFQVVAITVFFLLSIAYYAFFAPFLGKDIYEYVALGVYSLLALSVFFLYVRCTAIDPADQGVMLDCDKTSKNRSKLDEELAEPSKIGLKDEEMSDRHNSNWCSKVGCFFCSFLVREDCRSNEDIILQQQSGEEDALFCTLCNAEVRKFSKHCRSCDKCVDGFDHHCRWLNNCVGKKNYITFVCLMAVSLVWLIVECGVGIAVLVRCFVDKKGTDNQIAEKLGAGFSRVPFATIVAICTAVSFLATVPLGELFFFHMILIRKGITTYEYVVAMRTLSEPPGPSVDAGEQQSLPSSPTSSAVTAISGRSSVGMSLQYKGAWCTPPRIFMDHPDEIIPHLEPGRLPSTVDPDAVQPPDKGKRLNQRPVRISAWKLAKLDSNEATKAAAKARASSSVLRPISSRPQAYDVDHLSSSNVSGRSSPISNRGFHNKYDTAGTSRLSPSKSSYAHSQASKEDIDASCQHSMSNFSSPQVSNLTPSPMQQPNLNRDHFNPMYQQPSRNQSPSSAKESEGNMNTVHDNVPRVPMRSNTLAVSDNRRSSVFWDQAAGRFVSSSSRGPGSSQISGTELLYTGRSIFFGSPVVNEQPTTGTRISSSVPGVPDRDSTLRDFQLGRSHRGGQLPVFVPGYSQQSKFP

SEQ ID NO: 2895 - protein, 648 aa, Phaseolus coccineus
MARRHGWELPFHTFQVVAITVFFLLSIAYYAFFAPFLGKDVYEYVAIGVYSLLALSVFFLYVRCTAIDPADQGVTVDCDKSSKNRSKHDEELAEPSKIGLKGEGMSDRHNSNWCSKVGCFFCGFLVREDCRSNEDIIPQQQSGEEDALFCTLCNAEVRKFSKHCRSCDKCVDGFDHHCRWLNNCVGKKNYITFVCLMAVSVVWLIVECGVGIAVLVRCFVDKKGTEHQIAEKLGAGFSRVPFATIVAICTAVSFLATVPLGELFFFHMILIRKGITTYEYVVAMRTLSEPPGPSVDGGEQQSLPSSPTSSAVTAMSGRSSVGMSLQYKGAWCTPPRIFMDHPDEIIPHLEPGRLPSTVDPDAVQPLSDKGKKLNQRPVRISAWKLAKLDSNEATKAAAKARASSSVLRPISSRPHAYDVDHLSSSNVSGRSSPISNHQGFHNKYDTAGTSRLSPSKSSYAPSQASKDDMDASCHHSMSNFSSPQVSNMTPSPMQPSSNRDHFNPMYQQPSGNQSPSSAKESDGGNTKPVQENVARVPMRSNSLAVSDNRRSSVFWDQAAGRFVSSSSSSRGPGSSQISGTELLYTGRSIFFGSPVVNEQPNTGTRVSSSVTGIPDRDSTLRDFQQGRSHRGGQLPVFVPGYSQQNKFP

SEQ ID NO: 2896 - protein, 1193 aa, Glycine max
MAGGAATAERSLKETPTWAVAAVCSVFIIISVLIEHGIHSLGKWFQKRHKKAMNEALEKIKSELMLLGFISLLITFGTKYIAKICIPVSAGDIMLPCKKVEVSDSDDDSNDRRKLLSFDDNVVEWRRVLAAASGGDYCSQKGKVPLISQSGVHQLHIFIFVLAVFHIFYSVMTMVLARAKMKKWKAWEAETSSLEYQFTNDPARFRLAHQTSFVRRHSGWSRMPGIRWIVAFFRQFFGSVTKVDYMTMRHGFINAHFAPDSKFDFQKYIKRSMEDDFKVVVGISIPLWVFAIVFMLVNVYKWYTLTWLSLAPLVVILLLVGTKLELIIMEMAQQIQDRATIVRGVPIVEPNNKYFWFNRPQWIIFLIHFTLFENAFQIAFFLWTWYEFKITSCFHENLPLILTRVVLGIALQVVCSYITFPLYSLVTQMGSHMKKTIFEEQTAKALKKWQKAAKDKRKLRKAGIDIPSGTMSGETTPSQGTSPLHLLHKYKPSHTDTDSVLYSPRSYQSDTDLSETEGSSHQLNEITQTRQASRNGETHNIDFSFSVRVSVMARRHGWELPFHTFQVVAITVFFLLSIAYYAFFAPFLGKDIYEYLAIGVYSVLALSVFFLYVRCTAIDPADKGVMVDCDKTSKNRSKLDEELAEPSKMGLKGDGMSDRHNSNWCSKVGCFFCGFLVREDCCSNEEISLQQQSGEEEALFCTLCNAEVQKFSKHCRSCDKCVDGFDHHCRWLNNCVGKKNYITFVCLMAVSLVWLIVECGVGIAVLVRCFVDKKGTENQIAEKLGAGFSRVPFAIIVAICTAVSFLATVPLGELFFFHMILIRKGITTYEYVVAMRTLSEPPGPSVDGGEQQSLPSSPTSSAVTAMSGRSSVGMSIQYKGAWCTPPRIFMDHPDEIIPHLEPGRLPSTVDPDAVQPPDKGRKMNQRPVRISAWKLAKLDSNEATKAAAKARASSSVLRPISSRPHAYDVDHVSSSNVSGRSSPISNQGFHIKNDTVGTSRLSPSKSSYPPSQASKDDIDASCQHSMSNFSSPRVSNLTPSPMQRPGLNRDHFNPMYQQPSGNQSPSSAKGSEGNINPVHDNVPRVPMRSNTLAVSDNRRSSVFWDQAAGRFVSSSSRGPGTELLYTGRSIFFGSPVVNEQPSTGTRSSSSVVAGIPDRDSSTLRDFQQGRSHRGGQLPVFVPGCGYAQQNKFP

SEQ ID NO: 2897 - protein, 1203 aa, Glycine max
MAGGGATAERSLEETPTWAVAAVCSVFVIISVLIEHGIHSLGKWFQKRHKKAMNEALEKIKSELMLLGFISLLITFGTQYIAKICIPVSAGDIMLPCKKVEVSDSDDDSNDRRKLLSFDDNMEWRRVLAAASGGDYCSQKGKVSLISQSGVHQLHIFIFVLAVFHIFYSVMTMVLARAKMKKWKAWEAETSSLEYQFTNDPSRFRFAHQTSFVRRHSGWSRMPGIRWIVAFFRQFFGSVSKVDYMTMRHGFINAHFAPDSKFDFQKYIKRSMKDDFKVVVGISIPLWVFAIVFMLVNVYKWYTLTWLSLAPLVILLLVGTKLELIIMEMAQQIQDRATIVRGVPIVEPNNKYFWFNRPQWIIFLIHFTLFENAFQIAFFLWTWYEFKITSCFHESLPLILTRVVLGIALQVVCSYITFPLYSLVIQMGSHMKKAIFEEQTAKALKKWQKAAKDKRKLRKAGIDMSGETTPSQGTSPLHLLQKYKPSHTDTDSVLYSPRSYQSDTDLSETEGSSHQLNEITQTHQAPRNGETHNIDFSFSVGDSVMARRHGWELPFHTFQVVAITVFFLLSIAYYAFFAPFLGKDIYEYVAIGVYSVLALSVFFLYVRCTAIDPADQGVMVDCDKTSKNRSKLDEELAGIEQIIHHVIVLIRVTTNPKSYVTDLYMPFCSWCSKVGCFFCSFLVREDCRSNEDISLQQQSGEEEALFCTLCNAEVRKFSKHCRSCDKCVDGFDHHCRWLNNCVGKKNYITFVCLMAVSLVWLIVECGVGIAVLVRCFVDKKGTENQIAEKLGAGFSRVPFAIIVAICTAVSFLATVPLGELFFFHMILIRKGITTYEYVVAMRTLSEPPGPSVDGGEQQSLPSSPTSSAITAISGRSSVGMSIQYKGAWCTPPRIFMDHPDEIIPHLEPGRLPSTVDPDAVQSPDKGRKMNQRPVRISAWKLAKLDSNEATKAAAKARASSSVLRPISSRPHAYDVDHLSSSNVSGRSSPISNQGFHIKYDTAGTSRLSPSKSSYPPSHASKEDIDSSCQHSMSNISSPQVSNLTPSPMQRPSLNRDHFNPMYQQPSGNQSPSSGKGIEGNINPVHDNVARAPMRSNTLGVSDNRRSSVFWDQEAGRFVSSSSRGPGSSQIPGTELLYTGRSIFFGSPVVNEQPSTGTRSSSSVVAGIPDRDSSTLRDFQQGRSHRGGQLPVFVPGYAQQNKFP

SEQ ID NO: 2898 - protein, 651 aa, Arachis hypogaea
MARRHGWSLPFHTFQVVAINGFFLLSIAFYAFFAPFLGRDIYEYVAFGVYSAPALSVFLLYVRCTAIDPADLGVLLDSDKTSKNQSKADEELAETGKTGLKGEGTSGQHNSSWCSKIGCFFCSFLVREDCRSNEDNNLQQQSGEEEALFCTLCNAEVRKFSKHCRSCDKCVDGFDHHCRWLNNCVGRKNYVTFVCLMAVSLVWLIVECGVGIAVLVRCFVDKRDTENQIAEKLGAGFSRVPFAIIVAICTAVSFLATLPLGELLFFHMILIRKGITTYEYVVAMRTLSEPPGPSVDAGEQHSLPSSPTSSAVTAVSGRSSVGMSLQYKGAWCTPPRIFMDHPDEIIPHLEPGRLPSTVDPDAIQPPDKGKKPNHRAVRISAWKLAKLDSNEAAKAAAKARASSSVLRPINARSNPYDADNLSSSNVSGRSSPISNQGFHNKYDAAGTSRLSPYKGSYPPSQASKEDLDSCQHSMSNFSSPQVSNLTPSPMQIPTLSRDHFNPMYQQPSGNQSPLSARESEGNVNPVRDNNGRLPMRGNNIAVSENRRSLVFWDQEAGRFVSSSSGGHGSSQVSGTELLYSGRSIFFGSPVVNEQATTGTRSSSSAAGIQDRDAALREFQQGRSHRGGQLPVFVPGYSQSQSQSQSQQNKFS

SEQ ID NO: 2899 - protein, 357 aa, Medicago truncatula
MAATHGKIILFMFLAAFMLFNTQNAFVSCALTSELQNKIAKINEEGPYLGLIIPNSFELNPLLQNPGYTPSDSIIDFAGRRFRFGSIGEKPVILVMTGLSVINAAITTQLLLSFFKVDGVVHYGIAGNANPSLHIGDVAIPHYWAHLALWSWQRYGQDADDTLPLEINGDYTRDVGFLKFSDFTSNISAADSVTVDNHLNNLWYQPEEIFPVDGIPEQRQHALWVPVDSEYYRIAKKLEQMKLDACIDSDTCLTTTPKVVLVERGTSAGFYLDNAAYRTFIFNKFNVSPVDMESASVALICLQQRIPFIAIRALSDLAGGGTAESNEADTFSPLAATNSVAVVIEFVKLLSSHHSKW

SEQ ID NO: 2900 - protein, 75 aa, Medicago truncatula
MSSCGCGSSCNCGDSCKCSKRSSGLSYAEAETTETVILGVGLAKIQFEGAEMGVAAEDGGCKCGDNCTCDPCNCK

SEQ ID NO: 2901 - protein, 75 aa, Pisum sativum
MSGCGCGSSCNCGDSCKCNKRSSGLSYSEMETTETVILGVGPAKIQFDGAEMSVAAEDGGCKCGDSCTCDPCNCK

SEQ ID NO: 2902 - protein, 75 aa, Pisum sativum
MSSCGCGSSCNCGDSCKCSKRSSGLSYSEMETTETVILGVGPAKIQFDGAEMSVAAEDGGCKCGDSCTCDPCNCK

SEQ ID NO: 2903 - protein, 76 aa, Cicer arietinum
MSGCNCGSSCNCGDSCKCNKRSSGLNYAEGGETTETVVLGVGPTKIQFEGAEMSVAAEDGGCKCGSSCTCDPCNCK

SEQ ID NO: 2904 - protein, 75 aa, Pisum sativum
MSGCGCGSSCNCGDSCKCNKRSSGLSYSEMETTETVILGVGPAKIQFEGAEMSAASEDGGCKCGDNCTCDPCNCK

SEQ ID NO: 2905 - protein, 75 aa, Trifolium pratense
MSGCNCGSSCNCGDSCKCNKRSSGLSYVEVETTETVILGVGPAKIQFEGAEMGVAAEESGCKCGSNCTCDPCNCK

SEQ ID NO: 2906 - protein, 73 aa, Trigonella foenum-graecum
MSSCSCGSSCNCGDNCNCNSSGLSYAEGAATETVILGVGPAKIQFEGAEMGVAAENGGCKCGDNCTCDPCNCK

SEQ ID NO: 2907 - protein, 246 aa, Cicer arietinum
MAGGVIQQLLRRKFQSHSLSPSVSSIFSKAEGSGSTGSSSLRALALIGAGVSGLLGFATTASADEAEHGLASPNYPWPHEGILSSYDHASIRRGHQVYTQVCASCHSMSLISYRDLVGVAYTEEEVKAMAAEIEVEDGPNDEGEMFTRPGKLSDRFPQPYANESAARFANGGAYPPDLSLITKARHNGQNYVFALLTGYRDPPAGVSIREGLHYNPYFPGGAIAMPKMLNDGAVEYEDGVPATEAQ

SEQ ID NO: 2908 - protein, 75 aa, Cicer arietinum
MSGCNCGSSCNCGDSCKCNKRSGLSYVEAGETTETVVLGVGPTKIHFEGAEMSVAAEDGGCKCGSSCTCDPCNCK

SEQ ID NO: 2909 - protein, 74 aa, Trigonella foenum-graecum
MSGCGCGSSCNCGDNCTCNSRSSGLSYTEGATKETVILGVAPAKIHFEGAEMGVAAEDGGCKCGDSCTCDPCNC

SEQ ID NO: 2910 - protein, 178 aa, Cicer arietinum
METVMEDVEEYNYREVNLPSLIPVVGEPELERETGERRRGRDIVIAIDHGPNSKHAFDWALIHLCRLADTIHLVHAVSDVKNQIVYDMTQVLMEKLAVEAFQVAMVKTVARIVEGDTGKVICKEAERTKPAAVVMGTRGRSLFQSVLHGSVGEYCFHHCKAAPLVIVPGKDAGDASIV

SEQ ID NO: 2911 - protein, 177 aa, Cajanus cajan
METVMEDEEYNYREVTLPSLIPVVPEPELERETGERRRGRDLVIAIDHGPNSKHAFHWALIHLSRLADTIHLLHAVSDLKNQVVYDITQGLMENLAVEAFQVAMVKTVARIVEGDPGKVICKEAERIKPAAVVMGTRGRSLIQSVIQGSVGEYCFHHCKAAPVVIVPGKDAGDASIV

SEQ ID NO: 2912 - protein, 178 aa, Glycyrrhiza uralensis
METVMEEVEEYNYREVMLPSLIPVVAEPELERETGERRRGRDIVIAIDHGPNSKHAFDWALAHFCRLADTLHLVHAVSDLKNQLVYDTTQGLMEKLAVEAFQVVMVKSVARIVEGDPGKVICKEAERIKPAAVVLGTRGRSLFQSVLQGSVGEYCFHHCKAAPVVIVPGKDAGDASTI

SEQ ID NO: 2913 - protein, 178 aa, Lotus japonicus
METVMEDVEEYNFREVRLPSLIPVVPEPELERESGERRRGRDIVLAIDHGPNSKHAFDWALIHLCRLADTIHLIHAVSDVKNQLVYDTTQGLMEKLAVEAFEVAMVKTVARIVEGDAGKVICNEAERIKPAAVVMGTRGRSLIQSVLQGSVGEYCVHNCKSAPVVIVPGKDAGDASII

SEQ ID NO: 2914 - protein, 74 aa, Arachis hypogaea
METVMEEVEEYNYREVRLPSLIPVVGEPELERETGERRRGRDILIAIDHAPNSKHAFDWALIHLCRLADTIHLT

SEQ ID NO: 2915 - protein, 177 aa, Glycine max
METVMEEEEYNYREVRLPSLIAVVGEPELGRETGERRRGRDIIIAIDHGPNTKHAFDWALVHLCRLADTIHLVHAVSDLHNQVVYDITQGLMEKLAIEAFQVLMVKTVARIVEGDPGKVICKEAERIKPAAVVMGTRGRSLIQSVLQGSVGEYCFHHCKAAPVVIVPGKEAGDASIL

SEQ ID NO: 2916 - protein, 177 aa, Vigna unguiculata
METVMEDEEYNYREVKLPSLLPVAPEPELERETGERRRGRDIIIAIDHGLNSKHAFDWALVHFCRLADTIHLVHVVSDLKMNDYYEISQGLMEKLAVEAFQVAMVKTVARIVEGDPGKIICQEAERIKPAAVILGTRGRGFLQSVLQGSVGVYCLHHCKAAPIVIVPGKDAGDESIV

SEQ ID NO: 2917 - protein, 180 aa, Linum usitatissimum
MEVLQEEEEYNWKEVKLPSLIPKVPEPELEREKGERRRGRDIIIAIDHGPNSKHAFDWALIHFSRLADTLHLVHAVSSVKNDIVDEMTQGLMEKLAVEAFQVSMVKSVARIVQGDAGKVICKEAERIKPAAVVMGTRGRSLVQSVLQGSVSEYCFHHCKAAPVIIVPGTEAGDESMVSWN

SEQ ID NO: 2918 - protein, 177 aa, Theobroma cacao
MDTVLEDEEYSYREVKLPTLIPIVPEPGLERESGERRRGRDIVIAVDHGPNSKHAFDWALIHLVRLADTIHLVHAVSSVRNEIVYETSQGLMEKLAVEAFEVAMVKTTARIVEGDAGKVICKEAERLKPAAVVMGTRGRSLIQSVLQGSVSEYCFHNCKSAPVIIVPGKEAGDESLI

SEQ ID NO: 2919 - protein, 176 aa, Linum usitatissimum
QEEEEYNWKEVKLPSLIPKVPEPELEREKGERRRGRDIIIAIDHGPNSKHAFDWALIHFSRLADTLHLVHAVSSVKNDIVDEMTQALMEKLAVEAFQVSMVKSVARIVQGDAGKVICKEAERIKPAAVVMGTRGRSLVQSVLQGSVSEYCFHHCKAAPVIIVPGTEAGDESMVSWN

SEQ ID NO: 2920 - protein, 177 aa, Gossypium hirsutum
METVMEDEEYNYREVILPSLIPVVPEPALERETGERRRGRDILIAIDHGPKSKHAFDWALIHFLRLADTIHLVHAVSSVRNDVVYETSQALMEKLAVEAFEVTMVRTKARIVEGDAGKVICKEAERLKPAAVVMGTRGRSLIQSVFQGSVSEYCFHNCKSAPVIIVPGKEAGDESLI

SEQ ID NO: 2921 - protein, 177 aa, Unknown
  Sequence found in Organisms: Gossypium hirsutum, Gossypium raimondii
METVMEDEEYNYREVNLPSLIPVVPEPALERETGERRRGRDILIAIDHGPKSKHAFDWALIHFLRLADTIHLVHAVSSVRNDVVYETSQALMEKLAVEAFEVAMVRTQARIVEGDAGKVICKEAERLKPAAVVMGTRGRSLIQSVFQGSVSEYCFHNCKSAPVIIVPGKEAGDESLI

SEQ ID NO: 2922 - protein, 177 aa, Tropaeolum majus
METVMEDEEYNYREVILPTLIPIVPEPGLERENGERRRGRDIVIAIDHGPNSKHAFDWALIHLCRLADTIHLVHAVSSVQNDLVYEMSQSLMEKLSVEALQVAMVKCVARIVEGDAGKVICKEAERLRPAAVVMGTRGRTLIQSVLQGSVSEHCFHNCKSAPVIIVPGKEAGDVSMI

SEQ ID NO: 2923 - protein, 67 aa, Phaseolus coccineus
METVMEDEEFNCREVKLPSMIPVAAEPELQRETGERRRGRDIIIAIDHGPDSKHAFDWALIHFCQTR

SEQ ID NO: 2924 - protein, 180 aa, Ricinus communis
MEVLNEEEEYDWKEVNLPSLIPIVPEPELERESGERRRGRDILIAIDHGPNSKHAFDWAMIHLCRLADTIHLVHAVSSVKNDIVYEMAQGLMEKLAVEAFQVAMVKSVARIVQGDAGKVICKEAESLRPAAVVMGTRGRGLVQSVLQGSVSEYCFHHCKAAPVIIVPGKEAGEESLVQWK

SEQ ID NO: 2925 - protein, 180 aa, Manihot esculenta
MEVLNEEEEYNWREVHLPSLIPVVPQPELERETGERRRGRDILIAIDHGPNSKHAFDWALIHLCRLADTIHLVHAVSSVKNDIVYEMAQGLMEKLAVEAFQVVMVKSVARIVEGDPGKVICKEAERLRPAAVVMGTRGRGLVQSVLQGSVSEYCFHHCKAAPVVIVPGKEAGDESLIQWK

SEQ ID NO: 2926 - protein, 86 aa, Phaseolus coccineus
MEKLAVEAFQVTMVKTVARLVEGDPGKVVCQEAERIKPAAVILGTRGRSLIQSVLQGSVGAYCLHHCKAAPIVIVPGKDVGDESVI

SEQ ID NO: 2927 - protein, 177 aa, Populus trichocarpa
MEILQEDEEYNWREVKLPSLIPVIPEPGLERETGERRRGRDILIAIDHGPNSKHAFDWALIHLCRLADTLHLVHAVSSVQNTVVYETSQQLMEKLAVEALQVAMVRTVARIVQGDAGKVICNEAERLKPAAVVMSTRGRSLVQSVLQGSVSEYCFHHCKAAPVIIVPGKEDGDESLI

SEQ ID NO: 2928 - protein, 177 aa, Solanum lycopersicum
METVMEDEEYNWSEVKLHSLIPIVPEPELDRETGERRRGRDIVIAIDHGPNSKHAFDWAVTHLCRLADTLHLVHAVSSLKNEIVYEATQGLMEKLAVEAFSVAMVKTVARIVEGDAGKVICKEAERLKPSAVVMGTRGRGIIQSVLQGSVAEYCLHNCKIAPVIIVPGKEAGEVSVI

SEQ ID NO: 2929 - protein, 169 aa, Trigonella foenum-graecum
MALVTGRSSALNPNAPLFVPAAFRQVEDFSPQWWELVKSSTWFHNYWLSQHKEEDFVESSGNDTTNDDDIENMLSETFDLGIEEDFNLLENEFEKLVMSDEAQECPVMDDPVEEKKPLNGVNKDAAALIKILSPKERGVKSPIGSPKLFEKPAQHVNLKCAPQRIHQPR

SEQ ID NO: 2930 - protein, 169 aa, Cicer arietinum
MALVSKRSSSLNPNAPLFVPAALRQVEDFSPQWWELVKSSTWFRDYWLSQHEEEDFGESGGNDTANDDMENTLSETFDLGIEEEDFNFLENEFEKLVMSNEAQEHPVMDDPVDERKPLHEGVNKDASALLKILSPNERGVKSPIGSKQFEKPAQYVNLKCAPQRIHQPR

SEQ ID NO: 2931 - protein, 227 aa, Medicago truncatula
MEGIVKSLYLPKIPKSQTCSGSLLNSPLLLHSNATSVTFNSATHHLHKCFLFQQPGGVIHPKAQEKVNLGAIHASKATTPTTTTTQRWILEPVGDGDSRHIGFKVERPGAYEITSNEVTVGRVPEKADLVIPVATVSGVHARIRIKQDNLLVIDLDSTNGTFIGDKRLKPGVVTTVSSGSYITFGDTNLAMFRVSKIEEKAADTVGEPEGELENDGKSDSTETSYNF

SEQ ID NO: 2932 - protein, 281 aa, Trigonella foenum-graecum
MENGHNFQEVSKPKYDCLLFDIDDTLYPLSSGISARTAKNIEEYMLQKLGMEAATVPELCYTLYKTYGTTMAGLKAIGYDFDYNDFHSSVHGRLPYNLLKPDPVLKGILQSLPYRKVLFTNADTGHAIRVLKRLGLEDCFERIISFDTLNSTDSINPPNDKDGSEIFDFCEYTRRPDSDTVLPKTPVICKPFEDAFEKAFKLADIDPQRTLFFDDSLRNLQTAKRLGLHTVAVGTSVRSTGVDHALESIHNIREAFPELWEVDEKHEIVNYKVAIETTVKA

SEQ ID NO: 2933 - protein, 218 aa, Cicer arietinum
MENGHKFQEVSKPKYDCLLFDVDDTLYPLSSGISANTAKNIEEYMLQKLGMEAATVPELCYSLYKTYGTTMAGLRAIGYDFNYNDFHSFVHGRLPYNLLKPDPILRGILLSLPIRKVVFTNADTGHAIRVLQRLGLEDCFERIISFDTLNSVDNPPNDKDGSAIFDFCKYTRQPDSDMVLPKTPVVCKPFEDAFEKAFKLADIDPQRTLSLMTVSAIY

SEQ ID NO: 2934 - protein, 409 aa, Cicer arietinum
MGNCLDSSAKVDAAQSSRSTSRASKTTPSSLTIPSYSDKSNALSLPTPRSEGEILSSPNLKAFTFNELKNATRNFRPDSLLGEGGFGHVYKGWIDEHTYTAAKPGSGMVVAVKRLKPEGFQGHKEWLTEVNYLGQLHHPNLVKLIGYCLEGDNRLLVYEFMPKGSLENHLFRRGPQPLSWSIRMKVAIGAARGLSFLHNAKSQVIYRDFKASNILLDAEFNSKLSDFGLAKAGPTGDRTHVSTQVMGTQGYAAPEYVATGRLTAKSDVYSFGVVLLELLSGRRAVDKTIAGVDQNLVDWAKPYLGDKRRLFRIMDSKLEGQYPQKGAFMAATLALQCLNREAKARPPMIEVLATLEHIEAPKHASRNSLSEHQRVHAPIRKSPARNRTPLNSTPTASPLPSVRQSPRAR

SEQ ID NO: 2935 - protein, 410 aa, Cajanus cajan
MGNCLDSSAKVDAAQSSRSTSGISKTTPSSLSIPSSYSEKSNASSLPTPRSEGEILSSPNLKAFTFNELKNATRNFRPDSLLGEGGFGYVYKGWIDEHTFTASKPGSGMVVAVKRLKPEGFQGHKEWLTEVNYLGQLHHPNLVKLIGYCLEGENRLLVYEFMPKGSLENHLFRRGPQPLSWPVRMKVAIGAARGLSFLHNAKSQVIYRDFKASNILLDAEFNAKLSDFGLAKAGPTGDRTHVSTQVMGTQGYAAPEYVATGRLTAKSDVYSFGVVLLELLSGRRAVDKTIAGMEQNLVDWAKPYLSDKRRLFRIMDSKLEGQYPQKGAFMAATLALQCLNSEAKARPPMTEVLATLQQIEAPKTAGRHSHSEHHRVQTPVRKSPARPRSPLNVTPTASPLPAHRQSPRVH

SEQ ID NO: 2936 - protein, 411 aa, Glycine max
MGNCLDSSAKVDAAQSSRSTSASGISKTTPSSLSIPSYSEKSNASSLPTPRSEGEILSSPNLKPFTFNELKNATRNFRPDSLLGEGGFGYVYKGWIDEHTFTASKPGSGMVVAVKRLKPEGFQGHKEWLTEVNYLGQLYHPNLVKLIGYCLEGENRLLVYEFMPKGSLENHLFRRGPQPLSWSVRMKVAIGAARGLSFLHNAKSQVIYRDFKASNILLDAEFNSKLSDFGLAKAGPTGDRTHVSTQVMGTQGYAAPEYVATGRLTAKSDVYSFGVVLLELLSGRRAVDKTITGMEQNLVDWAKPYLSDKRRLFRIMDTKLEGQYPQKGAFTAATLALQCLNSEAKARPPMTEVLATLEQIEAPKTAGRNSHSEHHRLQTPVRKSPARNRSPLNLTPTASPLPAHRQSPRVH

SEQ ID NO: 2937 - protein, 417 aa, Lotus japonicus
MGNCLDSSAKVDAAQSSRSTSASGISKTTPSSISISSYSEKSNASSLPTPRSEGEILSSPNLKAFTFNELKNATRNFRPDSLLGEGGFGYVYKGWIDEHSFTAAKPGSGMVVAVKRLKPEGFQGHKEWLTEVNYLGQLYHPNLVKLIGYCLDGENRLLVYEFMPKGSLENHLFRRGPQPLSWSVRMKVAIGAARGLSFLHNAKSQVIYRDFKASNILLDAEFNAKLSDFGLAKAGPTGDRTHVSTQVMGTQGYAAPEYVATGRLTAKSDVYSFGVVLLELLSGRRAVDKTIAGVDQNLVDWARPYLGDKRRLFRIMDSKLEGQYPQKGAFMAATLALQCLNNEAKARPPMTQVLETLEQIEAPKNAGRNSLAQHHNNRFQTPVRRSPARNRTPLNLTPTASPLPSPLPAHRHSPRAH

SEQ ID NO: 2938 - protein, 410 aa, Phaseolus coccineus
MGNCLDSSAKVDAAQSSRSTSGISKATPSSLSIPSYSEKSNALSLPTPRSEGEILSSPNLKSFTFNELKNATRNFRPDSLLGEGGFGCVYKGWIDEHTFTASKPGSGMVVAVKKLKPEGFQGHKEWLTEVNYLGQLYHPNLVKLIGYCLEGENRLLVYEFMPKGSLENHLFRRGPQPLSWSVRMKVAIGAARGLSFLHNANSQVIYRDFKASNILLDAEFNAKLSDFGLAKAGPTGDRTHVSTQVMGTQGYAAPEYVATGRLTAKSDVYSFGVVLLELLSGRRAVDKTISGMEQNLVDWAKPYLSDKRRLFRIMDTKLEGQYPQKGAFMAATLSLQCLNTEAKTRPPMTEVLATLEQIEAPKTTTRNSHSSEHHRVHTPVRKSPARNRSPLNLTPTASPLHAHRQSPRVH

SEQ ID NO: 2939 - protein, 411 aa, Arachis hypogaea
MGNCLDSSAKVDAAQSSRGNSVSAISKTPPSTLSIPSHSEKSNTSTLPTPRSEGEILSSPNLKAFTFNDLKNATRNFRPDSLLGEGGFGYVYKGWIDQHTFVASKPGSGMVVAVKKLKPESFQGHREWLTEVNYLGQLHHPNLVKLIGYCLEGENRLLVYEFMPKGSLENHLFRRGPQPLSWAVRMKVAIGAARGLTFLHNAKSQVIYRDFKASNILLDAEFNAKLSDFGLAKAGPTGDRTHVSTQVMGTQGYAAPEYVATGRLTAKSDVYSFGVVMLELLSGRRAVDKTISGMEQNLVDWAKPYLGDKRRLFRIMDTKLEGQYPQKAAFMAATLALQCLNSEAKARPAMTEVLATLEQIDSPKTAGRHSHSEHLRVHTPVRRSPARNRSPLHLTPAASPLPSHRQSLRVH

SEQ ID NO: 2940 - protein, 417 aa, Populus trichocarpa
MGNCLDSSSAKVDSTQSSHNPGASRISSRTSHSSVPSSLTIPSYSGRSSECLPTPRSEGEILSSPNLKAFSFNELKNATRNFRPDSLLGEGGFGYVFKGWIDEHTLTAAKPGSGMVVAVKKLKPEGFQGHKEWLTEVNYLGQLHHPNLVKLIGYCLEGENRLLVYEFMPKGSLENHLFRRGPQPLSWAIRIKVAIGAARGLSFLHDAKSQVIYRDFKASNILLDAEFNAKLSDFGLAKAGPTGDRTHVSTQVMGTHGYAAPEYVATGRLTAKSDVYSFGVVLLEFLSGRRAVDKSKVGVEQNLVDWVKPYLGDKRKLFRIMDTKLGGQYPQKGAFMAANLALQCLSTEAKVRPRMSEVLATLEQIESPKGAVKNIQLEHQTVQTPVRQSPMRHHRSPVIPTASASPLPSHHQSPRLR

SEQ ID NO: 2941 - protein, 421 aa, Arachis hypogaea
MGNCLDSSAKVDAAHSSRTSTSGISKASRSSAASSLSILSHNGTSDSSSSSASALPTPRSEGEILSSPNLKSFAFNELKSATRNFRPDSLLGEGGFGYVYKGWLDEHTFTASKPGSGMVVAVKKLKPEGFQGHKEWLTEVNYLGQLHHHNLVKLIGYCVEGEDRLLVYEFMPKGSLENHLFRRGPQPLSWSLRMKVAIGAARGLTFLHNAKSQVIYRDFKASNILLDAEFNTKLSDFGLAKAGPTGDRTHVSTEVMGTRGYAAPEYVATGRLTAKSDVYSFGVVLLELLSGRRAVDRTKAGVEQDLVDWAKPYLGDKRRLFRIMDTKLEGQYPQKGAYMAATLALKCLDREAKLRPPMTEVLETLEQIEVPKTAARNSQSGQNRVHVPPSPRKSPGQNLSPMNVTRTSYPLPPCRESPHVH

SEQ ID NO: 2942 - protein, 302 aa, Glycine max
MVVAVKRLKPEGFQGHKEWLTEVNYLGQLYHPNLVKLIGYCLEGENRLLVYEFMPKGSLENHLFRRGPQPLSWSVRMKVAIGAARGLSFLHNAKSQVIYRDFKASNILLDAEFNSKLSDFGLAKAGPTGDRTHVSTQVMGTQGYAAPEYVATGRLTAKSDVYSFGVVLLELLSGRRAVDKTITGMEQNLVDWAKPYLSDKRRLFRIMDTKLEGQYPQKGAFTAATLALQCLNSEAKARPPMTEVLATLEQIEAPKTAGRNSHSEHHRVQTPVRKSPARNRSPLNLTPTASPLPAHRQSPRVH

SEQ ID NO: 2943 - protein, 419 aa, Castanea mollissima
MGNCLDSSAKVDTAQSSHATSGSAVSKFSSKTSRSSAPSSLTIQTFSETSNASSLPTPRSEGEILSSPNLKPFTFNELKNATRNFRPDSLLGEGGFGYVFKGWIDENTFSAAKPGSGMVVAVKKLKSEGFQGHKEWLTEVNYLGQLHHPNLVKLIGYCLEGENRLLVYEFMPKGSLENHLFRRGPQPLSWAIRIKVATGAARGLCFLHEAKSQVIYRDFKASNILLDAEFNSKLSDFGLAKAGPTGDRTHVSTQVMGTHGYAAPEYVATGRLTAKSDVYSFGVVLLELLSGRRAVDKSKVGIEQNLVDWAKPYLGDKRKLFRIMDTKLEGQYPQKGAYTAATLALQCLSTEAKVRPKMAEVLATLEQLENPKNAGRTSQSEQHTGAPVRKSPMRPHNSPRNLTPGASPLPSYRQSPRVR

SEQ ID NO: 2944 - protein, 393 aa, Phaseolus coccineus
MGNCIGSSAKVEAAHSSRTPSGISKTSPSSVPSNLSIQSYCEASDVSNLPTPRSEGEILSSPNLKAFAFNELRNATRNFRPDSLLGEGGFGYVYKGWIDEHTFTASKPGSGMVVAVKKLKPEGLQGHKEWLTEVDYLGQLHHQNLVKLIGYCVEGENRLLVYEFMSKGSLENHLFRRGPQPLSWSVRMKVAIGAARGLSFLHNAQSQVIYRDFKASNILLDADFNPKLSDFGLAKAGPTGDRTHVSTQVMGTQGYAAPEYVATGRLTAKSDVYSFGVVLLELLSGRRAVDRTKAGVEQNLVEWTKPYLGDKRKLFRIMDTKLGGQYPQKGAYMAATLALQCLNREAKARPPMTEVLETLEQIAASKTAGRNSQTEQKRVHAPVRKSKVKMGAL

SEQ ID NO: 2945 - protein, 402 aa, Glycine max
MGNCLDSSAKVEAAHSSRTPSGISKTSPSSVPSNLSILSYSEASDFSNLPTPRSEGEILSSPNLKAFTFNELKNATRNFRPDSLLGEGGFGYVYKGWIDEHTFTASKPGSGMVVAVKKLKPEGLQGHKEWLTEVDYLGQLHHQNLVKLIGYCADGENRLLVYEFMSKGSLENHLFRRGPQPLSWSVRMKVAIGAARGLSFLHNAKSQVIYRDFKASNILLDAEFNAKLSDFGLAKAGPTGDRTHVSTQVMGTQGYAAPEYVATGRLTAKSDVYSFGVVLLELLSGRRAVDRSKAGVEQNLVEWAKPYLGDKRRLFRIMDTKLGGQYPQKGAYMAATLALKCLNREAKGRPPITEVLQTLEQIAASKTAGRNSQLEQKRVHAPVRKSSVQKGSHLNHTPTAFP

SEQ ID NO: 2946 - protein, 419 aa, Fagus grandifolia
MGNCLDSSAKVDTAQSSHATSGSGISKFSSKTSRSSAPSSLTIQTFSEKSNASSLPNPRSEGEILSSPNLKSFSFNELKNATRNFRPDSLLGEGGFGYVFKGWIDEHSFSAAKPGSGMVVAVKKLKSEGFQGHKEWLTEVNYLGQLHHPNLVKLIGYCLEGENRLLVYEFMPKGSLENHLFRRGPQPLSWAIRIKVATGAARGLCFLHDAKSQVIYRDFKASNILLDAEFNAKLSDFGLAKAGPTGDRTHVSTQVMGTHGYAAPEYVATGRLTAKSDVYSFGVVLLELLSGRRAVDKTKVVIEQNLVDWAKPYLGDKRKLFRIMDTKLEGQYPQKGAYTAATLALQCLSNEAKGRPRMAEVLATLEQLDNPKNAGRPSQSEQQTVAPVRKSPMRPHHSPRNLTPGASPLPAYRQSPRVR

SEQ ID NO: 2947 - protein, 420 aa, Prunus persica
MGNCLDSSAKVDTAQSSFGTLGSGVSKISSKTSPSSASPSLTIPSSGERSNGSSLPTPRTEGEILSSPNLKAFSFNELKNATRNFRPDSLLGEGGFGYVFKGWINEHTLTAAKPGSGMVVAVKKLKPEGFQGHKEWLTEVNYLGQLYHPNLVKLIGYCLEGENRLLVYEFMPKGSLENHLFRRGPQPLSWATRMKVAIGAARGLSFLHEAESQVIYRDFKASNILLDSEFNAKLSDFGLAKAGPTGDRTHVSTQVMGTQGYAAPEYVATGRLTAKSDVYSFGVVLLELLSGRRAVDKTKVGVEQNLVDWTKPYLGDRRKLFRIMDTKLEGQYPQKAAFTAATLASQCLCAESKLRPTMSVVLATLEQLEAPKTAARNSQSEQQTLSVPHRKSPMRQHHSPLNITPSASPLLSHRQSPRVR

SEQ ID NO: 2948 - protein, 418 aa, Populus trichocarpa
MGNCLDSSAARVDSTQSSHTPGASRISSRTSRSSVPSSLTIPSYSGKSSSDCFPTPRSEGEILSSPNLKAFSFNELKSATRNFRPDSLLGEGGFGCVFKGWIDENTLTASKPGSGMVVAVKKLKPEGFQGHKEWLTEVNYLGQLHHPNLVKLIGYCVEGENRLLVYEFMPKGSLENHLFRRGPQPLSWAVRVKVAIGAARGLSFLHDAKSQVIYRDFKASNILLDAEFNAKLSDFGLAKAGPTGDRTHVSTQVMGTHGYAAPEYVATGRLTAKSDVYSFGVVLLELLSGRRAVDKTKVGVEQNLADWAKPYLGDKRKLFRIMDTKLGGQYPQKGAFMAANLALQCLSNEAKVRPRMSEVLATLENIESPKGAAKNSRSEQQTVQTPVRQSPMRHHHAPGTPPASASPLPSHHQSPRLR

SEQ ID NO: 2949 - protein, 394 aa, Cajanus cajan
MGNCLDSSAKVEAAHTSRTPSGISKTSPSSVPSNLSIVSFSEASDASNLPTPRSEGEILSSPNLKAFTFAELRNATRNFRPDSLLGEGGFGYVYKGWIDEHTFTASKPGSGMVVAVKKLKHDGLQGHKEWLTEVDYLGQLHHQNLVKLIGYCVEGENRLLVYEFMSKGSLENHLFRRGPQPLSWAVRMKVAIGAARGLCFLHNAKSQVIYRDFKASNILLDADFNAKLSDFGLAKAGPTGDKTHVSTEVMGTQGYAAPEYVATGRLTAKSDVYSFGVVLLELLSGRRAVDRTKAGVEQNLVEWTKPYLGDKRRLFRIMDTKLGGQYPQKGAYMAATLALKCLNREAKARPPMTEVLETLEKIEVSKTAGRTSQLLEHKRVHAPARKSTVRNGPL

SEQ ID NO: 2950 - protein, 402 aa, Glycine max
MGNCLDSSAKVEAAHSSRTPSGISKTSPSSVPSNLSILSYSEASDFSNLPTPRSEGEILSSPNLKAFTFNELKNATRNFRPDSLLGEGGFGFVYKGWIDEHTLTASKPGSGMVVAVKKLKPEGLQGHKEWLTEVDYLGQLHHQNLVKLIGYCVEGENRLLVYEFMSKGSLENHLFRRGPQPLSWSVRMKVAIGAARGLSFLHNAKSQVIYRDFKASNILLDAEFNAKLSDFGLAKAGPTGDRTHVSTQVMGTQGYAAPEYVATGRLTAKSDVYSFGVVLLELLSGRRAVDRSKAGEEQNLVEWAKPYLGDKRRLFRIMDTKLGGQYPQKGAYMAATLALKCLNREAKARPPMTEVLETLELIATSKPAGRNCQLEQKRVHAPDRKSSVQKGSHLNHTPTAFP

SEQ ID NO: 2951 - protein, 258 aa, Quercus alba
MGNCLDSSAKVDTAQSSHATSGSAVSKLSSKTSRSSGPSSLTIQTFSETSNASSLPTPRSEGEILSSPNLKPFTFNELKNATRNFRPDSLLGEGGFGYVFKGWIDEHTFSAAKPGSGMVVAVKKLKSEGFQGHKEWLTEVNYLGQLHHPNLVKLIGYCLEGENRLLVYEFMPKGSLENHLFRRGPQPLSWAIRIKVATGAARGLCFLHEAKSQVIYRDFKASNILLDAEFNSKLSDFGLAKAGPTGDRTHVYSWLCCT

SEQ ID NO: 2952 - protein, 419 aa, Malus domestica
MGNCLDSSAKVDTAQSSLGTWGSGASKVSNKTSPSSAPSTLTVPSYNGRSSGSSLPTPRTEGEILSSPNLKAFSFNELKNATRNFRPDSLLGEGGFGYVFKGWINENTWTAAKPGSGMVVAVKKLKPEGFQGHKEWLTEVNYLGQLHHPNLVKLIGYCLEGENRLLVYEFMPKGSLENHLFRRGPQPLSWATRMKVAIGAARGLSFLHEAESQVIYRDFKASNILLDSEFNAKLSDFGLAKAGPTGDRTHVSTQVMGTQGYAAPEYVATGRLTAKSDVYSFGVVLLELLSGRRAVDKTKVGVEQNLVDWTKPYLGDKRKLFRIMDTKLEGQYPQKAAYTAATLASQCLCTESKLRPTMSVVLATLEQLESPKTAARNSQSEQHTLPVPRKSPMRQHHSPLNMPPNASPLASQRQSVRVR

SEQ ID NO: 2953 - protein, 420 aa, Theobroma cacao
MGNCLFSSTRVDSSQSPHATSASGGSRISSKTSRSSAPSSLTIPSFSDTSSSGCLPTPRTEGEILSSPNLKPFSFNELKNATRNFRPDSLLGEGGFGYVFKGWIDEHTLSAAKPGSGMVVAVKKLKPEGFQGHKEWLTEVDYLGQLHHPNLVKLIGYCLEGENRLLVYEFMPKGSLENHLFRRGPQPLSWAVRLKVAIGAARGLSFLHDLKSQVIYRDFKASNILLDAEFNAKLSDFGLAKAGPTGDRTHVSTQVMGTHGYAAPEYVATGRLTAKSDVYSFGVVLLELLSGRRAVDKTKVGVEQNLVDWAKPYLGDKRKLFRIMDTKLGGQYPQKGAYTAATLALQCLSSEAKLRPRMSVVLAALEQLEAPKNVSKHSHSEQQPVPLPVRKSPMRHHRSPMNITPIASPLPAHRQSPRVY

SEQ ID NO: 2954 - protein, 419 aa, Ricinus communis
MGNCLDSSAAKVDTTQGSHTPSGASRISSRTSRSSVPSSLTIPSYSERSSSECLPTPRTEGEILSSPNLKAFCFNELKNATRNFRPDSLLGEGGFGYVFKGWIDEHTLSAARPGSGMVVAVKKLKPEGFQGHKEWLTEVRYLGQLHHPNLVKLIGYCLEGENRLLVYEFMPKGSLENHLFRRGPQPLSWAVRIKVAVGAARGLSFLHDAKSQVIYRDFKASNILLDAEFNAKLSDFGLAKEGPTGDRTHVSTQVMGTHGYAAPEYVATGRLTAKSDVYSFGVVLLELLSGRRAVDKTKVGIEQNLVDWAKPYLSDKRKLFRIMDTKLGGQYPQKSAHMAANLALQCLSTEAKARPRMSEVLATLEQIESPKTAGRLSHSEHPSIQIPVRKSPMRQHHSPLNLTPSASPLPSHRQSPRVR

SEQ ID NO: 2955 - protein, 303 aa, Gossypium raimondii
MVIAVKKLKPEGFQGHKEWLTEVDYLGQLHHPNLVKLIGYCSEGENRLLVYEFMPKGSLENHLFRRGPQPLSWAVRLKVAIGAARGLSFLHDLKSQVIYRDFKASNILLDAEFNAKLSDFGLAKAGPTGDRTHVSTQVMGTQGYAAPEYVATGRLTAKSDVYSFGVVLLELLSGRRAVDKTKVGVEQSLVDWAKPYLGDKRKLFRIMDTKLGGQYPQKGAFTAATLALQCLNSEAKLRPRMSEVLAALEQLEAPKTASKHSQAEQHAVPLPVRKSPMRHHRSPMHLTPSASPLPSHRQSPRVH

SEQ ID NO: 2956 - protein, 421 aa, Gossypium hirsutum
MGNCLFSSTRVDSTQSPQPTSASGGSRISSKTSRSSAPSSLTLPSFSDTSSINGCLPTPRTEGEILASPNLKPFSFNELKNATRNFRPDSLLGEGGFGYVFKGWIDEHTLAAARPGSGMVIAVKKLKPEGFQGHKEWLTEVDYLGQLHHPNLVKLIGYCSEGENRLLVYEFMPKGSLENHLFRRGPQPLSWAVRLKVAIGAARGLSFLHDLKSQVIYRDFKASNILLDAEFNAKLSDFGLAKAGPTGDRTHVSTQVMGTQGYAAPEYVATGRLTAKSDVYSFGVVLLELLSGRRAVDKTKVGVEQSLVDWAKPYLGDKRKLFRIMDTKLGGQYPQKGAFTAATLALQCLNSEAKLRPRMSEVLAALEQLEAPKTASKHSQAEQHAVPLPVRKSPMRHHRSPMHLTPSASPLPSHRQSPRVH

SEQ ID NO: 2957 - protein, 420 aa, Vitis vinifera
MGNCLDSSARVDSTQSSHTTSASGASKVVSKTSNSSAPSTLTVPSYSERSTAESFPTPRSEGEILPSPSLKAFSFNDLKNATRNFRPDSLLGEGGFGYVFKGWIDEQTLAAVKPGSGMVIAVKKLKPEGFQGHKEWLTEVNYLGQLHHPNLVKLIGYCLEGENRLLVYEFMPKGSLENHLFRRGPQPLSWAVRIRVAIGAARGLSFLHDAESQVIYRDFKASNILLDAEFNAKLSDFGLAKAGPTGDRTHVSTQVMGTHGYAAPEYVATGRLTAKSDVYSFGVVLLELLSGRRAVDKTKIGVEQNLVDWAKPYLGDKRRLFRIMDTKLEGQYPQKGAFMAATLALQCLNTEAKVRPRMSEVLATLEQIQSPKNAAKHIQSEQHTVSIPVQKSPLRQQHSPLNLTPRASPLPSYRQSPRVR

SEQ ID NO: 2958 - protein, 421 aa, Fragaria vesca
MGNCLGSSARVDTAQSTLGTSASGTSKSSSKTSPSSAAPPSLTISSYSEKSNSSSLPTPRTEGEILSSPNLNPFSFNELRNATRNFRPDSLLGEGGFGYVFKGWINETTFTAAKPGSGMVVAVKKLKPEGFQGHKEWLTEVNYLGQLYHPNLVKLIGYCLEGENRLLVYEFMPKGSLENHLFRRGPQPLSWATRMKVAIGAARGLSFLHEAESQVIYRDFKASNILLDAEFNAKLSDFGLAKAGPTGDRTHVSTQVMGTQGYAAPEYVATGRLTAKSDVYSFGVVLLELLSGRRAVDKTKVGVEQNLVDWTKPYLGDKRKLFRIMDTKLEGQYPQKSAYTAATLALQCLSPESKQRPTMSTVVATLEQLDAPKTPARISQSEQQGVPLHHRRSPMQHHRSPLNLTPSASPLPSYRPSAFVH

SEQ ID NO: 2959 - protein, 592 aa, Cicer arietinum
MNNNHSLFIIAFFFFISSLFSTVRSDSSDHRFKEGDLVPLFANKVGPFHNPSETYRYFDLPFCIPDHLKEKKEALGEVLNGDRLVSAPYQLEYRRDKESVSVCKKKLTKEDVGKFRSAVRKDYYFQMYYDDLPIWGFIGKVDKEGKDPSDYRYYLYKHIHFDIFYNKDRVIEINVRTDPNALVDVTEDNEVDVEFFYTVKWKETNTPFDKRMDKYSQSSSLPHHLEIHWFSIINSCVTVLLLTGFLATILMRVLKNDFVKYAHDEEVADDQEETGWKYIHGDVFRFPKFKSVFAAALGSGTQLFTLTVFIFILALVGVFYPYNRGALFTALVVIYALTSGIAGYTATSFYCQLEGTNWVRNLLLTGCLFCGPLFLTFCFLNTVAIVYNATAALPFGTIVVIVLIWTLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALFFVRHIYRSIKCE

SEQ ID NO: 2960 - protein, 587 aa, Glycine max
MRNLSFFFFFFFTFFAAVRSDPSDHRYKEGDPVPLYANKVGPFHNPSETYRYFDLPFCEPGDLKEKKEALGEVLNGDRLVSAPYKLEFQRDKELVSVCDRKLSKQDVARFRSAVRKDYYFQMYYDDLPIWGFIGKVDKEGKDPSDYRYFLYKHIHFDVFYNKDRVIEINVRTDPNALVDLTEDAEVQAEFLYTVKWKETNTPFEKRMDKYSQSSSLPHHLEIHWFSIINSCVTVLLLTGFLATILMRVLKNDFVKYAHDEESAEDQEETGWKYIHGDVFRFPKFKSLFAAALGSGTQLFTLTVFIFILALVGVFYPYNRGALFTALVVIYALTSGIAGYTATSFYCQLEGTNWVRNLLLTGCLFCGPLFLTFCFLNTVAIAYKATAALPFGTIVVIVLIWSLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2961 - protein, 588 aa, Cajanus cajan
MNPLSLSLFFLVTTLATTVRSDSSDHRYKDGDPVPLYANKVGPFHNPSETYRYFDLPFCLPGHLKEKKEALGEVLNGDRLVSAPYQLEFQRDKEAISVCKKTLSKDEVARFRSAVRKDYYFQMYYDDLPIWGFIGKVDKDGRDPSDYRYFLYKHVHFDVFYNKDRVIEINVRTDPNALVDLTDDAEVHAEFLYTVKWKETNTPFDKRMDKYSQSSSLPHHLEIHWFSIINSCVTVLLLTGFLATILMRVLKNDFVKYAHDEEIAEDQEETGWKYIHGDVFRFPKFKSLFAAALGSGTQLFTLTVFIFILALVGVFYPYNRGALFTALVVIYALTSGIAGYTATSFYCQLEGTNWVRNLLLTGCLFCGPLFLTFCFLNTVAIAYKATAALPFGTIVVIVLIWTLVTSPLLVLGGIAGKNSKAEFQAPCRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2962 - protein, 589 aa, Prunus persica
MAVGVPVIIALLILCGVDLVRSDASDHRYKEGDLVPLYANKVGPFHNPSETYRYFDLPFCSPDKVKEKKEALGEVLNGDRLVSAPYKLEFQKHKDSEVACKRTIKKEEVARFRSAVNKDYYFQMYYDDLPIWGFIGKVDKEGKDPSEYKTYLYKHIHFDISYNKDRVIEINVRTDPNALVDLTEDKEIDVEFMYTVKWKETTTPFDKRMDKYSQSSSLPHHLEIHWFSIINSCVTVLLLTGFLATILMRVLKNDFVKYAHDEEAAEDQEETGWKYIHGDVFRFPKYKSLFAAALGSGTQLFTLTIFIFILALVGVFYPYNRGALFTALVVIYALTSGIAGYTATSFYCQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRATIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRAALLFVRHIYRSIKCE

SEQ ID NO: 2963 - protein, 594 aa, Phaseolus coccineus
MRNLFSSSSSFCLLLFTAFAALSAVRSDSSDHRYKQGDIVPLYANKVGPFHNPSETYRYFDLPFCPPVDLKEKKEALGEVLNGDRLVSAPYVLEFQRDKESVHVCDAKLSKKDVARFRSAVRKDYYFQMYYDDLPIWGFIGKVDKEGKDPSEYRYFLYKHIHFDVFYNKDRVIEINVRTDPNALVDLTEDAEVNAEFQYTVKWKETNTPFEKRMDKYSQSSSLPHHLEIHWFSIINSCVTVLLLTGFLTTILMRVLKNDFVKYAHDEETAEDQEETGWKYIHGDVFRFPKFKSLFAAALGSGTQLFTLTLFIFILALVGVFYPYNRGALFTALVVIYALTSGIAGYTATSFYCQLEGTNWVRNLLLTGCLFCGPLFLTFCFLNTVAIAYKATAALPFGTIVVIVLIWTLVTSPLLVLGGIAGKNSKVEFQAPVRTTKYPREIPPLPWYRGPIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2964 - protein, 593 aa, Linum usitatissimum
MAGKKMVALLFVAVLVVVFGADQVRSDASDHRYKDGDQVPLYANKVGPFHNPSETYRYFDLPFCFPAHMKEKKEALGEVLNGDRLVSAPYQLDFLREKDSEVVCKKRLSKEEVDQFRAAVKKDYYFQMYYDDLPIWGFIGKVDKEGKDPSDYKYYLFKHIHFDIFYNKDRVIEINVRTDPNALVDVTEDKEVDVEFLYTVKWKETNTPFDKRMDKYSQSSSLPHHLEIHWFSIINSCVTVLLLTGFLATILMRVLKNDFVKYAHDEEAAEDQEETGWKYIHGDVFRYPKYKSLFAASLGSGTQLFTLTIFIFILALVGVFYPYNRGALFTALVVIYALTSGIAGYTATSFYCQLEGTNWVRNLLLTGCLFCGPLFLTFCFLNTVAIVYTATAALPFGTIVVIVLIWTLVTSPLLVLGGIAGKNSKAEFQAPCRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGSVGFRAALLFVRHIYRSIKCE

SEQ ID NO: 2965 - protein, 590 aa, Eucalyptus grandis
MGKPMAVLAVAVLMASLCSPARSDGSDHRYKDGDPVPLYANKVGPFHNPSETYRYFDLPFCIPAHLKEKKEALGEVLNGDRLVSAPYKLDFMKDKESEVICKKKLSKEEVAQFRSAVIKDYYFQMYYDDLPIWGFIGKVDKEGKDPSEYKYFLYKHIHFDIFYNKDRVIEINVRTDPNALVDLTEDKQTQVEFMYTVKWKETNTPFDKRMDKYSQSSSLPHHLEIHWFSIINSCVTVLLLTGFLATILMRVLKNDFVKYAHDEESVEDAEETGWKYIHGDVFRYPRFQSLFAAALGSGTQLFTLTVFIFILALVGVFYPYNRGALFTALVVIYALTSGIAGYTSTSFYCQLEGTNWVRNLLLTGCLFCGPLFLTFCFLNTVAIVYTATAALPFGTIVVIVLIWTLVTSPLLVLGGIAGKNSKAEFQAPCRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGMVGFRAALLFVRHIYRSIKCE

SEQ ID NO: 2966 - protein, 589 aa, Malus domestica
MTVGVHCIIALLILSGADLVRSDGSDHRYKEGDLVPLYANKVGPFHNPSETYRYFDLPFCSPGAVKEKKEALGEVLNGDRLVSAPYKLEFLKHKDTDVACKTKLKKEEVAQFRSAVNKDYYFQMYYDDLPIWGFIGKVDKEGKDPSEYKTYLYKHIHFDLYYNKDRVIEVNVRTDPNALVDLTEDKEVDVEFMYTVEWKETATPFEKRMDKYSQSSSLPHHLEIHWFSIINSCVTVLLLTGFLATILMRVLKNDFVKYAHDEEAAEDQEETGWKYIHGDVFRFPKYKSLFAAALGSGTQLFTLTVFIFILALVGVFYPYNRGALFTALVVIYALTSGIAGYTATSFYCQLEGSNWVRNLLLTGCLFCGPLFLTFCFLNTVAIAYTATAALPFGTIVVIVLIWTLVTSPLLVLGGIAGKNSKAEFQAPVRTTKYPREIPPLPWYRATIPQMAMAGFLPFSAIYIELYYIFASVWGHRIYTIYSILFIVFIILLIVTAFITVALTYFQLAAEDHEWWWRSFLCGGSTGLFIYTYCLYYYYARSDMSGFMQTSFFFGYMACICYGFFLMLGTVGFRAALLFVRHIYRSIKCE

SEQ ID NO: 2967 - protein, 591 aa, Cucumis melo
MGRFGAVPFIALLVLLCGSVPVRSDGSDHRYKDGDPVPLYANKVGPFHNPSETYRYFDLPFCVPDDVKEKKEALGEVLNGDRLVSAPYKLDFLQEKDSSSVCQKKLSKEDVARFRAAVDKDYYFQMYYDDLPIWGFIGKVDKEGKDPSDFKYYLYKHIHFDIFYNKDRVIEINVRTDPNALVDLTEDKEVDVEFLYTVKWKETTTPFENRMDKYSQSSSLPHHLEIHWFSIINSCVTVLLLTGFLATILMRVLKNDFVKYAHDEESAEDQEETGWKYIHGDVFRYPKHKSLFAACLGSGTQLFTLTVFIFILALVGVFYPYNRGALFTALVVIYALTSGIAGYVATSFYCQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACVCYGFFLMLGAIGFRAALLFVRHIYRSIKCE

SEQ ID NO: 2968 - protein, 591 aa, Citrullus lanatus
MGRFGAVVFIALLFLLCGSLRVRSDGSDHRYKDGDSVPLYANKVGPFHNPSETYRYFDLPFCVPDDVKEKKEALGEVLNGDRLVSAPYKLDFLQEKDSITVCKKTLSKEDVARFRAAVDKDYYFQMYYDDLPIWGFIGKVDKEGKEPSDFKYYLYKHIHFDIFYNKDRVIEINVRTDPNALVDLTEDKEVDVEFLYTVKWKETTTPFENRMDKYSQSSSLPHHLEIHWFSIINSCVTVLLLTGFLATILMRVLKNDFVKYAHDEESAEDQEETGWKYIHGDVFRYPKHKSLFAACLGSGTQLFTLTVFIFILALVGVFYPYNRGALFTALVVIYALTSGIAGYIATSFYCQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACVCYGFFLMLGAIGFRAALLFVRHIYRSIKCE

SEQ ID NO: 2969 - protein, 591 aa, Cucumis sativus
MRRFGAVPFIALLVLLCGSVPVRSDGSDHRYKDGDPVPLYANKVGPFHNPSETYRYFDLPFCVPDDVKEKREALGEVLNGDRLVSAPYKLDFLQEKDSSSVCQKKLSKEDVGRFRAAVDKDYYFQMYYDDLPIWGFIGKVDKEGKDPSDFKYYLYKHIHFDIFYNKDRVIEINVRTDPNALVDLTEDKEVDVEFLYTVKWKETTTPFENRMDKYSQSSSLPHHLEIHWFSIINSCVTVLLLTGFLATILMRVLKNDFVKYAHDEESAEDQEETGWKYIHGDVFRYPKHKSLFAACLGSGTQLFTLTVFIFILALVGVFYPYNRGALFTALVVIYALTSGIAGYVATSFYCQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACVCYGFFLMLGAIGFRAALLFVRHIYRSIKCE

SEQ ID NO: 2970 - protein, 593 aa, Malus domestica
MRKTMAVGVHCIVALLILSGADLVRSDGSDHRYKEGDFVPLYANKVGPFHNPSETYRYFDLPFCSRDAVKEKREALGEVLNGDRLVSAPYKLEFLRHKDTEVACKKSLTKEEVARFRSAVNKDYYFQMYYDDLPIWGFIGKVDKEGKDPSEYKTYLYKHIHFDLYYNKDRVIEVNVRTDPNALVDLTEDKEVDVEFMYTVEWKETTTPFDKRMDKYSQSSSLPHHLEIHWFSIINSCVTVLLLTGFLATILMRVLKNDFVKYAHDEEAAEDQEETGWKYIHGDVFRFPKYKSLFAAALGSGTQLFTLTVFIFILALVGVFYPYNRGALFTALVVIYALTSGIAGYTATSFYCQLEGSNWVRNLLLTGCLFCGPLFLTFCFLNTVAIAYTATAALPFGTIVVIVLIWTLVTSPLLVLGGIAGKNSKAEFQAPVRTTKYPREIPPLPWYRATIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2971 - protein, 599 aa, Fragaria vesca
MAKTMAVGGGGVPVIFIIAFLILCGAADLVSSDASNHRYKEGDVVPLYANKVGPFHNPSETYRYFDLPFCSPDAVKEKKEALGEVLNGDRLVSAPYKLEFLKHKDSEQVCKKSLTKEEVAKFRSAVNKDYYFQMYYDDLPIWGFIGKVDKENKDPSEYKTYLYKHIHFDILYNKDRVIEINVQTDPHALVDLTEDKEVDVEFLYTVKWRETNTPFDKRMDKYSHSSSLPHHLEIHWFSIINSCVTVLLLTGFLATILMRVLKNDFVKYAHDEEAAEDQEETGWKYIHGDVFRFPKHKSLFAAALGSGTQLFTLTIFIFILALVGVFYPYNRGALFTALVVIYALTSGIAGYTATSFYCQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRATVPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGSVGFRAALLFVRHIYRSIKCE

SEQ ID NO: 2972 - protein, 594 aa, Theobroma cacao
MKNLGNCPTFLILGVLFFCCLSHVRSDASDHRYKDGDPVPLYANKVGPFHNPSETYRYFDLPFCSPDHLKEKKEALGEVLNGDRLVNAPYKLNFREERDSYVVCKTKLSKDEVAIFRKAVDKDYYFQMYYDDLPIWGFIGKVDKEGKADPSEYKYFLYKHIQFDILYNKDRVIEISARMDPHSLVDLTEDKEVDAEFMYTVKWKETETPFEKRMDKYSMSSSLPHHLEIHWFSIINSCVTVLLLTGFLATILMRVLKNDFIKYGQDEEAADDQEETGWKYIHGDVFRFPKFKSLFAAALGSGTQLFTLTVFIFMLALVGVFYPYNRGALFTALVVIYALTSGIAGYTATSFYCQLEGKNWVRNLLLTGCLFCGPLFLTFCFLNTVAIAYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLLFVRHIYRSIKCE

SEQ ID NO: 2973 - protein, 591 aa, Euonymus alatus
MVEKMVAMLFVAVLMLMAADQVRSDASNHRYKEGDQVPLYANKVGPFHNPSETYRYYDLPFCLPDDLKEKSEALGEVLNGDRLVSAPYKLDFLREKDSERVCKKKITKEEVFQFRSAVKKDYYFQMFYDDLPIWGFIGRVDKEGKDPSDYKYYLFKHIHFDISYNKDRVIEINVRTDTNAVADLTEDKEIDVEFYYTVKWKETNIPFEKRMDKYSQSSSLPHHLEIHWFSIINSCVTVLLLTGFLATILMRVLKNDFVKYAHDEESAEDQEESGWKYIHGDVFRYPKYKSLFAAALGSGTQLFTLTIFIFVLALVGVFYPYNRGALFTALVVIYALTSGIAGYTAISFYCQLEGTNWVRNLLLTGCLFCGPLFLTFCFLNTVAIAYTATAALPFGTIVVIVLIWTLVTSPLLVLGGIAGKNSKAEFQAPCRTAKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLLFVRHIYRSIKCE

SEQ ID NO: 2974 - protein, 591 aa, Euonymus alatus
MADTMVATLFVAVLMLMAADQVRSDASNHRYKEGDQVPLYANKVGPFHNPSETYRYYDLPFCLPDDFKEKSEAFGEVLNGDRLVSAPYQLDFLREKESERVCKKTLTKEQVSQFRSAVKKDYYFQMFYDDLPIWGFIGRVDKEGKDPSDYKYYLFKHIYFDIFYNKDRVIEINVRTDTNAVADLTEDKEVDVEFYYTVKWKETNTPFEKRMDKYSQSSSLPHHLEIHWFSIINSCVTVLLLTGFLATILMRVLKNDFVKYATDEESAEDQEETGWKYIHGDVFRYPKYKSLFAAALGSGTQLFTLMIFIFILALVGVFYPYNRGALFTALVVVYALTSGIAGYTATSFYCQLEGTNWVRNLLLTGCLFCGPLFLTFCFLNTVAIAYTATAALPFGTIVVIVLIWTLVTSPLLVLGGIAGKNSKTEFQAPCRTTKYPREIPLLPWYRGTIPQMAMAGFLPFSAIYIELYYIFASVWGHRIYTIYSILFIVFIILLIVTAFITVALTYFQLAAEDHDWWWRSFLCGGSTGLFIYAYCLYYYHARSDMSGFMQTSFFFGYMACICYGFFLMLGTVGFRAALLFVRHIYRSVKCE

SEQ ID NO: 2975 - protein, 591 aa, Castanea mollissima
MEKSVAVVVLLMVLLGADQVRSSASDHRYKEGEAVPLYANKVGPFHNPSETYRYFDLPFCSPENVKEKKEALGEVLNGDRLVSAPYKLDFRIEKDSELVCKKTLSKEEVARFRDAVNKDYYFQMYYDDLPLWGFIGKVEKEGRDPSDYRYSLYKHIQFNIFYNKDRVIEINVQTDARNVVDLTDDNKDSVDVDFLYTVKWKETSVPYEKRMDKYSQSSSLPHHLEIHWFSIINSCVTVLLLTGFLATILMRVLKNDFVKYAHDEETAEDQEETGWKYIHGDVFRYPKYKSIFAAALGSGTQLFTLTVFIFILALVGVFYPYNRGALFTALVVIYALTSGIAGYIATSFYCQLEGTNWVRNLMLTGCLFCGPLFLMFCFLNTVAIAYNATAALPFGTIVVIVLIWTLVTSPLLVLGGIAGKNSKAEFQAPVRTTKYPREIPTLPWYRGTIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRAALLFVRHIYRSIKCE

SEQ ID NO: 2976 - protein, 592 aa, Silene vulgaris
MEKLRATFMVAILVVVINLIGVRSDGSDHRYKAGDQVPLYANKVGPFHNPSETYRYFDLPFCSPDQVKEKREALGEVLNGDRLVSAPYKLDFLVDKDSEVICKKKLSKEEVVKFRDAVSKDYYFQMYYDDLPIWGFLGKVDKEGKLDPSEYKYYLYKHIHFDILYNKDRVIEINVRTDPNTLVDITEDKDVEVEFMYTVNWKETDTPFDKRMDKYSQSSSLPHHLEIHWFSIINSCVTVLLLTGFLATILMRVLKNDFVKYAHDEETAEDQEETGWKYIHGDVFRFPKYKSLLAASLGSGTQLFTLTVFIFLLALVGVFYPYNRGALFTALVVIYALTSGIAGYTATSFYCQLEGSNWVRNLLLTGCLFCGPLLLTFCFLNTVAIGYNATAALPFGTIVVILLIWTLVTSPLLVLGGIAGKNSKAEFQAPCRTTKYPREIPPLPWYRGSLPQMAMAGFLPFSAIYIELYYIFASVWGHRIYTIYSILFIVFIILIIVTAFITVALTYFQLAAEDHEWWWRSFLCGGSTGLFIYGYCLYYYYARSDMSGFMQTSFFFGYMACICYGFFLMLGTVGFRASLLFVRHIYRSIKCE

SEQ ID NO: 2977 - protein, 591 aa, Tripterygium wilfordii
MAEKMVAIIFVAVLMLMAADQVRSDSSNHRYKEGDQVPLYANKVGPFQNPSETYRYYDLPFCLPDDLKEKSEALGEVLNGDRLVSAPYKLDFLREKESERVCKKTLTKEQVSQFRSAVKKDYYFQMFYDDLPIWGFIGRVDKEGKDPSDYKYYLFKHIYFDIFYNKDRMIEINVRTDTNAVADLTEDKEVDVEFYYTVKWKATKTPFEKRMEKYSQSSSSPHHLEIHWFSIINSCVTVLLLTGFLATILMRVLKNDFVKYANDEESAEDQEETGWKYIHGDVFRYPKYKSLFAAALGSGTQLFTLTIFIFILALIGVFYPYNRGALFTALVVIYALTSGIAGYTATSFYCQLEGINWVRNLLLTGCLFCGPLFLTFCFLNTVAIAYNATAALPFGTIVVIVLIWTLVTSPLLVLGGIAGKNSKPEFQAPCRTTKYPREIPHLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYHARSDMSGFMQTSFFFGYMACICYGFFLMLGAVGFRAALLFVRHIYRSIKCE

SEQ ID NO: 2978 - protein, 591 aa, Quercus alba
MEKSVAVVLLLMVLFGADQVWSSASDHRYKEGEAVPLYANKVGPFHNPSETYRYFDLPFCSPENVKDKKEALGEVLNGDRLVSAPYKLDFRIEKDSEPVCKKTLSKEEVARFRDAVNKDYYFQMYYDDLPLWGFIGKVEKEGKEPSDYRYFLYKHIQFNIFYNKDRVIEINVQTDARNVVDLTDDNKDEVDVDFLYTVKWKETSVPYEKRMDKYSQSSSLPHHLEIHWFSIINSCVTVLLLTGFLATILMRVLKNDFVKYAHDEETAEDQEETGWKYIHGDVFRYPKYKSIFAAALGSGTQLFTLTVFIFVLALVGVFYPYNRGALFTALVVIYALTSGIAGYIATSFYCQLEGTNWVRNLMLTGCLFCGPLFLMFCFLNTVAIAYNATAALPFGTIVVIVLIWTLVTSPLLVLGGIAGRNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRAALLFVRHIYRSIKCE

SEQ ID NO: 2979 - protein, 466 aa, Arachis hypogaea
MYYDDLPIWGFIGKVDKEGKDPSDYKYYLYKHIHFDIYYNNDRVIEINVRTDPNALVDVTEDNEVEVEFLYTVKWKETNTPFEKRMDKYSQSSSLPHHLEIHWFSIINSCVTVLLLTGFLATILMRVLKNDFVKYAHDEEAAEDQEETGWKYIHGDVFRFPKYKSLFAAALGSGTQLFTLTVFIFILALVGVFYPYNRGALFTALVVIYALTSGIAGYTATSFYCQLEGSNWVRNLLLTGCLFCGPLFLTFCFLNTVAIVYNATAALPFGTIVVIVLIWTLVTSPLLVLGGIAGKNSKAEFQAPCRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2980 - protein, 591 aa, Vitis vinifera
MERAMAILVVAVLILLCGSQVRSDASSHRYKAGEAVPLYANKVGPFHNPSETYRYFDLPFCVPAHLKEKKEALGEVLNGDRLVSAPYKLDFLREKDSEVVCKKKLKKEEVAQFRAAVAKDYYFQMYYDDLPIWGFIGKVDKEGKADPSEYKYFLYKHIQFDIRYNKDRVIEINARTDPHSMVDVTDDKDVDVEFMYTVKWTETDAPFEKRMEKYSQTSSMPHHLEIHWFSIINSCVTVLLLTGFLATILMRVLKNDFIKYAHDEESADDQEETGWKYIHGDVFRYPKYKSLFAAALGSGTQLFTLTVFIFILALVGVFYPYNRGALFTALVVIYALTSGIAGYTATSFYCQLEGTNWVRNLLLTGCLFCAPLFLTFCFLNTVAIIYSATAALPFGTIVVIVLIWTLVTSPLLVLGGIAGKNSKAEFQAPCRTTKYPREIPALPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRASLLFVRHIYRSIKCE

SEQ ID NO: 2981 - protein, 589 aa, Euphorbia peplus
MNLHNAVTILLLSLLISHVTSDGSDHRYKDSDSVPLYANKVGPFHNPSETYRYYDLPFCIPDHLKEKKEALGEVLNGDRLVSAPYKLNFREDKDTAVVCQKKLTKEEVAKFRSAVDKDYYFQMYYDDLPIWGFIGKAEKEGKDDPSEYKYFLYKHIQFDILYNKDRVIEINTRMDPHTLLDLTEDKEVDVEFVYTVKWKETETPFEKRMEKYSLSSSLPHHLEIHWFSIINSCVTVLLLTGFLATILMRVLKNDFMRYAQDEEASDDQEETGWKYIHGDVFRFPKYKSLFAAALGSGTQLFTLTLFIFMLALVGVFYPYNRGALFTALVVIYALTSGIAGYIATSFYCQLEGKNWVRNLLLTGCLFCAPLFLTFCFLNTVAIAYSATAALPFGTIVVIVLIWTLVTSPLLVLGGIAGKNSKTEFQAPCRTTKYPREIPQLPWYRSALPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACVCYGFFLMLGTVGFHASLFFVRHIYRSIKCE

SEQ ID NO: 2982 - protein, 590 aa, Papaver somniferum
MGFFTVTTVLIIISTLAVQVRSDGSDHRYKARDPVPLYANKVGPFHNPSETYRFFDLPFCSPSHVTEKKEALGEVLNGDRLVSAPYKLDFLVEKESEVVCKKKLTKEEVIQFRNAVTKDYYFQMYYDDLPIWGFIGKVEKDSKSDPSEFKYYLYKHINFEILYNKDRVIEINVRTDPNALVDLTEDKPVDAEFMYTVKWKETATPFDKRMDKYSQSSSLPHHLEIHWFSIINSCVTVLLLTGFLATILMRVLKNDFVKYAHDEEAADDQEETGWKYIHGDVFRYPKGKSLFAAALGSGTQLFALTIFIFILALVGVFYPYNRGALFTALVVIYALTSGIAGYTATSFYCQLEGTNWVRNLLLTGCLFCGPLFLTFCFLNTVAIAYSATAALPFGTIVVIVLIWTLVTSPLLVLGGIAGKNSKSEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTIGFRASLLFVRHIYRSIKCE

SEQ ID NO: 2983 - protein, 590 aa, Solanum lycopersicum
MEKMALYVVVLLIICYASPARSDGSDHKYKSGDQVPLYANKVGPFHNPSETYRFFDLPFCTPDHVKEKKEALGEVLNGDRLVSAPYKLDFLYDKDSEIVCKKKLSKEEVSQFRSAVAKDYYFQMYYDDLPIWGFLGKVDKEGKSDPSEYKYYLFKHLHFEIFYNDDRVIEINARTDPNALVDITEDKEVDVDFMYTVKWKETKTPFDKRMEKYSQSSSLPHHLEIHWFSIINSCVTVLLLTGFLATILMRVLKNDFVKYAHDEEAADDQEETGWKYIHGDVFRYPSHKSLMAAALGSGTQLFTLTIFIFLLSLVGVFYPYNRGALFTALVVIYALTSGIAGYTAASFYCQLEGTNWVRNLILTGALFCGPLFLTFCFLNSVAIAYSATAALPFGTIVVIFLIWALVTSPLLVLGGIAGKNSRAEFQAPCRTTKYPREIPPLPWYRGTLPQMAMAGFLPFSAIYIELYYIFASVWGHRIYTIYSILFIVFIILIIVTAFITVALTYFQLAAEDHEWWWRAFLCGGSTGLFIYGYCLYYYYARSDMSGFMQTSFFFGYMACICYGFFLMLGTVGFRAALFFVRHIYRSIKCE

SEQ ID NO: 2984 - protein, 590 aa, Papaver somniferum
MGFFTVTTVLIIISTLAVQVRSDGSDHRYKARDTVPLYANKVGPFHNPSETYRFFDLPFCSPSHVTEKKEALGEVLNGDRLVSAPYKLDFLVEKESEVVCKKKLTKEEVIQFRNAVTKDYYFQMYYDDLPIWGFIGKVEKDSKSDPSEFKYYLYKHINFEILYNKDRVIEINVRTDPNALVDLTEDKPVDAEFMYTVKWKETATPFDKRMDKYSQSSSLPHHLEIHWFSIINSCVTVLLLTGFLATILMRVLKNDFVKYAHDEEAADDQEETGWKYIHGDVFRYPKGKSLFAAALGSGTQLFALTIFIFILALVGVFYPYNRGALFTALVVIYALTSGIAGYTATSFYCQLEGTNWVRNLLLTGCLFCGPLFLTFCFLNTVAIAYSATAALPFGTIVVIVLIWTLVTSPLLVLGGIAGKNSKSEFQAPVRTTKYPREIPPLPWYRSTIPQMAMAGFLPFSAIYIELYYIFASVWGHRIYTIYSILFIVFIILLIVTAFITVALTYFQLAAEDHEWWWRSILCGGSTGLFIYGYCLYYYYARSDMSGFMQTSFFFGYMACICYGFFLMLGTIGFRASLLFVRHIYRSIKCE

SEQ ID NO: 2985 - protein, 249 aa, Brassica napus
MRIPTTLLLFIGALILSGAGNVRPDASDHRYKEGDSVPLYANKVGPFHNPSETYRYFDLPFCIPEGVKDKKEALGEVLNGDRLVSAPYKLNFRDEKDSETYCKKKLSREEVEQFRRAVEKDYYFQMYYDDLPIWGFIGKVDKDGKPDPSEFKYFLYKHIQFEILYNEDRVIEINARMDPHSLVDVTEDKEVDAEFMYTVKWKETETPFEKRMDKYAMSSSLPHHLEIHWFSIINSCVTVLLLTGFLAQS

SEQ ID NO: 2986 - protein, 592 aa, Elaeis guineensis
MGKKAMSPAAVAALLLFLGIAGVVSDASDHRYKPEDPVPLYANKVGPFQNPSETYRYFDLPFCTPEHVTEKKEDLGEVLNGDRLVVAPYKLDFRVDQDSQVVCKKQLTKEDVAKFRNAVIKDYYFQMYYDDLPIWGFIGKVDKEGRDPSEYKYFLYKHIHFDILYNNDRVIEINVHTDPNALVDVTEDRDIEVEFLYSVKWKETTTPFSKRMDKYSQSSSLPHHLEIHWFSIINSCVTVLLLTGFLATILMRVLKNDFVKYAHDEESADDQEETGWKYIHGDVFRFPKNKSLFAACLGSGTQLFALTVFIFILALVGVFYPYNRGALFTALVVIYALTSGVAGYTATSFYFQLEGTNWVRNLLLTGCLFCGPLFLMFCFLNTVAIVYSATAALPFGTIVVIALIWTLVTAPLLVLGGIAGKNSKTEFQAPCRTTKYPREIPPLPWYRGTIPQMAMAGFLPFSAIYIELYYIFASVWGHRIYTIYSILFIVFIILLVVTAFITIALTYFQLAAEDHEWWWRAFLCGGSTGLFIYGYCLYYYYARSDMSGFMQTSFFFGYMACICYGFFLMLGMVGFRAALLFVRHIYRSIKCE

SEQ ID NO: 2987 - protein, 592 aa, Arabidopsis lyrata
MRLPTSLLLFIGALIFSGAGNVRSDASDHRYKDGDSVPLYANKVGPFHNPSETYRYFDLPFCIPDGVKDKKEALGEVLNGDRLVSAPYKLNFREEKDSDVYCRKKLSREQVEQFRRAVEKDYYFQMYYDDLPIWGFIGKVDKESKSDPSEFKYFLYKHIQFEILYNKDRVIEINARMDPHSLVDLTEDKEVDAEFMYTVKWKETETPFEKRMDKYAMSSSLPHHLEIHWFSIINSCVTVLLLTGFLATILMRVLKNDFMKYAQDEEAADDQEETGWKYIHGDVFRFPKHKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIVVIVLIWTLVTSPLLVLGGIAGKNSKAEFQAPVRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2988 - protein, 591 aa, Manihot esculenta
MKIPSAILLLALLVSFSVTHVKSDASDHRYKDGDSVPLYANKVGPFHNPSETYRYFDLPFCVPEHLKEKTEALGEVLNGDRLVSAPYKLNFRDEKDTAVVCRKKLTKEEVAQFRSAVDKDYYFQMYYDDLPIWGFIGKVDKEGKADPSEYKYFLYKHIQFDVLYNKDRVIEVSTRMDPHSLLDLTEDKGVNAEFLYTVKWKETDTPFEKRMEKYSLSSSLPHHLEIHWFSIINSCVTVLLLTGFLATILMRVLKNDFMKYAQDEEAADDQEETGWKYIHGDVFRYPKYKSLFAAALGSGTQLFTLTVFIFMLALVGVFYPYNRGALFTALVVIYALTSGIAGYTATSLYCQLEGKNWVRNLLLTGCLFCGPLFLTFCFLNTVAIIYSATAALPFGTIVVIVLIWTLVTSPLLVLGGIAGKNSKAEFQAPCRTTKYPREIPILPWYRSALPQMAMAGFLPFSAIYIELYYIFASVWGHRIYTIYSILFIVFIILLVVTAFITVALTYFQLAAEDHEWWWRSFLCGGSTGLFIYAYCLYYYYARSDMSGFMQTSFFFGYMACICYGFFLMLGTVGFRASLLFVRHIYRSIKCE

SEQ ID NO: 2989 - protein, 591 aa, Medicago truncatula
MGSSSVIWIHLLISLLAATHVRSDASDHRYSDGDAVPLYANKVGPFHNPSETYRYLDLPFCVTGHEKEKTEALGEVLNGDRLVSAPYELKFKKEKDSTVVCKKTLTREQVNQFREAVKKDYYFQMYYDDLPIWGFIGTVDKEGKADPSEYKYFLYKHIQFDVLYNKDRVIEISARMDPHSVVDLTEDREVDVEFMYTVKWKETDIPFEKRMEKYSQSSSLPHHLEIHWFSIINSCVTVLLLTGFLATILMRVLKNDFMKYAQDEEAADDQEETGWKYIHGDVFRFPKFKSIFAAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTICVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 2990 - protein, 592 aa, Arabidopsis thaliana
MRLPTTLLLFIGALIFSGAGTVRSDASDHRYKDGDSVPLYANKVGPFHNPSETYRYFDLPFCIPEGVKDKKEALGEVLNGDRLVSAPYKLNFRDEKDSEVYCKKKLSREEVEHFRRAVEKDYYFQMYYDDLPIWGFIGKVDKESKSDPSEFKYFLYKHIQFEILYNKDRVIEINARMDPHSLVDLTEDKEVDAEFMYTVKWKETETSFEKRMDKYAMSSSLPHHLEIHWFSIINSCVTVLLLTGFLATILMRVLKNDFMKYAQDEEAADDQEETGWKYIHGDVFRFPKNKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIIVIVLIWTLVTSPLLVLGGIAGKNSKAEFQAPVRTTKYPREIPPLPWYRSAVPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2991 - protein, 592 aa, Eutrema parvulum
MKIPTTLLLFIGALIFSGAGNVRSDASDHRYKEGDSVPLYANKVGPFHNPSETYRYFDLPFCVPEGVKDKKEALGEVLNGDRLVSAPYKLSFRDEKDSETYCKKKLSREEVEQFRRAVEKDYYFQMYYDDLPIWGFIGKVDKESKADPSEFKYFLYKHIQFEILYNKDRVIEINARMDPHSLVDLTEDKEVDAEFMYTVKWKETETSFEKRMDKYAMSSSLPHHLEIHWFSIINSCVTVLLLTGFLATILMRVLKNDFMKYAQDEEAADDQEETGWKYIHGDVFRFPKYKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2992 - protein, 592 aa, Brassica napus
MSTPTTLLLFLGALLFSAAGIVRSDASDHRYKEGDSVPLYANKVGPFHNPSETYRYFDLPFCVPEGVKDKKEALGEVLNGDRLVSAPYKLNFRDEKDSETYCKKKLSREEVEQFRRAVEKDYYFQMYYDDLPIWGFIGKVEKEGKSDPTEFKYFLYKHIQFEILYNNDRVIEINARMDPHSLVDVTEDKEVDAEFMYTVKWKETETPFEKRMDKYAMSSSLPHHLEIHWFSIINSCVTVLLLTGFLATILMRVLKNDFMKYAQDEEAADDQEETGWKYIHGDVFRFPKHKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIVVIVLIWTLVTSPLLVLGGIAGKNSKAEFQAPVRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2993 - protein, 295 aa, Brassica napus
MTKLLLLLGAIILSSVGYVRSDASDHRYKEGDIVPLYANKVGPFHNPSETYRYFDLPFCVPEGVKEKKEALGEVLNGDRLVSAPYKLNFREEKDSEVYCKKKLSKEEVRKFRQAVEKDYYFQMYYDDLPIWGFIGKVDKEIKSDPSEYKYFLYKHIEFEILYNNDRVIEISARMDPHSLVDLTEDKEVDAEFMYTVKWKETETPFEKRMDKYSMSSSLPHHLEIHWFSIINSCVTVLLLTGFLATILMRVLKNDFTKYAQDEEAADDLEETGWKYIHGDVFRFPTRNSLFAAFAW

SEQ ID NO: 2994 - protein, 588 aa, Brassica napus
TTLLLFVGALIFFAAGNVRSDASDHRYKEGDSVPLYANKVGPFHNPSETYRYFDLPFCVPEGVKDKKEAFGEVLNGDRLVSAPYKLSFRDEKDSETYCKKKLSRKEVEQFRRAVEKDYYFQMYYDDLPIWGFIGKVDKESKSDPSEFKYFLYKHIQFEILYNNDRVIEINARMDPHSLVDLTEDKEVVAEFMYTVKWKETETPFEKRMDKYAMSSSLPHHLEIHWFSIINSCVTVLLLTGFLATILMRVLKNDFMKYAQDEEAADDQEETGWKYIHGDVFRFPKHKSLFAASLGSGTQLFTLTIFIFMLSLVGVFYPYNRGALFTALVVIYALTSGIAGYTASSFYCQLEGKNWVRNLLLTGGLFCGPLFLTFCFLNTVAIAYSATAALPFGTIVVIVLIWTLVTSPLLVLGGIAGKNSKAEFQAPVRTTKYPREIPPLPWYRSAVPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2995 - protein, 589 aa, Brassica napus
MTKLLLLLGALILSSVGYVRSDASDHRYKEGDIVPLYANKVGPFHNPSETYRYFDLPFCVPEGVKEKKEALGEVLNGDRLVSAPYKLNFREEKDSEVYCKKKLSKEEVRKFRQAVEKDYYFQMYYDDLPIWGFIGKVDKEIKSDPSEYKYFLYKHIEFEILYNNDRVIEISARMDPHSLVDLTEDKEVDAEFMYTVKWKETETPFEKRMDKYSMSSSLPHHLEIHWFSIINSCVTVLLLTGFLATILMRVLKNDFTKYAQDEEAADDLEETGWKYIHGDVFRFPTRNSLFAASLGSGTQLFTLTIFIFMLALVGVFYPYNRGALFTALVVIYALTSGIAGYTSASFYCQLEGKSWVRNLLLTGCLFCGPLLLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALFFVRHIYRSIKCE

SEQ ID NO: 2996 - protein, 591 aa, Humulus lupulus
MEDSLKFLVLALLISCCATHVSSDGSDHRYKDNDVVPLYANKVGPFHNPSETYRYFDLPFCSGGDVKEKKEALGEVLNGDRLVSAPYKLEFRKEKESEVACSKKLSKEDVAKFREAVKKDYYFQMYYDDLPIWGFIGKVDKDVKTDPSEVKYSLYKHIHFDILYNKDRVIEISAKTDPSSVVDLTEDKEADADFTYTVKWKETEIPFEKRMDKYSQSSSLPHHLEIHWFSIINSCVTVLLLTGFLATILMRVLKNDFMKYAQDEEAADDQEETGWKYIHGDVFRFPKHKSVFAAALGSGTQLFTLTIFIFMLALVGVFYPYNRGALFTALVVIYALTSGIAGYTATAFYCQLEGTNWVRNLLLTGCLFCGPLFFTFCFLNTVAIAYSATAALPFGTIVVIVLIWTLVTSPLLVLGGIAGKNSKAEFQAPCRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGMVGFRAALLFVRHIYRSIKCE

SEQ ID NO: 2997 - protein, 592 aa, Eutrema halophilum
MKIPTTLLLLVGALIFSGAGNVRSDASDHRYKEGDSVPLYANKVGPFHNPSETYRYFDLPFCVPEGVKDKKEALGEVLNGDRLVSAPYKLNFRDEKDSEIYCKKKLSREEVEQFRRAVEKDYYFQMYYDDLPIWGFIGKVDKESKSDPSEFKYFLYKHIQFEILYNKDRVIEINARMDPHSLVDLTEDKEVDAEFMYTVKWKETETPFDKRMEKYAMSSSLPHHLEIHWFSIINSCVTVLLLTGFLATILMRVLKNDFMKYAQDEEAADDQEETGWKYIHGDVFRFPKHKSLFAASLGSGTQLFTLTIFIFMLSLVGVFYPYNRGALFTALVVIYALTSGIAGYTASSFYCQLEGKNWVRNLLLTGCLFCGPLFLTFCFLNTVAIAYSATAALPFGTIVVIVLIWTLVTSPLLVLGGIAGKNSKAEFQAPVRTTKYPREIPPLPWYRSAVPQMAMAGFLPFSAIYIELYYIFASVWGHRIYTIYSILFIVFIILIIVTAFITVALTYFQLAAEDHEWWWRSFLCGGSTGLFIYAYCLYYYYARSDMSGFMQTSFFFGYMACICYGFFLMLGTVGFRAALLFVRHIYRSIKCE

SEQ ID NO: 2998 - protein, 589 aa, Brassica rapa
MTKLLLLLGAIILSSVGYVRSDASDHRYKEGDIVPLYANKVGPFHNPSETYRYFDLPFCVPEGVKEKKEALGEVLNGDRLVSAPYKLNFREEKDSEVYCKKKLSKEEVRKFRQAVEKDYYFQMYYDDLPIWGFIGKVDKEIKSDPSEYKYFLYKHIEFEILYNNDRVIEISARMDPHSLVDLTEDKEVDAEFMYTVKWKETETPFEKRMDKYSMSSSLPHHLEIHWFSIINSCVTVLLLTGFLATILMRVLKNDFTKYAQDEEAADDLEETGWKYIHGDVFRFPTRNSLFAASLGSGTQLFTLTIFIFMLALVGVFYPYNRGALFTALVVIYALTSGIAGYTSASFYCQLEGKSWVRNLLLTGCLFCGPLLLTFCFLNTVAITYTATAALPFGTIVVIVLIWTLVTSPLLVLGGIAGKNSKAEFQAPCRTTKYPREIPPLPWYRSAVPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALFFVRHIYRSIKCE

SEQ ID NO: 2999 - protein, 592 aa, Elaeis guineensis
MRKKAMAPAAVAALLLCFGIAGVVSSASDHRYKPEDPVPLYANKVGPFQNPSETYRYFDLPFCTPEHVTEKKEDLGEVLNGDRLVVAPYKLDFHVNQDSKVVCKKQLTKEDVAKFRNAVIKDYYFQMYYDDLPIWGFIGKVDKEGKDPSEYKYFLYKHIHFDILYNDDRVVEINVHTDPNALVDVTEDGDIEVEFLYSATWKETTTPFEKRMDKYSQSSSLPHHLEIHWFSIINSCITVLLLTGFLATILMRVLKNDFVKYAHDEESADDQEETGWKYIHGDVFRFPKNKSLFSACLGSGTQLFALTVFIFILALVGVFYPYNRGALFTALVVIYALTSGIAGYTATSFYRQLEGTNWVRNLLLTGCLFCGPLFLTFCFLNTVAIVYSATAALPFGTIIVIVLIWTLVTAPLLVLGGIAGKNSKTEFQAPCRTTKYPREIPPLPWYRETIPQMAMAGFLPFSAIYIELYYIFASVWGHRIYTIYSILFVVFIILLIVTAFITVALTYFQLAAEDHEWWWRSFLCGGSTGLFVYGYCLYYYHARSDMSGFMQTSFFFGYMACICYGFFLMLGMVGFRAALLFVRHIYRSIKCE

SEQ ID NO: 3000 - protein, 592 aa, Lotus japonicus
MGRSKWSTLLFFVLAILHGTHVRSDASDHRYKDGDLVPLYANKVGPFHNPSETYRYLDLPFCVTGKEREKTEALGEVLNGDRLVSAPYELDFRKEKDSNVVCKKKLTKAQVAQFREAVKKDYYFQMYYDDLPIWGFIGTVDKEGKTDPSEYKYFLYKHIQFDVLYNKDRVIEISARMDPHSVVDLTEDKEVDVEFMYTVKWKETDTSFEKRMDKYSQSSSLPHHLEIHWFSIINSCVTVLLLTGFLATILMRVLKNDFMKYAQDEEAADDQEETGWKYIHGDVFRFPKYKSLFAAALGSGSQLFTLTIFIFMLALVGVFYPYNRGALFTALVVIYALTSGIAGYTATSFYIQLEGSNWVRNLLLTGCLFCGPLFLMFCFLNTVAIAYSATAALPFGTILVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGAVGFRASLLFVRHIYRSIKCE

SEQ ID NO: 3001 - protein, 589 aa, Citrullus lanatus
MKNSLIFTLFWIAICATHVAPDASDHRYSEGDPVPLYANKVGPFHNPSETYRYFDLPFCSPGDVKEKKEALGEVLNGDRLVSAPYKLDFRREKDTEVACKSKLSKEEVAQFRAAVKKDYYFQMYYDDLPIWGFIGKVDREGRDDPSEYKYFLFKHIQFDISYNKDRVIEISARMDPHSVVDLTEDKDVDVEFMYTVKWRETDTPFEKRMDKYSQSSSLPHHLEIHWFSIINSCVTVLLLTGFLATILMRVLKNDFMKYAQDEEAADDQEETGWKYIHGDVFRFPKYKSLFAAALGSGTQLFTLTIFIFMLALVGVFYPYNRGALFTALVVIYALTSGIAGYTAASFYCQLEGTNWVRNLLLTGCLFCGPLFVTFCFLNTVAIVYNATAALPFGTIVVIVLIWTLVTSPLLVLGGIAGKNSRIEFQAPCRTTKYPREIPQLPWYRSTVPQMAMAGFLPFSAIYIELYYIFASVWGHKIYTIYSILFIVFIILLIVTAFITVALTYFQLTAEDHEWWWRSFLCGGSTGLFIYGYCLYYYYARSDMSGFMQTSFFFGYMACICYGFFLMLGTVGFRAALFFVRHIYRSIKCE

SEQ ID NO: 3002 - protein, 592 aa, Eschscholzia californica
MERTMAFFPILTLLLSFFIIGTRSNGSDHRYNPKDLVPLYANKVGPFHNPSETYRFFDLPFCSPTEVTEKKEALGEILNGDRLVSAPYKIDFLVDKDSEIVCKKKLSTEEVIKFRDAVTKDYYFQMYYDDLPIWGFIGKIDKNGRSDPSEYKYYLYKHINFEVLYNKDRVIEINVRTDPSALVDLTEDKPVDAEFMYTVKWKETTIPFEKRMEKYSQSSSLPHHLEIHWFSIINSCVTVLLLTGFLATILMRVLKNDFVKYGHDEESADDQEETGWKYIHGDVFRYPKGKSLFAAALGSGTQLFALTIFIFILALVGVFYPYNRGALFTALVVIYALTSGIAGYTATSFYCQLEGTNWVRNLLLTGCLFCGPLLLAFCFLNTVAIAYSATAALPFGTIVVIVLIWTLVTSPLLVLGGIAGKNSKAEFQAPVRTTKYPREIPSMPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTIGFRASLFFVRHIYRSIKCE

SEQ ID NO: 3003 - protein, 589 aa, Brassica rapa
MTKLLLLLGALILSSVGYVRSYASDHRYKEGDIVLLYANKVGPFHNPSETYRYFDLPFCVPEGVKEKKEALGEVLNGDRLVSAPYKLNFREEKDSEVYCKKKLSKEEVRKFRQAVEKDYYFQMYYDDLPIWGFIGKVDKEIKSDPSEYKYFLYKHIEFEILYNNDRVIEISARMDPHSLVDLTEDKEVDAEFMYTVKWKETETPFEKRMDKYSMSSSLPHHLEIHWFSIINSCVTVLLLTGFLATILMRVLKNDFTKYAQDEEAADDLEETGWKYIHGDVFRFPTRNSLFAASLGSGTQLFTLTIFIFMLALVGVFYPYNRGALFTALVVIYALTSGIAGYTSASFYCQLEGKSWVRNLLLTGCLFCGPLLLTFCFLNTVAITYTATAALPFGTIVVIVLIWTLVTSPLLVLGGIAGKNSKAEFQAPCRTTKYPREIPPLPWYRSAIPQMAIAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALFFVRHIYRSIKCE

SEQ ID NO: 3004 - protein, 592 aa, Lippia dulcis
MARGGSHVGVLLLLLCAAVPAVRSDGSDHKYKVGDPVPLYANKVGPFHNPSETYRYFDLPFCSPGDVKDKSEALGEVLNGDRLVSAPYKLDFLADKESEVICKKQLSKKEVAEFRRAVAKDYYFQMYYDDLPIWGFLGKVDKEGKADPSEYKYYLFKHLHFEIFFNKDRVIEINARTDPNALVDLTEDKEVDVEFMYSAKWKETNIAFEKRMEKYSQSSSLPRHLEIHWFSIINSCVTVLLLTGFLATILMRVLKNDFVKYAHDEETADDQEETGWKYIHGDVFRFPKYKSLFSAALGSGTQLFTLATFIFLLALVGVFYPYNRGALFTALVVIYALTSGIAGYTAASFYCQLEGSNWVRNLLLTGGLFCGPLFLTFCFLNTVAIAYHATAALPFGTIVVIFLIWALVTSPLLVLGGIAGKNSKAEFQAPCRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYAFFLMLGAVGFRAALFFVRHIYRSIKCE

SEQ ID NO: 3005 - protein, 592 aa, Eutrema parvulum
MRTPTMLLLYVGALIFSGAGYVRSDASDHRYKEGDIVPLYANKVGPFHNPSETYRYFDLPFCIPEGVKEKKEALGEVLNGDRLVSAPYKLNFKDEKESEVYCKKKLSKEEVKQFRKAVEKDYYFQMYYDDLPIWGFIGKVDKEMKSDPSEYKYFLYKHIQFEILYNKDRVIEISARMDPHSLVDLTEDKEVDAEFMYTVKWKETETAFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAVPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 3006 - protein, 592 aa, Malus domestica
MKMNLPPILLLAALIACTATHVRSDASDHRYNEGDAVPLYANKVGPFHNPSETYRYFDLPFCSAGDVKEKREALGEVLNGDRLVSAPYKLEFRKDKDSEVACRRKLTKEEVAQFRTAVKKDYYFQMYYDDLPIWGFLGKVDKEGKTDPREYKYFLYKHIQFDARYNKDRVIEITAKMDPHSVVDLTEDKDVDADFMYSVRWSDTNIPFENRMDKYSQSSSLPHHLEIHWFSIINSCVTVLLLTGFLATILMRVLKNDFMKYAQDEEAADDQEETGWKYIHGDVFRFPKNKSLFAAAHGSGTQLFTLTIFIFMLALVGVFYPYNRGALFTALVVIYALTSGIAGYTATSFYCQLEGKNWVRNLLLTGCLFCGPLFLTFCFLNTVAIVYSATAALPFGTIVVIVLIWTLVTSPLLVLGGIAGKNSKAEFQAPVRTTKYPREIPTLPWYRTTIPQMAMAGFLPFSAIYIELYYIFASVWGHRIYTIYSILFIVFIILLIVTAFITVALTYFQLAAEDHGWWWRSFLCGGSTGLFIYGYCLYYYYARSDMSGFMQTSFFFGYMACICYGFFLMLGTVGFRAALLFVRHIYKSIKCE

SEQ ID NO: 3007 - protein, 592 aa, Arabidopsis thaliana
MRTPTTILLLVGAILFSGAGYVRSDASDHRYKEGDTVPLYANKVGPFHNPSETYRYFDLPFCIPEGVKEKKEALGEVLNGDRLVSAPYKLNFRDEKESEVYCNKKLSKEEVKQFRKAVEKDYYFQMYYDDLPIWGFIGKVDKDIKSDPSEFKYFLYKHIQFEILYNKDRVIEISARMDPHSLVDLTEDKEVDAEFMYTVKWKETETPFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 3008 - protein, 591 aa, Prunus persica
MKNLSTILVLAVLITCCVTHVRSDASDHRYNDGDAVPLYANKVGPFHNPSETYRYFDLPFCSAGDVKEKREALGEVLNGDRLVSAPYKLEFRKEKDTEVACRRKLTKEEVAQFRTAVKKDYYFQMYYDDLPIWGFLGKVDKEGKTDPSEYKYFLYKHIQFEVMYNKDRVIEIGAKMDPHSVVDLTEDKDVDADFMYTVKWRETNIPFENRMDKYSQSSSLPHHLEIHWFSIINSCVTVLLLTGFLATILMRVLKNDFMKYAQDEEAADDQEETGWKYIHGDVFRFPKHKSLFAAAHGSGTQLFTLTIFIFMLALVGVFYPYNRGALFTALVVIYALTSGIAGYTATSFYCQLEGTNWVRNLLLTGCLFCGPLFLTFCFLNTVAIAYSATAALPFGTIVVIVLIWTLVTSPLLVLGGIAGKNSKAEFQAPCRTTKYPREIPPLPWYRTTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRAALLFVRHIYKSIKCE

SEQ ID NO: 3009 - protein, 588 aa, Tabernaemontana elegans
MARWQVVVFVVVSMVAVVRSDGSDHKYKAKDQVPLYANKVGPFQNPSETYRFFDLPFCFPDHAKEKKEALGEVLNGDRLVSAPYKLDFLVDKDSETVCKKKLNKDKVKQFRRAVTKDYYFQMYYDDLPVWGFVGKVDRESKSDPSEYKYYLFKHLHFEIFYNKDRVIEINARTDPSALVDITEDKDVDVEFMYSVKWKETNIPFEKRMEKYSKTSALPHHLEIHWFSIINSCVTVLLLTGFLATILMRVLKNDFVKYAHDEETADDQEETGWKYIHGDVFRYPKYKSLFAAALGCGTQLFIMATFIFILALVGVFYPYNRGALFTALVVIYALTSGIAGYTAASFYCQLEGTNWVRNVLLTGALFCGPLFLTFCFLNTVAIAYNATAALPFGTIVVIFLIWALVTSPLLVLGGVAGKNAKAEFQAPCRTTKYPREIPPLPWYRSTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRAALFFVRHIYRSIKCE

SEQ ID NO: 3010 - protein, 592 aa, Eutrema halophilum
MRTPTLLLLFVGALIFSGAGYVRSDASDHRYKEGDTVPLYANKVGPFHNPSETYRYFDLPFCVPEGVKEKKEALGEVLNGDRLVSAPYKLNFRDEKESEVYCKKKLSKEEVKQFRKAVEKDYYFQMYYDDLPIWGFIGKVDKDIKSDPSEYKYFLYKHIQFEILYNKDRVIEISARMDPHSLVDLTEDKEVDAEFMYTVKWKETETPFEKRMEKYSMSSSLPHHLEIHWFSIINSCVTVLLLTGFLATILMRVLKNDFMKYAQDEEAADDQEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLFLTFCFLNTVAITYTATAALPFGTIVVIVLIWTLVTSPLLVLGGIAGKNSKAEFQAPCRTTKYPREIPPLPWYRSAVPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALLFVRHIYRSIKCE

SEQ ID NO: 3011 - protein, 598 aa, Solanum phureja
MCTKFVKEMEKMALYVVVLLIICYASPARSDGSDHKYKSGDQVPLYANKVGPFHNPSETYRFFDLPFCTPDHVKEKKEALGEVLNGDRLVSAPYKLDFLYDKDSEIVCKKKLSKEEVSQFRSAVAKDYYFQMYYDDLPIWGFLGKVDKEGKSDPSEYKYYLFKHLHFEIFYNDDRVIEINARTDPNALVDITEDKEVDVDFMYSVKWKETKTPFDKRMEKYSQSSSLPHHLEIHWFSIINSCVTVLLLTGFLATILMRVLKNDFVKYAHDEEAVDDQEETGWKYIHGDVFRYPSHKSLMAAALGSGTQLFTLTIFIFLLSLVGVFYPYNRGALFTALVVIYALTSGIAGYTAASFYCQLEGTNWVRNLILTGALFCGPLFLTFCFLNSVAIAYSATAALPFGTIVVIFLIWALVTSPLLVLGGIAGKNSRAEFQAPCRTTKYPREIPPLPWYRGTLPQMAMAGFLPFSAIYIELYYIFASVWGHRIYTIYSILFIVFIILIIVTAFITVALTYFQLAAEDHEWWWRAFLCGGSTGLFIYGYCLYYYYARSDMSGFMQTSFFFGYMACICYGFFLMLGTVGFRAALFFVRHIYRSIKCE

SEQ ID NO: 3012 - protein, 591 aa, Triphysaria pusilla
MARGEWPFVVLLLLCIAIPAVRSDGSDHKYKIGDSVPLYANKVGPFHNPSETYRYFDLPFCSPGNVKDKSEALGEVLNGDRLVSAPYKLDFLVDKELEVICKRQLSKKDVAEFRSAVAKDYYFQMYYDDLPIWGFLGKVDKEGKVDPSEYKYYLFKHLHFEIFYNKDRVIEINARTDPSALVDLTDGKEVDVEFMYSAKWKETNIAFDKRMEKYSHSSSLPRHLEIHWFSIINSCVTVLLLTGFLATILMRVLKNDFVKYAHDEETADDQEETGWKYIHGDVFRFPKYKSLFSAALGSGTQLFTLATFIFLLALVGVFYPYNRGALFTALVVIYALTSGIAGYTAASFYCQLEGTNWVRNLLLTGGLFCGPLFLTFCFLNTVAIAYHATAALPFGTIVVIFLIWALVTSPLLVLGGIAGKNSKAEFQAPCRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACVCYAFFLMLGAVGFRAALFFVRHIYRSIKCE

SEQ ID NO: 3013 - protein, 593 aa, Artemisia annua
MKMSVIRWSLVVLTLFYLTTTSTVRSDASDHKYKSGDEVPIYANKVGPFHNPSETYRFFDLPFCLPAHLKEKPEALGEVLNGDRLVSAPYKLDFMVEKDSEIVCRKTLTKAEVAKFRSAVTKDYYFQMYYDDLPFWGFLGKVEKDKTDPSEEKYYLFKHLHFEILYNKDRVIEINAKADPNAVVDLTEDKEVEVEFMYTVRWKETTIPFESRMEKYSQSSSQPHHLEIHWFSIINSCVTVLLLTGFLATILMRVLKNDFVKYAHDEEAADDQEETGWKYIHGDVFRYPKYKSLFAAALGSGTQLFALALFIFILALVGVFYPYNRGALFTALVVIYALTSGIAGYTAASFYHQLEGTNWVRNLLLTGCLFCGPLFLTFCFLNTVAIAYTATAALPFGTIVVIVLIWSLVTSPLLVLGGIAGKNSKAEFQAPVRTTKYPREIPPLPWYRKTVPQMAMAGFLPFSAIYIELYYIFASVWGHRIYTIYSILFIVFIILLIVTAFITVALTYFQLAAEDHEWWWRSFLCGGSTGVFIYGYCLYYYYERSDMSGFMQTSFFFGYMACICYGFFLMLGMVGFRAALFFVRHIYRSIKCE

SEQ ID NO: 3014 - protein, 589 aa, Helianthus annuus
MSVIRWLTVALLLAFCTNKVQSDASDHKYKPADEVPIYANKVGPFHNPSETYRYYDLPFCLPARLKEKPEALGEVLNGDRLVSAPYKLDFMVEKDSEIVCKKTLTKDEVSKFRKAVTKDYYFQMYYDDLPFWGFLGKVEKDKNDPSEEKYYLFKHIHFEIHYNKDRVIEINAKADPSAVVDLTEDKEVEVEFMYTVRWKETNVPYESRMEKYSQSSSQPHHLEIHWFSIINSCVTVLLLTGFLATILMRVLKNDFVKYAHDEEAADDQEETGWKYIHGDVFRYPKYKSLFAAALGSGTQLFALALFIFILALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTVPQMAMAGFLPFSAIYIELYYIFASVWGHRIYTIYSILFIVFIILLIVTAFITVALTYFQLAAEDHEWWWRSFLCGGSTGVFIYGYCLYYYYERSDMSGFMQTSFFFGYMACICYGFFLMLGTVGFRAALFFVRHIYRSIKCE

SEQ ID NO: 3015 - protein, 371 aa, Elaeis guineensis
FGIAGVAADASDHRYKAGEPVPLYANKVGPFHNPSETYRYFDLPFCSPEHVKEKSEALGEVLNGDRLVDAPYKLDFRVDLDSKVVCTKKLKSEEVAQFRSAVLKDYYFQMYYDDLPIWGFIGKVDREGKTDENEYKYYLYRHIHFDVLYNGDRVIEINAHTDPNALVDVTKDREIEVEFLYSVKWRETSTPFENRMDKYSQTSSLPHHLEIHWFSIINSCVTVLLLTGFLATILMRVLKNDFVKYAHDEESAEDQEETGWKYIHGDVFRFPKHKSLFAACVGSGTQLFALTIFIFILALVGVFYPYNRGALFTALVVIYALTSGIAGYISTSFYFQLEGTNWVRNLLMTGCLFLRASVPDILLFEHCGHYL

SEQ ID NO: 3016 - protein, 591 aa, Malus domestica
MKNLLTALPLAVLIACTATLVRSDASDHRYNEGDAVPLYANKVGPFHNPSETYRYFDLPFCSAGDVKEKREALGEVLNGDRLVSAPYNLEFRKDKDSEVACRRMLTKEEVAQFRTAVKKDYYFQMYYDDLPIWGFLGKVDKEGKTDPREYKYFLYKHIQFDARYNKDRVIEITAKMDPHSVVDLTEDKDVDADFMYSVKWADTNIPFENRMDKYSQSSSLPHHLEIHWFSIINSCVTVLLLTGFLATILMRVLKNDFMKYAQDEEAADDQEETGWKYIHGDVFRFPQHKSLFAAAHGSGTQLFTLTIFIFMLALVGVFYPYNRGALFTALVVIYALTSGIAGYTATSFYCQLEGKNWVRNLLLTGCLFCGPLFLTFCFLNTVAIAYSATAALPFGTIVVIVLIWTLVTSPLLVLGGIAGKNSKAEFQAPVRTTKYPREIPPLPWYRTTIPQMAMAGFLPFSAIYIELYYIFASVWGHRIYTIYSILFIVFIILLIVTAFITVALTYFQLAAEDHWWWWRSFLCGGSTGLFIYGYCLYYYYARSDMTGFMQTSFFFGYMACICYGFFLMLGTVGFRAALLFVRHIYKSIKCE

SEQ ID NO: 3017 - protein, 592 aa, Solanum phureja
MEKKMTSYVVVLIALCCCVTPARSDGSDHKYKAGDQVTMYANKVGPFHNPSETYRFFDLPFCAPAHVTEKKEALGEVLNGDRLVSAPYKLDFMYDKDSEIVCKKKLSKEEVSQFRSAVAKDYYFQMYYDDLPIWGFLGKVDKEGKTDPSKYKYYLFKHLHFEIFYNNDRVVEINARTDPNALVDITEDKEVDVDFVYSVKWKESTTPFEKRMEKYSQSSSLPHHLEIHWFSIINSCVTVLLLTGFLATILMRVLKNDFVKYAHDEEAADDQEETGWKYIHGDVFRYPKYKSLLAAALGSGTQLFTMTIFIFILALVGVFYPYNRGALFTALVVIYALTSGIAGYTASAFYCQLEGTNWVRNLILTGALFCGPLFLTFCFLNSVAISYTATAALPFGTIVVIFLIWALVTSPLLVLGGIAGKNSKSEFQAPCRTTKYPREIPPSPWYRGTMPQMAMAGFLPFSAIYIELYYIFASVWGHRIYTIYSILFIVFIILLIVTAFITVALTYFQLAAEDHEWWWRAFLCGGSTGLFIYGYCLYYYYARSDMTGFMQTSFFFGYMACICYGFFLMLGSVGFRAALFFVRHIYRSIKCE

SEQ ID NO: 3018 - protein, 592 aa, Fragaria vesca
MKNLSTILLLTVLITCSATTTVRSDASDHRYNENDVVPLYANKVGPFHNPSETYRYFDLPFCSPGDVKEKKEALGEVLNGDRLVSAPYKLEFRKEKDTEVACRRKLTKEEVAEFRKAVEKDYYFQMYYDDLPIWGFLGKVDKEGKTDPSEYKYFLYKHIQFEILYNKDRVIEIGAKMDPHSVVDLTEDKDVDADFMYTVKWRETNIPFENRMDKYSQSSSLPHHLEIHWFSIINSCVTVLLLTGFLATILMRVLKNDFMKYAQDEEAADDQEETGWKYIHGDVFRFPKYKSLFSAAHGSGTQLFTLTVFIFMLALVGVFYPYNRGALFTALVVIYALTSGIAGYTSTAFYCQLEGTNWVRNLLLTGCLFCGPLFLTFCFLNTVAIAYSATAALPFGTIVVIVLIWTLVTAPLLVLGGIAGKNSKAEFHAPCRTTKYPREIPTLPWYRTTVPQMAMAGFLPFSAIYIELYYIFASVWGHRIYTIYSILFIVFLILLIVTAFITVALTYFQLAAEDHEWWWRSFLCGGSTGLFIYGYCLYYYYARSDMSGFMQTSFFFGYMACICYGFFLMLGTVGFRAALFFVRHIYKSIKCE

SEQ ID NO: 3019 - protein, 596 aa, Solanum phureja
MVRKSSMGCGNYVVVLVLLFFGAMKVRSDSSDHKYKSGEEVPLYANKVGPFHNPSETYRYFDLPFCSPGHVKDKTEALGEVLNGDRLVTAPYKLDFTNDRETEVVCKKTLSKEEVARFRDAVAKDYYFQMFYDDLPIWGFIGKVDKEGKADPSEYKYYLFKHLHFDIHHNKDRVIEVNARTDPNALVDITEDKEIDVDFMYSVKWKETHIPFEKRMEKYSQTSALPHHLEIHWFSIINSCVTVLLLTGFLATILMRVLKNDFVKYAHDEEAADDQEETGWKYIHGDVFRYPKQKSLFAAALGSGTQLFTLAIFIFILALVGVFYPYNRGALFTALVVIYALTSGIAGYTAASFYCQLEGKNWVRNLLLTGGLFCGPLLLTFCFLNSVAIGYHATAALPFGTIVVIFLIWALVTSPLLVLGGIAGKNSKAEFQAPTRTTKYPREIPQLPWYRGALPQMAMAGFLPFSAIYIELYYIFASVWGHRIYTIYSILFIVFIILIIVTAFITVALTYFQLAAEDHEWWWRSFVCGGSTGLFIYGYCLYYYYARSDMSGFMQTSFFFGYMACICYAFFLMLGTVGFRAALFFVRHIYRSIKCE

SEQ ID NO: 3020 - protein, 596 aa, Solanum lycopersicum
MARKSRMGCGNYAVVLVLLFFGAMKVRSDSSDHKYKSGEEVPLYANKVGPFHNPSETYRYFDLPFCSPGHVKDKTEALGEVLNGDRLVTAPYKLDFTNDRETEVVCKKTLSKEEVARFRDAVAKDYYFQMFYDDLPIWGFIGKVDKEGKADPSEYKYYLFKHLHFDIHHNKDRVIEVNARTDPNALVDITEDKEIDVDFMYSVKWKETEIPFEKRMEKYSQTSALPHHLEIHWFSIINSCVTVLLLTGFLATILMRVLKNDFVKYAHDEEAADDQEETGWKYIHGDVFRYPKHKSLFAAALGSGTQLFTLAIFIFILALVGVFYPYNRGALFTALVVIYALTSGIAGYTAASFYCQLEGKNWVRNLLLTGGLFCGPLLLTFCFLNSVAIGYHATAALPFGTIVVIFLIWALVTSPLLVLGGIAGKNSKAEFQAPTRTTKYPREIPQLPWYRGALPQMAMAGFLPFSAIYIELYYIFASVWGHRIYTIYSILFIVFIILIIVTAFITVALTYFQLAAEDHEWWWRSFVCGGSTGLFIYGYCLYYYYARSDMSGFMQTSFFFGYMACICYAFFLMLGTVGFRAALFFVRHIYRSIKCE

SEQ ID NO: 3021 - protein, 587 aa, Musa acuminata
MDLIRVTALLLCFGVTGVVSDASDHRYKQGDPVPLYANKVGPFHNPSETYRYFDLPFCVPEHVTEKKEALGEVLNGDRLVEAPYKLDFRVDRDSEPLCKKKLTKEDVAKFRSAVTKDYYFQMYYDDLPIWGFIGKVDKERKDLSEYKYYLYRHIHFDILYNSDHVIEISVHTDPNSLADLTEDKDIEASFFYSVKWKETTTPFEKRMNKYSQTSSLPHHLEIHWFSIINSCVTVLLLTGFLATILMRVLKNDFVKYAHDEESAEDQEETGWKYIHGDVFRFPKNKSLLAACLGSGTQLFALTVFIFILALVGVFYPYNRGALFTALVVVYALTSGIAGYTASSFYCQLEGTNWVRNVLLTGFLFCGPLFLTFCFLNTVAIVYSATAALPFGTIVVIVLIWTLVTSPLLVLGGIAGKNGKTEFQAPCRTTKYPREIPLLPWYRRTIPQMAMAGFLPFSAIYIELYYIFASVWGHRIYIIYSILFIVFIILLIVTAFITVALTYFQLASEDHEWWWRSYLCGGSTGLFVYGYCFYYYFARSDMSGFMQTSFFFGYMACICYGFFLMLGMVGFRAALLFVRHIYRSIKCE

SEQ ID NO: 3022 - protein, 588 aa, Musa acuminata
MDLAAAVALLLLCFGIAGVASDASDHRYKKRDSVPLYANKVGPFHNPSETYRYFDLPFCAPEHVTEIREALGEVLNGDRLVDAPYKLNFLVDLDSKQLCKKKLTKEDVAKFRSAVTKDYYFQMYFDDLPIWGFIGKVDKEGKDLGDYKYYLYRHIHFDVLYNGDRVIEITVHTDPSALVDLTDDKEIEVDFMYSVKWKETSTPFEKRMEKYSLTYSQTHHLEIHWFSIINSCVTVLLLTGFLATILMRVLKNDFVKYAHDEESAEEQEETGWKYIHGDVFRFPKNKSLFAACLGSGTQLFALTVFIFVLALIGVFYPYNRGALFTALVVIYALTSGIAGYTATSFYCQLEGTNWVRNLLLTGCLFCGPLFLTFCFLNTVAIVYSATAALPFGTIVVIVLIWTLVTSPLLVLGGIAGKNSKNEFQAPCRTKKFPREIPPLPWYRGTLPQMAMAGFLPFSAIYIELYYIFASVWGHSIYTIYSILFIVFIILLIVTAFITIALTYFQLAAEDHEWWWRSFLCGGSTGVFVYAYCLYYYYARSDMSGFMQTSFFFGYMACICYGFFLMLGMVGFRAALLFVRHIYRSIKCE

SEQ ID NO: 3023 - protein, 589 aa, Artemisia annua
MIRWQLLVALVAVITISPQAASASSDHKYKPNDDVPIYANKVGPFHNPSETYRFYDLPFCLPDHLKEKKEALGEVLNGDRLVSAPYKLQFMVEKDSEIVCRKKLTKEEVKKFRSAVAKDYYFQMYYDDLPFWGFLGKVEKDKTDPSEEKYYLFKHLHFEIHYKKDRVIEINAKADPSAVVDLTEDKEVEVEFMYTVRWKETSIPFESRMEKYAQSSSQPHHLEIHWFSIINSCVTVLLLTGFLATILMRVLKNDFVKYAHDEEEADDQEETGWKYIHGDVFRYPKYKSLFAAALGSGTQLFSLSLFIFGLALVGVFYPYNRGALFTALVVIYALTSGIAGYTASSFYHQLEGTNWVRNLLLTGCLFCGPLFLTFCFLNTVAIAYNATAALPFGTIVVIVLIWTLVTSPLLVLGGIAGKNSKAEFQAPVRTTKYPREIPPLPWYRKTVPQMAMAGFLPFSAIYIELYYIFASVWGHRIYTIYSILFIVFIILLIVTAFITVALTYFQLAAEDHEWWWRSFLCGGSTGVFIFGYCLYYYYERSDMSGFMQTSFFFGYMACICYGFFLMLGTVGFRAALFFVRHIYRSIKCE

SEQ ID NO: 3024 - protein, 588 aa, Vinca minor
MARFPVVVLIVLLMVAGVRSDGSDHKYKAKDQVPLYANKVGPFQNPSETYRFFDLPFCIPDHVKEKKEALGEVLNGDRLVSAPYKLDFLVDKDSETVCKKKLTKDDVKLFRKAVAKDYYFEMYYDDLPVWGFLGKVDKESKSDPSEYKYYLFKHLHFEIFYKKDRVIEINARTDPSALVDLTEDKDVNVEFMYSVRWKETNIPFEKRMEKYSKTSALPHHLEIHWFSIINSCVTVLLLTGFLATILMRVLKNDFVKYAHDEETADDQEETGWKYIHGDVFRYPQYKSLFAAALGCGTQLFIMVTFIFILALVGVFYPYNRGALFTALVVIYALTSGIAGYTAASFYCQLEGANWVRNVLLTGALFCGPFFLTFCFLNTVAIGYSATAALPFGTIVVIFLIWALVTSPLLVLGGVAGKNAKTEFQAPCRTTKYPREIPPSPWYRSTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRAALFFVRHIYRSIKCE

SEQ ID NO: 3025 - protein, 342 aa, Theobroma cacao
MRVLKNDFVKYAHDEESADDQEETGWKYIHGDVFRYPKHKSLFAAALGSGTQLFTLTIFIFILALVGVFYPYNRGALFTALVVIYALTSGIAGYTTASFYCQLEGTNWVRNLLLTGGLFCGPLFITFCFLNTVAIAYKTTAALPFGTIVVIFLIWALVTSPLLVLGGIAGKNSKAEFQAPCRTTKYPREIPPLPWYCKTLPQMAMAGFLPFSAIYIELYYIFASVWGHRIYTIYSILFIVVIILLIVTAFITVALTYFQLAAEDHEWWWRSFLCGGSTGLFIYAYCLYSYNARSDMSGFMQTSFFFGCMACICYGFFLMLGAIGFRASLFFVRHIYRSIKCE

SEQ ID NO: 3026 - protein, 335 aa, Catharanthus roseus
MEIEKEFQRLAKWQVVVLILLSTVAVVRSDGSDHKYKAKDQVPLYVNKVGPFQNPSETYRFFDLPFCSPDHVKDKKEALGEVLNGDRLASAPYKLDFLVDKDSEVVCKKKLNKDEVKQFRKAVAKDYYFQMYYDDLPVWGFLGKVDKEGKSDPSEYKYYLFKHLHFEVFYNKDRVIEINARTDPSALVDLTEDKDVDVEFMYSVRWKETNVPFEKRMEKYSKTSALPHHLEIHWFSIINSCVTVLLLTGFLATILMRVLKNDFVKYAHDEEAADDQEETGWKYIHGDVFRFPKYKSLFAAALGCGTQLFIMVTLFLFWHWLVYFIHTIVELFSLH

SEQ ID NO: 3027 - protein, 594 aa, Amsonia hubrichtii
MIERRWWSPYVVILAVLVCFTAEVRSDASDHKYKPGDEVPLYANKVGPFHNPSETYRYFDLPFCSPDHVKEKREALGEVLNGDRLVVAPYKLEFLSDKESIIVCKKKLSQGEVAQFRSAVSKDYYFQMYYDDLPLWGFLGTVDKDGKADASEYKYHLFKHLHFEIFYNKDRVIEINARSDPSALVDITEDKEVDVDFMYSVKWKETTTAFENRMEKYSHSSSLPHHLEIHWFSIINSCVTVLLLTGFLATILMRVLKNDFVKYAHDEETADDQEETGWKYIHGDVFRYPKYKSLLAAALGSGTQLFTLTICIFILALVGVFYPYNRGALFTALVIIYALTSGVAGYIAASFYCQLEGTNWVRNVLLTGALFCGPLFLTFCFLNTVAIAYSATAALPFGTIVVIFLIWALITSPLLVMGGIAGKNSKAEFQAPCRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYAFFLMLGTVGFRAALFFVRHIYQSIKCE

SEQ ID NO: 3028 - protein, 588 aa, Flaveria ramosissima
MSAIRWFVVALLVAFCVEEVRSGADHKYKPGDEVPLYANKVGPFHNPSETYRFFDLPFCLPAHLKEKPEALGEVLNGDRLVSAPYKLDFMVEKDSEIVCRKTLTKDEVSKFRSAVKKDYYFQMYYDDLPFWGFLGKVEKDKTDPNEEKYYLFKHLHFEIHYNNDRVIEINAKADPNAVVDLTEDKEVDVEFMYTVRWKETNVPYETRMEKYAQSSSQPHHLEIHWFSIINSCVTVLLLTGFLATILMRVLKNDFVKYAHDEEAADDQEETGWKYIHGDVFRYPKYKSLFAAALGSGTQLFALALFIFILALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGVFIFGYCLYYYYERSDMSGFMQTSFFFGYMACICYGFFLMLGMVGFRAALFFVRHIYRSIKCE

SEQ ID NO: 3029 - protein, 588 aa, Helianthus annuus
MPVTVIRWLLVALLAAVSVNSVRSDHKYKPGDEVPLYANKVGPFHNPSETYRFYDLPFCLPAHLKEKSEALGEVLNGDRLVSAPYKLDFMVEKDSEIVCKKTLTKEEVSKFRSAVTKDYYFQMYYDDLPFWGFLGKVEKDKTDPSEEKYYLFKHLHFEIHYNNDRVIEINAKADPSAVVDLTEDKEVEVEFMYTVRWKETNIPYESRMEKYAQSSSQPHHLEIHWFSIINSCVTVLLLTGFLATILMRVLKNDFVKYAHDEEAADDQEETGWKYIHGDVFRYPKYKSLFAAALGSGSQLFALALFIFILALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGVFIFGYCLYYYYERSDMSGFMQTSFFFGYMACICYGFFLMLGMVGFRAALFFVRHIYRSIKCE

SEQ ID NO: 3030 - protein, 597 aa, Musa acuminata
MEMGRSAMDLAAVVAVATLLLCFGVVGVRSDASNHRYKTGDHVPLYVNKVGPFHNPSETYRYFDLPFCTPEHVTEKKEALGEVLNGDRLVDAPYKLDFRVDRESEVLCKKKLKKEDVAKFRSAVTKDYYFQMYYDDLPLWGFIGKVDKEGKDLGEYKYYLYKRFHFDVLYNNDRVIEIIVHTDPNTLLDVTEDRDTEVEFLYSVKWKETSTPFEKRMEKYSQTSSLPHHLEIHWFSIINSCVTVLLLTGFLATILMRVLKNDFVKYAHDEESAEDQEETGWKYIHGDVFRFPKNKSLLAACLGSGTQLFTLTVFIFILALVGVFYPYNRGALFTALVIIYALTSGIAGYAATSFYCQLEGTNWVRNLLLTGCLFCGPLFLTFCFLNTVAIVYSATAALPFGTIVVIVLIWTLVTSPLLVLGGIAGKNSKIEFQAPCRTTKYPREIPELPWYRQAIPQMIMAGFLPFSAIYIELYYIFASVWGHRIYTIYSILFIVFIILIIVTAFITVALTYFQLAAEDHEWWWRSFLCGGSTGLFVYGYCWYYYYARSDMSGFMQTSFFFGYMACICYGFFLMLGMVGFRAALLFVRHIYRSIKCE

SEQ ID NO: 3031 - protein, 588 aa, Helianthus annuus
MPVTVIRWLLMALLAAVSVNSVRSDHKYKPGDEVPLYANKVGPFHNPSETYRFYDLPFCLPAHLKEKSEALGEVLNGDRLVSAPYKLDFMIEKDSEIVCKKTLTKEEVSKFRSAVTKDYYFQMYYDDLPFWGFLGKVEKDKTDPSEEKYYLFKHLHFEIHYNNDRVIEINAKADPSAVVDLTEDKEVEVEFMYTVRWKETNIPYESRMEKYAQSSSQPHHLEIHWFSIINSCVTVLLLTGFLATILMRVLKNDFVKYAHDEEAADDQEETGWKYIHGDVFRYPKYKSLFAAALGSGSQLFALALFIFILALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTVPQMAMAGFLPFSAIYIELYYIFASVWGHRIYTIYSILFIVFIILLIVTAFITVALTYFQLAAEDHEWWWRSFLCGGSTGVFIFGYCLYYYYERSDMSGFMQTSFFFGYMACICYGFFLMLGMVGFRAALFFVRHIYRSIKCE

SEQ ID NO: 3032 - protein, 588 aa, Helianthus annuus
MTTMTVIRWLLVALTLLQVRSGASDHKYKPNDEVPIYANKVGPFHNPSETYRFFDLPFCLPAHLKEKPEALGEVLNGDRLVSAPYKLEFMREKDSELVCRKKLTKAEVSKFRKAVAKDYYFQMYYDDLPFWGFLGKVEKDKTDPSEEKYYLFKHLHFEIHYNKDRVIEINAKADPNAVVDLTDDKEVEVEFLYTVKWKETDIPYESRMEKYSQTSSQPHHLEIHWFSIINSCVTVLLLTGFLATILMRVLKNDFVKYAHDEEEADDQEETGWKYIHGDVFRYPKYKSLFAAALGSGTQLFSLALFIFGLALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTVPQMAMAGFLPFSAIYIELYYIFASVWGHKIYTIYSILFIVFIILLIVTAFITVALTYFQLAAEDHEWWWRSFLCGGSTGVFIYGYCLYYYYERSDMSGFMQTSFFFGYMACICYGFFLMLGMVGFRAALFFVRHIYRSIKCE

SEQ ID NO: 3033 - protein, 596 aa, Nicotiana tabacum
  misc_feature (5)..(5): Xaa can be any naturally occurring amino acid
  misc_feature (25)..(25): Xaa can be any naturally occurring amino acid
  misc_feature (66)..(66): Xaa can be any naturally occurring amino acid
  misc_feature (148)..(148): Xaa can be any naturally occurring amino acid
  misc_feature (282)..(282): Xaa can be any naturally occurring amino acid
MVKKXSMGCGYYVVVLVLLFFGATXVRSDSSDHKYKNGEEVPLYANKVGPFHNPSETYRYFDLPFXSPGHVKDKTEALGEVLNGDRLVTAPYKLDFLSDRETEVVCKKSLSKEEVARFRDAVAKDYYFQMFYDDLPIWGFIGKVDKEXKSDPNEYKYYLFKHLHFDIHFNNDRVIEVNARTDPNALVDITEDKEVDVDFMYSVKWKETDIPFEKRMEKYSQTSALPHHLEIHWFSIINSCVTVLLLTGFLATILMRVLKNDFVKYAHDEEAADDQEETGWKXIHGDVFRYPKRNSLFAAALGSGTQLFTLTIFIFILALVGVFYPYNRGALFTALVVIYALTSGIAGYTAASFYCQLEGKNWVRNLLLTGGLFCGPLFLTFCFLNTVAIAYHTTAALPFGTIVVIFLIWALVTSPLLVLGGIAGKNSKAEFQAPCRTTKYPREIPQLPWYRGALPQMAMAGFLPFSAIYIELYYIFASVWGHRIYTIYSILFIVFIILIIVTAFITVALTYFQLAAEDHEWWWRSFLCGGSTGLFIYGYCLYYYYARSDMSGFMQTSFFFGYMACICYAFFLMLGTVGFRAALFFVRHIYRSIKCE

SEQ ID NO: 3034 - protein, 597 aa, Vinca minor
MERRRWNPNAVVVFIAAVLFCCFAAEVRSDAWDHKYEPGDQVPLYANKVGPFHNPSETYRYFDLPFCSPAHVKEKREALGEILNGDRLVIAPYKLEFLSDKDSEIVCKKKLSKEEVAQFRSAVSKDYYFQMYYDDLPLWGFLGKVDKEGRADPSEYKYYLFKHLHFEIFYNKDRVIEINARTDPNALVDITEDKEVDVDFMYSVKWKETSTAFENRMEKYSQSSSLPHHLEIHWFSIINSCVTVLLLTGFLATILMRVLKNDFVKYGHDEEAADDQEETGWKYIHGDVFRYPKYKSLLAAALGSGTQLFTMTICIFILALVGVFYPYNRGALFTALVIIYALTSGVAGYTAASFYCQLEGKNWVRNVLLTGGLFCGPLFLTFCFLNTVAIAYTATAALPFGTIVVIFLIWALITSPLLVMGGIAGKNSKAEFQAPCRTTKYPREIPPLPWYRGTLPQMAMAGFLPFSAIYIELYYIFASVWGHRIYTIYSILFIVFIILVIVTAFITIALTYFQLAAEDHEWWWRSFLCGGSTGLFIYGYCLYYYYARSDMSGFMQTSFFFGYMACICYAFLLMLGTVGFRAALFFVRHIYRSIKCE

SEQ ID NO: 3035 - protein, 459 aa, Tripterygium wilfordii
MGFLGKVDKEGKSDPSEYKYYLFKHLIFNILHNKDRVIEITVQSDQNSLVDITEDKEVEVEFTYTVKWKETEIPFEKRMEKYSQSSSLPHHLEIHWFSIINSCVTVLLLTGFLATILMRVLKNDFSKYAHDEESADDQEETGWKYIHGDVFRYPKYKSLLAAALGSGTQLFTLVLFIFMLALVGVFYPYNRGALFTALVVIYALTSGIAGYTAASFYCQLEGTNWVRNLLLTGSLFCGPLFLTFCFLNTVAIAYSATAALPFGTIVVIFLILTLVTTPLLVLGGIAGKNSKAEFQAPCRTTKYPREIPPLPWYRKSLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFLLMLGTVGFRASLFFVRHIYRSIKCE

SEQ ID NO: 3036 - protein, 594 aa, Cucumis sativus
FPDWSMKNSLIFTLFWIAISAIQVAPDASNHRYSEGDSVPLYANKVGPFHNPSETYRYFDLPFCSPGDVKEKKEALGEVLNGDRLVSAPYKLDFKREKDTEVACKSKLSKKEVAQFRAAVKKDYYFQMYYDDLPIWGFIGKVDREGRDDPSEYKYFLFKHIQFDISYNRDRVIEISARMDPHSVVDLTEDKDVDVEFMYTVKWRETDTPFEKRMDKYSQSSSLPHHLEIHWFSIINSCVTVLLLTGFLATILMRVLKNDFMKYAQDEEAADDQEETGWKYIHGDVFRFPKYKSLFAAALGSGTQLFTLTVFIFMLALVGVFYPYNRGALFTALVVIYALTSGIAGYTASSFYCQLEGSNWVRNLLLTGCLFCGPLFATFCFLNTVAIVYNATAALPFGTIVVIVLIWTLVTSPLLVLGGIAGKNSRIEFQAPCRTTKYPREIPQLPWYRSTVPQMAMAGFLPFSAIYIELYYIFASVWGHKIYTIYSILFIVFIILLIVTAFITVALTYFQLTAEDHEWWWRSFLCGGSTGLFIYGYCLYYYYARSDMTGFMQTSFFFGYMACICYGFFLMLGTVGFRAALFFVRHIYRSIKCE

SEQ ID NO: 3037 - protein, 166 aa, Ambrosia trifida
MSVIRWLVVSLLLTVSLNSIQSNASDHKYKPGDEVSLYANKVGPFHNPSETYRFYDLPFCLPAHLKEKSEALGEVLNGDRLVSAPYKLDFMVEKDSEIVCRKTLTKEEVSKFRSAVTKDYYFQMYYDDLPFWGFLGKVEKDKTDPNDKNITCLNIFILRSTTITIV

SEQ ID NO: 3038 - protein, 595 aa, Musa acuminata
MRTSVTDLTAAATALLLLLCFGVDGVVSDASDHRYKTGDHVPLYVNKVGPFHNPSETYRYFDLPFCTPEHVTEKREALGEVLNGDRLVDAPYKLDFRVDHESEVLCKKRLTREEVSKFRSAVTKDYYFQMYYDDLPLWGFIGKVDKEGKDLGEYKYYLYKRFHFDVLYNNDRVIEIVVHTDPNMLLDVTEDRDIEAEFLYSVKWKETATPFEKRMEKYSQTSSLPHHLEIHWFSIINSCVTVLLLTGFLATILMRVLKNDFVKYTHDEESAEDQEESGWKYIHGDVFRFPKNKSLLAASLGSGTQLFTLTVFIFILALVGVFYPYNRGALFTALVIIYALTSGIAGYAATSFYCQLEGTNWVRNLLLTGCLFCGPLFLTFCFLNTVAIVYSATAALPFGTIVVIVLIWTLVTSPLLVLGGIAGKNSKADFQAPCRTAKYPREIPPLPWYRQTIPQMIMAGFLPFSAIYIELYYIFASVWGHRIYTIYSILFIVFIILLIVTAFITVALTYFQLAAEDHEWWWRSFLCGGSTGLFVYGYCLYYYHARSDMSGFMQTSFFFGYMACICYGFFLMLGMVGFRAALLFVRHIYRSIKCE

SEQ ID NO: 3039 - protein, 592 aa, Castanea mollissima
MKKKIMACLVAAIVILCSLTHVRSDASNHRYKEGDDVPLYANKVGPFHNPSETYRYFDLPFCSPAHMQEKKEALGEVLNGDRLVVAPYNLEFLKDKESEIVCKKKLKQEEVSQFRTAVSKDYYFQMYYDDLPLWGLLGKFDKEGKDDPSEHKYYLFKHLHFDILYNKDRVIEIIVKSDPDALVDLTEDKEVDVEFTYSVKWKDTEIPFEKRMEKYSQISSLPHHLEIHWFSIINSCVTVLLLTGFLATILMRVLKNDFVKYTHDEEAADDQEETGWKYIHGDVFRYPKYKSLFAAALGSGTQLFTLAIFIFLLALVGVFYPYNRGALFTALVVIYALTSGIAGYTAASFYCQLEGQNWVRNLLLTGSLFCGPLFLTFCFLNTVAIAYSSTAALPFGTIVVIFLIWTLVTSPLLVLGGIAGKNSKAEFQAPCRTAKFPREIPSLPGYRKTLPQMAMAGFLPFSAIYIELYYIFASVWGHRIYTIYSILFIVFIILLVVTAFITVSLTYFQLAAEDHEWWWRSFLCGGSTGLFIYGYCLYYYHARSDMSGFMQTSFFFGYMACICYGFFLMLGVVGFRASLFFVRHIYRSIKCE

SEQ ID NO: 3040 - protein, 587 aa, Euonymus alatus
MACIVAAVLILCGLSQVRSDASDHRFKVGDDVPLYANKVGPFHNPSETYRYFDLPFCSSAPVKEKKEALGEVLNGDRLVSAPYKLDFLNEKESEVACKRRLTKEQVTQFRRAVSKDYYFQMYYDDLPIWGFLGRVDKEGKSDPSEYKYYLFRHLIFNIFYNKDRVIEITVQSDPNSLVDITEDKEVEVEFTYTVKWKETEIPFEKRMEKYSQSSSLPHHLEIHWFSIINSCVTVLLLTGFLATILMRVLKNDFSKYAHDEESADDQEETGWKYIHGDVFRYPKYKSLLAAALGSGTQLFTLTIFIFMLALVGVFYPYNRGALFTALVLIYALTSGIAGYTAASFYCQLEGTNWVRNLLLTGSLFCGPLFLTFCFLNTVAIAYSATAALPFGTIVVIFLILTLVTTPLLVLGGIAGKNSKAEFQAPCRTTKYPREIPQLPWYRKSLPQMAMAGFLPFSAIYIELYYIFASVWGHRIYTIYSILFIVFIILLIVTAFITVALTYFQLAAEDHDWWWRSFLCGGSTGLFIYGYCLYYYYARSDMSGFMQTSFFFGYMACICYGFLLMLGTVGFRASLFFVRHIYRSIKCE

SEQ ID NO: 3041 - protein, 397 aa, Catharanthus roseus
MYSVKWKETTTAFEKRMEKYSQSSSLPHHLEIHWFSIINSCVTVLLLTGFLATILMRVLKNDFVKYAHDEEAADDQEETGWKYIHGDVFRYPKYKSVLAAALGSGTQLFTITICIFILALVGVFYPYNRGALFTALVIIYALTSGIAGYTASSFYCQLEGTNWVRNVLLTGGLFCGPLFLTFCFLNTVAIAYSATAALPFGTIVVIFLIWALITSPLLVMGGIAGKNSKAEFQAPCRTTKYPREIPPLPWYRATLPQMAMAGFLPFSAIYIELYYIFASVWGHRIYTIYSILFIVFIILVIVTAFITIALTYFQLAAEDHEWWWRSFLCGGSTGLFIYGYCLYYYYARSDMSGFMQTSFFFGYMACICYAFFLMLGTVGFRAALFFVRHIYHSIKCE

SEQ ID NO: 3042 - protein, 588 aa, Helianthus annuus
MTTMTVIRWLLVALTVLQVRSGASDHKYKPNDEVPIYANKVGPFHNPSETYRFFDLPFCLPAHLKEKPEALGEVLNGDRLVSAPYKLEFMREKDSELVCRKKLTKAEVSKFRKAVAKDYYFQMYYDDLPFWGFLGKVEKDKTDPSEEKYYLFKHLHFEIHYNKDRVIEINAKADPNAVVDLTDDKEVEVEFLYTVKWKETDIPYESRMEKYSQTSSQPHHLEIHWFSIINSCVTVLLLTGFLATILMRVLKNDFVKYAHDEEEADDQEETGWKYIHGDVFRYPKYKSLFAAALGSGTQLFSLALFIFGLALVGVFYPYNRGTLFTALVVIYALTSGIAGYTAASFYHQLEGTNWVRNLLMTGCLFCGPLFLTFCFLNTVAIAYTATAALPFGTIVVIVLIWTLVTSPLLVLGGIAGKNSKAEFQAPVRTTKYPREIPPLPWYRKTVPQMAMAGFLPFSAIYIELYYIFASVWGHKIYTIYSILFIVFIILLIVTAFITVALTYFQLAAEDHEWWWRSFLCGGSTGVFIYGYCLYYYYERSDMSGFMQTSFFFGYMACICYGFFLMLGMVGFRAALFFVRHIYRSIKCE

SEQ ID NO: 3043 - protein, 589 aa, Arnica chamissonis
MSVIRWLLVALLVTFCVDEVRSGASDHKYKPGDEVPIYANKVGPFHNPSETYRFFDLPFCLPAHLKEKPEALGEVLNGDRLVSAPYKLDFMVEKDSEIVCRKTLTKDEVSKFRKAVTKDYYFQMYYDDLPFWGFLGKVEKDKNDPNEEKCYLFKHLHFEIHYNNDRVIEINAKADPNAVADLTEDKEVEVEFMYTVRWKETNTPYETRMEKYAQSSSQPHHLEIHWFSIINSCVTVLLLTGFLATILMRVLKNDFVKYAHDEEEADDQEETGWKYIHGDVFRYPKYKSLFAAALGSGSQLFALALFIFILALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTVPQMAMAGFLPFSAIYIELYYIFASVWGHRIYTIYSILFIVFIILLIVTAFITVALTYFQLAAEDHEWWWRSFLCGGSTGVFIFGYCLYYYYERSDMSGFMQTSFFFGYMACICYGFFLMLGMVGFRAALFFVRHIYRSIKCE

SEQ ID NO: 3044 - protein, 592 aa, Lactuca sativa
MLKKMAVIRWLVVALLLVFRIQEVRSGADHKYKEKEEVPIYANKVGPFHNPSETYRFFDLPFCLPDHLKEKPEALGEVLNGDRLVSAPYKLPFMVEKESETVCRKKLTKQEVLKFRSAVAKDYYFQMYYDDLPFWGFLGKVEKDKNDPSEERFYLFKHLHFEILYNKDRVIEINAKADPNAVVDLTEDKEVEVEFMYTVRWKETNIPFENRMEKYSQSSSQPHHLEIHWFSIINSCVTVLLLTGFLATILMRVLKNDFVKYAHDEEAADDQEETGWKYIHGDVFRYPKYKSLFAAALGSGTQLFALALFIFILALVGVFYPYNRGALFTALVVIYALTSGIAGYTASSFYHQLEGSNWVRNLLLTGCLFCGPLFLTFCFLNTVAIAYTATAALPFGTIVVIVLIWSLVTSPLLVLGGIAGKNSKAEFQAPVRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGVFIYGYCLYYYYERSDMSGFMQTSFFFGYMACICYGFFLMLDMIGFRAALFFVRHIYRSIKCE

SEQ ID NO: 3045 - protein, 592 aa, Populus trichocarpa
MEKKLVPCLVVSILIFCSVTHVRSDASDHRYKVGEDVPLYVNKVGPFHNPSETYRYFDLPFCSSGPTKDKKEALGEVLNGDRLVTAPYKLDFLNDKDSEIACRKRLTKEQVAQFREVVSKDYYFQMYYDDLPIWGFLGKVDKERKNDPSEYKYYLFKHLHFTIFYNKDRVIEITAQSDLNNVVDLTEDKEVDVEFMYSVKWKETEIPFEKRMEKYSQSSSLPHHLEIHWFSIINSCVTVLLLTGFLATILMRVLKNDFVKYAHDEESAEDQEETGWKYIHGDVFRYPKYKSLLAAAVGSGTQLFTLTIFIFVLALVGVFYPYNRGALFTALVVIYALTAGIAGYTAASFFCQLEGTNWVRNLLLTGALFCGPLFLTFCFLNTVAIAYSATAALPFGTIVVIFLIWALVTTPLLVLGGIAGKNSKAEFQAPVRTTKYPREIPQLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYGFFLMLGSIGFRASLFFVRHIYRSIKCE

SEQ ID NO: 3046 - protein, 592 aa, Populus trichocarpa
MEKKLVPCLVSFVLILCSVSHVRSDASDHRYKVGDDVPLYVNKVGPFHNPSETYRYFDLPFCSSGPTKDKKEALGEVLNGDRLVTAPYKLDFLNDKDSEVACKNTLTKEQVAQFREAVSKDYYFQMYYDDLPIWGFLGKVDKERKNDPSEYKYYLFKHLHFTIFYNKYRVIEISAQSDLNNVVDLTEDKEVNVEFMYSVKWKETDITFEKRMDKYSQSSSLPHHLEIHWFSIINSCVTVLLLTGFLATILMRVLKNDFVKYAHDEESAEDQEETGWKYIHGDVFRYPKYKSLLAAAVGSGTQLFTLTIFIFVLALVGVFYPYNRGALFTALVVIYALTAGIAGYTAASFFCQLEGTNWVRNLLLTGALFCGPLFLTFCFLNTVAITYSATAALPFGTIVVIFLIWALVTTPLLVLGGIAGKNSKAEFQAPVRTTKYPREIPQLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYGFFLMLGSIGFRASLFFVRHIYRSIKCE

SEQ ID NO: 3047 - protein, 596 aa, Plantago ovata
MSSSKQAWWWWSYAVVLALGCIAVGVRSDASDHKYKMGETVPLYANKVGPFHNPSETYRFFDLPFCSTGDVKDKSEALGEVLNGDRLVSAPYKLDFLVDKESEVICTKKLSKEEVAVFRSAVAKDYYFQMYYDDLPIWGFLGKVDKEGKSDPSEYKYYLFKHLHFEIFYNKDRVIEINARTDPNALIDLTEDKEVSVEFTYSSKWKETSITFENRMEKYSHSSSLPRHLEIHWFSIINSCVTVLLLTGFLATILMRVLKNDFVKYAHDEEAADDQEETGWKYIHGDVFRFPKYKSVFAAALGSGTQLFALATFIFLLALVGVFYPYNRGALFTALVVIYALTSGIAGYTAASFYCQLEGTNWVRNLLLTGGLFCGPLFLTFCFLNTVAIAYHATAALPFGTIVVIFLIWALVTSPLLVMGGIAGKNSKAEFQAPCRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYAFFLMLGAVGFRAALFFVRHIYRSIKCE

SEQ ID NO: 3048 - protein, 602 aa, Tabernaemontana elegans
MSKFRTEMMARRWLNPYAFVFLVVLVCFAVEVRSDASDHKYKPGDQVPLYANKVGPFHNPSETYRYFDLPFCAPAHVKEKREALGEVLNGDRLVVAPYKLEFLSDKDSEIVCTKKLSKEEVGQFRSAVSKDYYFQMYYDDLPLWGFLGKVDKERKADPSEYKYYLFKHLHFEILCNKDRVIEVNARTDPNALVDITEDKEVDVDFMYSVKWKETTTAFENRMEKYSQSSSLPHHLEIHWFSIINSCVTVLLLTGFLATILMRVLKNDFVKYAHDEEAADDQEETGWKYIHGDVFRYPKYKSLLAAALGSGTQLFTLTICIFILALVGVFYPYNRGALFTALVIIYALTSGVAGYTAASFYCQLEGTNWVRNVLLTGGLFCGPLFLTFCFLNTVAIAYSATAALPFGTIVVIFLIWALITSPLLVMGGIAGKNSRAEFQAPCRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYAFFLMLGTVGFRAALFFVRHIYRSIKCE

SEQ ID NO: 3049 - protein, 502 aa, Vinca minor
MGRWPVVVVMIVFLSMVAGVKSDGSDHKYKAKDQVPLYANKVGPFQNPSETYRFFDLPFCIPDHVKEKKEALGEVLNGDRLVSAPYKLDFLVDKDSEKVCKKKLTKDEVELFRKAVAKDYYFEMYYDDLPVWGFLGKVDKEGRSDPSEFKYYLFKHLHFEIFYKKDRVIEINARTDPSALVDLTEDKDVNVEFMYSVRWKETNVPFEKRMDKYSKTSALPHHLEIHWFSIINSCVTVLLLTGFLATILMRVLKNDFVKYAHDEETADDQEETGWKYIHGDVFRFPQYKSLFAAALGCGTQLFILVTFIFILALVGVFYPYNRGALFTALVVIYALTSGIAGYTAASFYCQLEGANWVRNVLLTGALFCGPFFLTFCFLNTVAIAYSATAALPFGTIVVIFLIWALVTSPLLVLGGVAGKNAKTEFQAPCRTTKYPREIPPLPWYRSTLPQMAMAGFLPFSAIYIELYYIFASVWGHRIYTIYSILFIVFIILIIVTALLPWH

SEQ ID NO: 3050 - protein, 237 aa, Brassica napus
TMLLLLLGALILSDAGYVRSDSSDHRYKEGDIVPLYANKVGPFHNPSETYRYFDLPFCVPEGVKEKKEALGEVLNGDRLVSAPYKLNFRDEKDSEVYCKKKLSKEEVKHFRKAVEKDYYFQMYYDDLPIWGFIGKVDKDIKSDPSEYKYFLYKHIQFEILYNKDRVIEISARMDPHSLVDLSEDKEVDAEFMYSVKWKETETPFEKRMEKYSMSSSLPHHLEITGSPLLTRVLLSCF

SEQ ID NO: 3051 - protein, 592 aa, Tropaeolum majus
MVKITPYLVALTVMILCGVTHVRSDASDHRYKVGDDVPLYANKVGPFHNPSETYRYFDLPFCSSAPIKEKKEALGEVLNGDRLVSAPYKLDFLNDKDSEIACKKRLTVEDVTKFRESVSKDYYFEMYYDDLPIWGFLGKVDKEGKTDSSEYKYYLFTHLQFEIFYNKDRVIEISVRSDPHTLVDLTEDKEVEVDFMYTVRWKETEISFENRMEKYSHSSSLPHHLEIHWFSIINSCVTVLLLTGFLATILMRVLKNDFVKYAHDEEEADDQEETGWKYIHGDVFRYPKNNSLFAAALGSGTQLFALTLFIFMLALVGVFYPYNRGALFTALVVMYALTSGVAGYTAASFYCQLEGTNWVRNLLLTGGLFCGPLFLTFCFLNTVAIAYHATAALPFGTIVVIFLIWTLVTSPLLILGGIAGKNSKAEFQAPCRTTKYPREIPPLPWYRRTLPQMAMAGFLPFSAIYIELYYIFASVWGHRIYTIYSILFIVFIILLIVTAFITVALTYFQLAAEDHGWWWRSFLCGGSTGLFIYAYCLYYYFARSDMSGFMQTSFFFGYMACICYGFFLMLGTIGFRTALLFVRHIYRSIKCE

SEQ ID NO: 3052 - protein, 591 aa, Manihot esculenta
MKISSIILLLALLIACSVTQVISDASDHRYKDGDSVPLYANKVGPFHNPSETYRYFDLPFCVPEHLKEKTEALGEVLNGDRLVSAPYKLNFRDEKDTAVVCRKKLRKEEVARFRSAVDKDYYFQMYYDDLPIWGFIGKVDREGKADRSEYKYFLHKHIQFDVLYNKDRVIEVSAHMDPHSLLDLTEDKEIVAEFLYTVKWKQTDIPFEKRMEKYSLSSSSPHHLEIHWFSIINSCVTVLLLTGFLTTILMRVLKNDFMKYAQDEEAADDREETGWKYIHGDVFRYPTYKSLFAAALGSGTQLFTLTIFIFMLALVGVFYPYNRGALFTALVVIYALTSGIAGYTATSFYCQLEGKNWVRNLLLTGCLFCGPLFLTFCFLNTVAIIYSATAALPFGTIVVIFLIWTLVTSPLLVLGGIAGKNSKGEFQAPCRTTKYPREIPQLPWYRCALPQMAMAGFLPFSAIYIELYYIFASVWGHRIYTIYSILFIVFIILLTVTGFITVALTYFQLAAEDHEWWWRSFLCGGSTGLFIYAYCLYYYYARSDMSGFMQTSFFFGYMACICYGFFLMLGTVGFRASLLFVRHIYWSIKCE

SEQ ID NO: 3053 - protein, 592 aa, Solanum lycopersicum
MEKKMMSYVVVLIVLCCGVTPARSDGSDHKYKAGDQVTMYANKVGPFHNPSETYRFFDLPFCAPAHVTEKKEALGEVLNGDRLVSAPYKLDFMYDKDSEIVCKKKLSKEEVSLFRNAVAKDYYFQMYYDDLPIWGFLGKVDKEGKTDPSEYKYYLFKHLHFEIFYNNDRVVEINARTDPNALVDITEDKEVDVDFMYSVKWKESTTPFEKRMEKYSQSSSMPHHLEIHWFSIINSCVTVLLLTGFLATILMRVLKNDFVKYAHDEEAADDQEETGWKYIHGDVFRYPKYKSLLAAAVGSGTQLFTMTIFIFILALVGVFYPYNRGALFTALVVIYALTSGIAGYTASAFYCQLEGTNWVRNLILTGALFCGPLFLTFCFLNSVAIGYTATAALPFGTIMVIFLIWALVTSPLLVLGGIAGKNSKSEFQAPCRTTKYPREIPPSPWYRGTLSQMAMAGFLPFSAIYIELYYIFASVWGHRIYTIYSILFIVFIILLIVTAFITVALTYFQLAAEDHEWWWRAFLCGGSTGLFIYGYCLYYYYARSDMTGFMQTSFFFGYMACICYGFFLMLGSVGFRAALFFVRHIYRSIKCE

SEQ ID NO: 3054 - protein, 587 aa, Musa acuminata
MDLVRVAALLLCFGVAGVVSEASDHRYKQGDPVPLYANKVGPFHNPSETYRFFDLPFCIPDHVTEKKEALGEVLNGDRLVGAPYKLDFRVDYDSELLCKKKLTKGDVGKFRDAVTKDYYFQMYYDDLPIWGFIGKVDKEGKDLSNDNYYLYRHIHFDILYNNDRVIEITVHTDPNSVADLTEDKDIEAEFLYSVKWKETTMPFEKRMEKYSQSSSLPHHLEIHWFSIINSCVTVLLLTGFLATILMRVLKNDFVKYADDEESAEDQEETGWKYIHGDVFRFPKNKSLLAASLGSGTQLFALTVFIFVLALVGVFYPYNRGALFTALVVIYALTSGIAGFTATSFYFQLEGTNWVRNLLLTGCLFCGPLFLTFCFLNTVAVVYSATAALPFGTIVVIVLIWTLVTSPLLVLGGIAGKNNKTEFQAPCRTTKFPREIPPLPWFRRTIPQMAMAGFLPFSAIYIELYYIFASVWGHRIYIIYGILFVVFIILLVVAAFVTVALTYFQLAAEDHEWWWRSFLCGGSTGLFVYGYCLYYYFARSDMSGFMQTSFFFGYMACICYGFFLMLGTVGFHAALFFVRHIYRSIKCE

SEQ ID NO: 3055 - protein, 589 aa, Ambrosia trifida
MKTTMSTIQWLLVAITVLQVRSGASDHKYKPNDEVPIYANKVGPFHNPSETYRFFDLPFCLPAHLKEKPEALGEVLNGDRLVSAPYKLEFMREKDSEVVCRKKLSKDEVSKFRKAVAKDYYFQMYYDDLPFWGFLGKVEKDKNDPSEEKYYLFKHLHFEIHYNKDRVIEINAKADPDAVVDLTDDKEVEVEFLYTVRWKETNIPYESRMEKYSQTSSQPHHLEIHWFSIINSCVTVLLLTGFLATILMRVLKNDFVKYAHDEEEADDQEETGWKYIHGDVFRYPKCKSLFAAALGSGTQLFCLALSIFGLALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRPTKYPREIPPLPWYRKTIPQMAMAGFLPFSAIYIELYYIFASVWGHKIYTIYSILFIVFIILLIVTAFITVALTYFQLAAEDHEWWWRSFLCGGSTGVFIYGYCLYYYYERSDMSGFMQTSFFFGYMACICYGFFLMLGMVGFRASLFFVRHIYRSIKCE

SEQ ID NO: 3056 - protein, 596 aa, Quercus alba
MVVDKKKKIMACLVAAIVILCSLTHVRSDASNHRYKEGDDVPLYANKVGPFHNPSETYRYFDLPFCSPAHMQEKKEALGEVLNGDRLVVAPYKLEFLKDKESEIVCKKKLKQEEVSQFRAAVSKDYYFQMYYDDLPLWGLLGKFDKEGKDDPSELKYYLFKHLHFDILYNKDFVIEIIVKSDPDALLDLTEDKEVDVEFTYSVKWKDTEIPFEKRMEKYSQISSLPHHLEIHWFSIINSCVTVLLLTGFLATILMRVLKNDFVKYTHDEEAADDQEETGWKYIHGDVFRYPKYKSLFAAALGSGTQLFTLAIFIFLLALVGVFYPYNRGALFTALVVIYALTSGIAGYTAASFYCQLEGQNWVRNLLLTGSLFCGPLFLTFCFLNTVAIAYSSTAALPFGTIVVIFLILTLVTSPLLVLGGIAGKNSKAEFQAPCRTAKFPREIPSLPWYRKTFPQMAMAGFLPFSAIYIELYYIFASVWGHRIYTIYSILFIVFIILLIVTAFITVSLTYFQLAAEDHEWWWRSFLCGGSTGLFIYGYCLYYYHARSDMSGFMQTSFFFGYMACICYGFFLMLGVVGFRASLFFVRHIYRSIKCE

SEQ ID NO: 3057 - protein, 466 aa, Ambrosia trifida
MYYDDLPFWGFLGKVEKDKNDPSEEKYYLFKHLHFEIHYNKDRVIEINAKADPEAVVDLTDDKEVEVEFLYTVRWKETNIPYESRMEKYSQTSSQPHHLEIHWFSIINSCVTVLLLTGFLATILMRVLKNDFVKYAHDEEEADDQEETGWKYIHGDVFRYPKYKSLFAASLGSGTQLFCLALSIFGLALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTIPQMAMAGFLPFSAIYIELYYIFASVWGHKIYTIYSILFIVFIILLIVTAFITVALTYFQLAAEDHEWWWRSFLCGGSTGVFIYGYCLYYYYERSDMSGFMQTSFFFGYMACICYGFFLMLGMVGFRASLFFVRHIYRSIKCE

SEQ ID NO: 3058 - protein, 452 aa, Brassica juncea
MYYDDLPIWGFIGKVDKEIKSDPSEYKYFLYKHIEFEILYNNDRVIEISARMDPHSLVDLTEDKEVDAEFMYTVKWKETETPFEKRMDKYSMSSSLPHHLEIHWFSIINSCVTVLLLTGFLATILMRVLKNDFTKYAQDEEAADDLEETGWKYIHGDVFRFPTRNSLFAASLGSGTQLFTLTIFIFMLALVGVFYPYNRGALFTALVVIYALTSGIAGYTSASFYCQLEGKSWVRNLLLTGCLFCGPLLLTFCFLNTVAITYTATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRA

SEQ ID NO: 3059 - protein, 586 aa, Centaurea maculosa
MMEIVALFVISSLLLLGSVTSDASNHKYKSGDVVPLYANKVGPFQNPSETYRYFDLPFCLPGDLKEKKEALGEVLNGDRLVSAPYKLDFLVDKDSEFICTKKLTKQEVAKFRKSIAKDYYFQMYFDDLPLWGFIGKYEKTESNEQKYYLFKHLQFEVLYNKNRVIEVNVRTDPSALVDVTEDKEVNVDFMYTVRWKETSIPFEKRMEKYSHNSSLPHHLEIHWFSIINSCVTVLLLTGFLATILMRVLKNDFVKYAHDEETAEDQEETGWKYIHGDVFRYPKFKSLFAASLGSGSQLFALTIFIFILALVGVFYPYNRGALFTALVVIYALTSGIAGYTASSFYCQLEGTNWVRNLLLTGSLFCGPLFLTFCFLNTVAIAYSATAALPFGTIVVIALIWALVTSPLLVLGGIAGKNSKAEFQAPCRTTKYPREIPPLPWYRGTLAQMGMAGFLPFSAIYIELYYIFASVWGHRIYTIYSILFIVFIILVIVTAFITIALTYFQLAAEDHEWWWRSFLCGGSTGLFIYGYCLYYYYGRSDMTGFMQTSFFFGYMACICYGFFLMLGTIGFRAALFFVRHIYRSIKCE

SEQ ID NO: 3060 - protein, 397 aa, Arnica chamissonis
MYTVRWKETNVPYESRMEKYSQSLSQTHHLEIHWFSIINSCVTVLLLTGFLATILMRVLKNDFVKYAHDEEAADDQEETGWKYIHGDVFRYPKYKSLFAASLGSGTQLFSLALFIFGLALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTVPQMAMAGFLPFSAIYIELYYIFASVWGHRIYTIYSILFIVFIILLIVTAFITVALTYFQLAAEDHEWWWRSFLCGGSTGVFIYGYCLYYYYERSDMSGFMQTSFFFGYMACICYGFFLMLGTVGFRASLFFVRHIYRSIKCE

SEQ ID NO: 3061 - protein, 595 aa, Oryza sativa
MASPAAAAPAALLVLLAAALAATGVVADGSDHRYKANELVPLYANKVGPFHNPSETYRYFDLPFCSPEKVKEKSEALGEVLNGDRLVDAPYKLDFRVDYDSKPVCSKKLTKEEVAKFRNAVAKDYYFQMYYDDLPLWGFIGKVEKGGKTDPKEWKYYLYRHIIFDILYNNDRVIEINVHTDQSALVDLTEDKEADVQFLYSVKWKETPTPFEKRMEKYSSSSNLPHHLEVHWFSIINSCVTVLLLTGFLATILMRVLKNDFVKYAHDEEAADDQEESGWKYIHGDVFRFPKNKSFFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKTEFQAPCRTTKYPREIPPLPWYRQTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMIGFRAALFFVRHIYKSIKCE

SEQ ID NO: 3062 - protein, 593 aa, Brachypodium distachyon
MASPAAGAASAVLLLLAFAVAGVLSDGSDHRYKSSEPVPLYANKVGPFHNPSETYRYFDLPFCSPEKVKEKSEALGEVLNGDRLVDAPYKLDFRVDLDSKPVCSKKLTKEDVAKFRNSVAKDYYFQMYYDDLPLWGFIGKLEKTAKADPSEWKYYLYRHIIFDILYNNDRVIEITVHTDQSALVDLTEDKEANVEFLYTVKWKETATPFEKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 3063 - protein, 590 aa, Phalaenopsis aphrodite
MTIAAMATVLMFFCVGIIGVVSDASSHRYKPDETVPLYANKVGPFHNPSETYRYFDLPFCSPAPVKDKSEALGEVLNGDRLVDAPYKLDFRVDYDSKSACKKQLTKEEVAKFRTAVDKDYYFQMYFDDLPIWGFIGKVDKEGKSDPSEYKYFLYRHILFEVLHNNDRVIEINVRTDTNSMVDITDDKDIEVDFMYSVKWQETDTPFEKRMEKYSQSSSQQHHLEIHWFSIINSCVTVLLLTGFLATILMRVLKNDFVKYAHDEETGDDQEETGWKYVHGDVFRFPKNKSFLASCLGSGTQLFALTTFVFLLALVGVFYPYNRGALFTALVVIYALTSGIAGYTATSFYCQLEGTNWVRNLLLTGVLFCGPLFVTFGFLNTVAIAYNATAALPFGTIVVITLIWALVTSPLLVLGGIAGKNSKAEFQAPCRTTKYPREIPQLPWYRGAIPQMAMAGFLPFSAIYIELYYIFASVWGHRIYTIYSILFVVFIILLIVTAFITVAMTYFQLAAEDHEWWWRAFLCGGSTGLFIYAYCFYYYHARSDMSGFMQTSFFFGYMACICYGFFLMLGTVGFRASLLFVRHIYRSIKCE

SEQ ID NO: 3064 - protein, 541 aa, Silene vulgaris
YRYFDLPFCTPAHVQEKKEALGEVLNGDRLVSAPYKLDFLVDKDSEVICKKKLTKDDVTKFRDAVSKDYYFQMYYDDLPIWGFLGKVDKEGKLDPSEYKYYLYKHIHFDILYNKDRVIEINVRTDPNSLVDITEDRDLDADVEFMYTVKWKETDTPFENRMDKYSQSSSLPHHLEIHWFSIINSCVTVLLLTGFLATILMRVLKNDFVKYAHDEETAEDQEETGWKYIHGDVFRFPKYKSVLAAALGSGTQLFTLTIFIFLLALVGVFYPYNRGALFTALVVIYALTSGIAGYTATSFYCQLEGANWVRNLLLTGFLFCGPLFLTFCFLNTVAIVYTATAALPFGTIVVIILIWTLVTSPLLVLGGIAGKNSKAEFQAPVRTTKYPREIPLLPWYRGTLPQMAMAGFLPFSAIYIELYYIFASVWGHRIYTIYSILFIVFIILIIVTAFITVALTYFQLAAEDHEWWWRSFLCGGSTGLFIYGYCLYYYYARSDMTGFMQTSFFFGYMACICYGFFLMLGMVGFRAALLFVRHIYRSIKCE

SEQ ID NO: 3065 - protein, 586 aa, Helianthus annuus
MENIHQWLVVALFVICSVMTTVKSDVSNHKYKSGDAVPLYANKVGPFQNPSETYRYFDLPFCLPDDLKEKKEALGEVLNGDRLVSAPYKLDFLVDKDSESICSKKLSKQDVGKFRKAISKDYYFQMYFDDLPLWGFIGKYDTKEQKYYLFKHLQFEVLYNKNHVIEVNVQTDPTALVDITQDKEVDVDFMYTVRWKETNIPFKKRMDKYSQNSSLPHHLEIHWFSIINSCVTVLLLTGFLATILMRVLKNDFVKYAHDEETAEDQEETGWKYIHGDVFRYPQHKSLFAAALGSGTQLFALTIFIFILALVGVFYPYNRGALFTALVVIYALTSGIAGYTASSFYCQLEGTNWVRNLILTGGLFCGPLFITFCFLNTVAISYSATAALPFGTIVIIGLIWGLVTSPLLVLGGIAGKNSKAEFQAPCRTTKYPREIPPLPWYRGTLPQMAMAGFLPFSAIYIELYYIFASVWGHRIYTIYSILFIVFIILVIVTAFITIALTYFQLAAEDHEWWWRSFLCGGSTGLFIYGYCLYYYYGRSDMTGFMQTSFFFGYMACICYAFFLMLGTIGFRAALFFVRHIYRSIKCE

SEQ ID NO: 3066 - protein, 586 aa, Helianthus annuus
MENIHQWLVVALFVICSVITTVKSDVSNHKYKSGDAVPLYANKVGPFQNPSETYRYFDLPFCLPDDLKEKKEALGEVLNGDRLVSAPYKLDFLVDKDSESICSKKLSKQDVGKFRKAISKDYYFQMYFDDLPLWGFIGKYDTKEQKYYLFKHLQFEVLYNKNHVIEVNVQTDPTALVDITQDKEVDVDFMYTVRWKETNIPFKKRMDKYSQNSSLPHHLEIHWFSIINSCVTVLLLTGFLATILMRVLKNDFVKYAHDEETAEDQEETGWKYIHGDVFRYPQHKSLFAAALGSGTQLFALTIFIFILALVGVFYPYNRGALFTALVVIYALTSGIAGYTASSFYCQLEGTNWVRNLILTGGLFCGPLFITFCFLNTVAISYSATAALPFGTIVIIGLIWGLVTSPLLVLGGIAGKNSKAEFQAPCRTTKYPREIPPLPWYRGTLPQMAMAGFLPFSAIYIELYYIFASVWGHRIYTIYSILFIVFIILVIVTAFITIALTYFQLAAEDHEWWWRSFLCGGSTGLFIYGYCLYYYYGRSDMTGFMQTSFFFGYMACICYAFFLMLGTIGFRAALFFVRHIYRSIKCE

SEQ ID NO: 3067 - protein, 593 aa, Avena sativa
MASPAAGAASALLVLLAFAVAGVFSDGSDHRYKAGEPVPLYANKVGPFHNPSETYRYFDLPFCSPEKVKEKSEALGEVLNGDRLVDAPYKLDFRVDYDSKAVCSKKLAKEDVAKFRNSVAKDYYFQMYYDDLPLWGFIGKVDKGTKLPPTEWKYYLYRHIIFDILYNNDRVIEINVHTDQSALVDLTEDRETDVEFLYTVKWKETPTPFEKRMEKYSSSSNMPHHLEVHWFSIINSCVTVLLLTGFLATILMRVLKNDFVKYAHDEEVADDQEESGWKYIHGDVFRFPKNKSLFSAALGTGTQLFALTTFIFLLALVGVFYPYNRGALFTALVVIYALTSGIAGYIATAFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMIGFRAALFFVRHIYKSIKCE

SEQ ID NO: 3068 - protein, 592 aa, Populus trichocarpa
MEMKLVPCLVVSILILCNVTRVRSDASTNRYKVGDDVPLYVNKVGPFHNPSETYRYFDLPFCSSGPTKDKKEALGELLNGDRLVTAPYKLDFLNDKDSEIACKNKLTKEQVAQFREAVSKDYYFQMYYDDLPIWGFIGKVEKEGKNDPSEYKYYLFKHLHFTIFYNKDRVIEITALSDPKNVVELTENKEVNVEFMYSVKWKETEIPYEKRMEKYSQSSSLPHHLEIHWFSIINSCVTVLLLTGFLATILMRVLKNDFVKYAHDEESAEDQEETGWKYIHGDVFRYPKYKSVLAAAVGSGTQLFTLTIFIFLLALVGVFYPYNRGALFTALVVIYALTAGIAGYTAASFFCQLEGTNWVRNLLLTGGLFCGPLLLTFSFLNTVAITYSATAALPFGTIVVIFLIWALVTTPLLVLGGIAGKNSKAEFQAPCRTTKYPREIPLLPWYRKTLPQMAMAGFLPFSAIYIELYYIFASVWGHRIYTIYSILFIVFIILLIVTAFITVALTYFQLAAEDHEWWWRSFLCGGSTGLFIYGYCLYYYFARSDMSGFMQTSFFFGYMACVCYGFFLMLGSIGFRASLFFVRHIYHSIKCE

SEQ ID NO: 3069 - protein, 585 aa, Flaveria ramosissima
MAIDQCMVVALLVICSVMGAVTSDVSNHKYKNGDAVPLYANKVGPFQNPSETYRYFDLPFCLPGDLKEKKEALGEVLNGDRLVSAPYKLDFLVDKDSETICSKKLTKQEVGKFRKAISKDYYFQMYFDDLPLWGFIGKYDSNEQKYYLFKHLHFEVLYNKEHVIEVNVQTDPSALVDITQDKEVNVDFMYTVRWKETNIPFKKRMNKYSQSSSLPHHLEIHWFSIINSCVTVLLLTGFLATILMRVLKNDFVKYAHDEETAEDQEETGWKYIHGDVFRYPQFKSLFAAALGCGTQLFALTIFIFILALVGVFYPYNRGALFTALVVIYALTSGIAGYTASSFYCQLEGTNWVRNLVLTGSLFCGPLFITFCFLNTVAIGYSATAALPFGTIVIIFLIWGLVTSPLLVLGGIAGKNSKAEFQAPCRTTKYPREIPPLPWYRGTLPQMAMAGFLPFSAIYIELYYIFASVWGHRIYTIYSILFIVFIILVIVTAFITIALTYFQLAAEDHQWWWRSFVCGGSTGLFIYGYCLYYYYGRSDMTGFMQTSFFFGYMACICYAFFLMLGTIGFRAALFFVRHIYRSIKCE

SEQ ID NO: 3070 - protein, 593 aa, Arabidopsis lyrata
MVLLHSMTSLLLVFFFLSGVSPVISDGSDHRYKVGDDVPLYANKVGPFHNPSETYRYFDLPFCSSAPVKEKKEALGEVLNGDRLVSAPYKLEFLGEKNSEVACRKRLSREDVAKFRDVIAKDYYFQMYYDDLPIWGFLGKVFKEGKTDPSEYKYYLFNHLQFEIFYNKDRVIEIIVRTDQNFLVDLTEDKEVQVDFTYTVRWKETEIPFEKRMEKYSLASSMPHHLEIHWFSIINSCVTVLLLTGFLATILMRVLKNDFVKYAHDEEAVDDQEETGWKLIHGDVFRFPKHKSLLAAALGSGTQLFTLAVFIFMLALVGVFYPYNRGALFTALVVIYALTSGIAGYTAASFYCQLEGTNWVRNVILTGSLFCGPLLLTFSFLNTVAIAYQATAALPFGTIVVIFLIWALVTSPLLILGGIAGKNRKSEFQAPCRTTKYPREIPPMRWYRRTLPQMAMAGFLPFSAIYIELYYIFASVWGHRIYTIYSILSIVFLILVIVTAFITVALTYFQLAAEDHEWWWRSLLCGGSTGLFIYAYCLYYYYARSDMSGFMQTSFFFGYMACICYGFFLMLGAIGFRASLLFVRHIYRSIKCE

SEQ ID NO: 3071 - protein, 590 aa, Ambrosia trifida
MMENNALIHQWLLLALLVICSVMTSVTSDVSDHKYKSGDAVPLYANKVGPFQNPSETYRYFDLPFCLPDDLKEKKEALGEVLNGDRLVSAPYKLDFLVDKDSESICSKKLSKKEVEKFRKAISKDYYFQMYFDDLPLWGFIGKYDKKEQKYYLFKHLQFEVLYNKNHVIEVNVQTDPTALIDITQDKEVNVDFMYTVRWKETKIPFKKRMDKYSQNSSLPHHLEIHWFSIINSCVTVLLLTGFLATILMRVLKNDFVKYAHDEETAEDQEETGWKYIHGDVFRYPQYKSLFAAALGSGTQLFALTIFIFVLALVGVFYPYNRGALFTALVVIYALTSGIAGYTASSFYCQLEGTNWVRNLILTGGLFCGPLFVTFCFLNTVAITYSATAALPFGTIVIIGLIWALVTSPLLVLGGIAGKNSKAEFQAPCRTTKYPREIPPLPWYRGTLPQMAMAGFLPFSAIYIELYYIFASVWGHRIYTIYSILFIVFIILVIVTAFITIALTYFQLAAEDHEWWWRSFVCGGSTGLFIYGYCLYYYYGRSDMSGFMQTSFFFGYMACICYAFFLMLGTIGFRAALFFVRHIYRSIKCE

SEQ ID NO: 3072 - protein, 588 aa, Arnica chamissonis
MDNARIHQWLAVALFVICSVMGAVTSDVSNHKYKNGDAVPLYANKVGPFQNPSETYRYFDLPFCLPGDLKEKKEALGEVLNGDRLVSAPYKLDFLVDKDSELICSKKLTKQEVGKFRKAISKDYYFQMYFDDLPLWGFVGKYVPNEQKYYLFKHLQFEALYNKEHVIEVNVQTDPSALVDITEDKEVNVDFMYTVRWKETNIPFQKRMDKYSQSSSLPHHLEIHWFSIINSCVTVLLLTGFLATILMRVLKNDFVKYAHDEETAEDQEETGWKYIHGDVFRYPQSKSLFAAALGSGTQLFALTIFIFILALVGVFYPYNRGALFTALVVIYALTSGIAGYTASSFYCQLEGTNWVRNLVLTGSLFCGPLFITFCFLNTVAIGYSATAALPFGTIVIIGLIWGLVTSPLLVLGGIAGKNSKAEFQAPCRTTKYPREIPPLPWYRGTLPQMAMAGFLPFSAIYIELYYIFASIWGHRIYTIYSILFIVFIILIIVTAFITIALTYFQLAAEDHQWWWRSFVCGGSTGLFIYAYCLYYYYGRSDMTGFMQTSFFFGYMACICYAFFLMLGTIGFRAALFFVRHIYRSIKCE

SEQ ID NO: 3073 - protein, 593 aa, Arabidopsis thaliana
MVLLPSMTSLLLVFLFLYGVSPVISDGSDHRYKVGDDVPLYANKVGPFHNPSETYRYFDLPFCSSAPVKEKKEALGEVLNGDRLVSAPYKLEFLGEKNSEVACRKRLSREDVAKFRDVIAKDYYFQMYYDDLPIWGFLGKVVKEGKTDPSEYKYYLFNHLQFEIFYNKDRVIEIIVRTDQNFLVDLTEDKEVQVDFTYTVRWKETEIPFEKRMEKYSLASSMPHHLEIHWFSIINSCVTVLLLTGFLATILMRVLKNDFVKYAHDEEAVDDQEETGWKLIHGDVFRFPKHKSLLAAALGSGTQLFTLAVFIFMLALVGVFYPYNRGALFTALVVIYALTSGIAGYTAASFYCQLEGTNWVRNVILTGSLFCGPLLITFSFLNTVAIAYQATAALPFGTIVVIFLIWALVTSPLLILGGIAGKNRKSEFQAPCRTTKYPREIPPMRWYRRTLPQMAMAGFLPFSAIYIELYYIFASVWGHRIYTIYSILSIVFLILVIVTAFITVALTYFQLAAEDHEWWWRSLLCGGSTGLFIYAYCLYYYYARSDMSGFMQTSFFFGYMACICYGFFLMLGTIGFCASLLFVRHIYRSIKCE

SEQ ID NO: 3074 - protein, 588 aa, Elaeis guineensis
MKIQWAVLLVLLLVCDWRVKADGSDHRYKEGDRVPLYANKVGPFHNPSETYRYYDLPFCSPDHVIEKKEALGEVLNGDRLVDAPYELNFREDRESTTICEKSLSEKDIAKLRNAVAKDYYFQMYYDDLPFWGFIGKVDKDNLDPSEYKYLLFKHIHFDIFYNDDRVIEISVQTDPNLTVDITEDKAVDVMFAYSVTWKNTDIPFEKRMEKYSKSSSLPQHLEIHWFSIINSCVTVLLLTGFLATILMRVLKNDFVKYSHDEESLEDQEETGWKYIHGDVFRFPKYKSLFSAVIGSGTQLLTLAMFIFLLALVGVFYPYNRGALFTALVVIYALTSGIAGYIATSFYLQLEGTNWVRNLLLTGCLFCGPLFLTFCFLNTVAIAYNATAALPFGTILVILLIWTLVTSPLLVLGGIAGKNSKTEFQAPCRTTKYPREIPQLPWYRGTVPQMAMAGFLPFSAIYIELYYIFASVWGHKIYTIYSILFIVFIILIIVTAFITVALTYFQLAVEDHEWWWRSVLCGGSTGIFIFFYCLYYYHARSDMSGFMQTSFFFGYMACICYGFFLMLGTVGFRASLLFVQHIYRSIKCE

SEQ ID NO: 3075 - protein, 586 aa, Phalaenopsis aphrodite
ASVTLALLLCFGIVGVASDASDHTYKPDEVVPLYANKVGPFHNPSETYRYFDLPFCSPEPVKDKLEALGEVLNGDRLVDAPYKLDFRVDHESASACKKHLTKEEVAKFRSAVDKEYYFQMYYDDLPLWGYIGKVDRDGRTDPSEYKYFLYRHIMFEIYYNNDRVIEINAHADMNSMVDITEDKEIDVEFMYSAKWKETGTPFEKRMEKYSQTSSLPQHLEIHWFSIINSCVTVLLLTGFLATILMRVLKNDFVKYTHDEETGEDQEETGWKYVHGDVFRFPKNNSLLAACLGSGTQLFALTIFVFALALVGVFYPYNRGALFTALVVIYALTSGIAGYTATSFYCQMEGSNWVRNLLLTGFLFCGPLFLTFCFLNTVAIAYSATAALPFGTIIVIVLIWALVTSPLLVFGGIAGRNSKTEFQAPCRTTKYPREIPPLPWYRRTIPQMAMAGFLPFSAIYIELYYIFASVWGHRIYTIYSILSVVFVILLIVTAFITVAMTYFQLAAEDHEWWWRAFLCGGSTGLFVYAYCFYYYYARSDMSGFMQTSFFFGYMACICYGFFLMLGSVGFRASLLFVRHIYRSIKCE

SEQ ID NO: 3076 - protein, 561 aa, Flaveria ramosissima
TNLTTKFLFKLTKLAPFTTLVKHIVFMIYHSVYQLILKEKPEALGEVLNGDRLVSAPYKLPFMREKDSEIVCRKKLTKDEVSKLRKAVAKDYYFQMYYDDLPFWGFLGKVEKDKTDPSEEKYYLFKHLHFEIHYNKDRVIEINAKADPDAVVDLTDDKEVEVEYLYTVRWKETNIPYESRMEKYSQTSSQPHHLEIHWFSIINSCVTVLLLTGFLATILMRVLKNDFVKYAHDEEAADDQEETGWKYIHGDVFRYPKYKSLFAAALGSGTQLFSLALSIFGLALVGVFYPYNRGALFTALVVIYALTSGFAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTIPQMAMAGFLPFSAIYIELYYIFASVWGHKIYTIYSILFIVFIILIIVTAFITVALTYFQLAAEDHEWWWRSFLCGGSTGVFIFGYCLYYYYERSDMSGFMQTSFFFGYMACICYGFFLMLGMVGFRAALFFVRHIYRSIKCE

SEQ ID NO: 3077 - protein, 592 aa, Brassica napus
MEKPPHLLLLLLVFFIYGVSPVISDGSDHRYKVGDDVPLYANKVGPFHNPSETYRYFDLPFCSSAPVKEKKEALGEVLNGDRLVTAPYKLEFLGEKNSHVACRKRLSREDVAQFRDVISRDYYFQMYYDDLPIWGFLGKVVKDGKSDPSEFKYYLFNHLQFEIFYNKDRVIEIIVRTDQSFLVDLTEDKEVEVDFTYTVRWKETEIPFEKRMEKYSLASSTPHHLEIHWFSIINSCVTVLLLTGFLATILMRVLKNDFVKYSHDEETADDQEETGWKLLHGDVFRFPKHKSLLAAALGSGTQLFTLAVFIFMLALVGVFYPYNRGALFTALVVIYALTSGIAGYTASSFYCQLEGTNWVRNVMLTGSLFCGPLLLTFSFLNTVAIAYQATAALPFGTIVVIFLIWALVTSPLLILGGIAGKNRKSEFQAPCRTTKYPREIPPMRWYRRTLPQMAMAGFLPFSAIYIELYYIFASVWGHRIYTIYSILSIVFLILVIVTAFITVALTYFQLAAEDHEWWWRSLLCGGSTGVFVYAYCLYYYYARSDMTGFMQTSFFFGYMACICYGFFLMLGAVGFRASLFFVRHIYRSIKCE

SEQ ID NO: 3078 - protein, 76 aa, Flaveria ramosissima
MVVEVFCMWWFNRAVYLWVLLVLLLWALRYDRFHADLILLRLHGVHLLRFLSHARDHRFRAALFFVRHIYRSIKCE

SEQ ID NO: 3079 - protein, 592 aa, Brassica rapa
MEKPPHLLLLLLVFFIYGVSPVISDGSDHRYKVGDDVPLYANKVGPFHNPSETYRYFDLPFCSSAPVKEKKEALGEVLNGDRLVTAPYKLEFLGEKNSHVACRKRLSREDVAQFRDVISRDYYFQMYYDDLPIWGFLGKVVKDGKSDPSEFKYYLFNHLQFEIFYNKDRVIEIIVRTDQSFLVDLTEDKEVEVDFTYTVRWKETEIPFEKRMEKYSLASSTPHHLEIHWFSIINSCVTVLLLTGFLATILMRVLKNDFVKYSHDEEAADDQEETGWKLLHGDVFRFPIHKSLLAAALGSGTQLFTLAVFIFMLALVGVFYPYNRGALFTALVVIYALTSGIAGYTASSFYCQLEGTNWVRNVMLTGSLFCGPLLLTFSFLNTVAIAYQATAALPFGTIVVIFLIWALVTSPLLILGGIAGKNRKSEFQAPCRTTKYPREIPPMRWYRRTLPQMAMAGFLPFSAIYIELYYIFASVWGHRIYTIYSILSIVFLILVIVTAFITVALTYFQLAAEDHEWWWRSLLCGGSTGVFVYAYCLYYYYARSDMTGFMQTSFFFGYMACICYGFFLMLGAVGFRASLFFVRHIYRSIKCE

SEQ ID NO: 3080 - protein, 545 aa, Cannabis sativa
ISFLFEYLKYYLLMLMVGDVKEKKEALGEVLNGDRLVSAPYKLEFRKEKESEVACSKKLTKEDVAKFREAVKKDYYFQMYYDDLPIWGFIGKVDKDGKSDPSEYKYSLYKHIHFAVLYNKDRVIEISAKTDPSSVVDLTEDKEADADFTYTVKWTETDIPFEKRMDKYSQSSSLPHHLEIHWFSIINSCVTVLLLTGFLATILMRVLKNDFMKYAQDEEAADDQEETGWKYIHGDVFRFPKYKSVFAAALGSGTQLFTLTIFIFMLALVGVFYPYNRGALFTALVVIYALTSGIAGYTATAFYCQLEGTNWVRNLLLTGCLFCGPLFLTFCFLNTVAIAYSATAALPFGTIVVIVLIWTLVTSPLLVLGGIAGKNSKAEFQAPCRTTKYPREIPPLPWYRSTLPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGMVGFRAALLFVRHIYRSIKCE

SEQ ID NO: 3081 - protein, 583 aa, Eschscholzia californica
VVVLLVMVSGFRVEGNGSTHKYNEREHVPLYANKVGPFHNPSETYRYYDLPFCAPDNVKEKIEDLGEVLNGDRLVDAPYELNFRVDKQSETLCRKKLSKEEVAKLRDAVLKDYYFQMYYDDLPFWGFLGKVEREGKTDPSEYKYLLFKHIHFDIFYNNDRVIEINVQTDPNQSVDITEDREVEAEFSYSVKWKETDIPYENRMEKYSKSSSMPQHLEIHWFSIINSCVTVLLLTGFLATILMRVLKNDFVKYSHDEEAVDDQEETGWKYIHGDVFRYPKYKSLFSAVLGSGTQLLALAMFIFLLALVGVFYPYNRGALFTALVVIYALTSGIAGYTATSTYLQLEGTNWVRNLLLTGCLFCGPLFLTFCFLNTVAIAYSATAALPFGTILVILLIWTLVTAPLLVLGGIAGKNSKTEFQAPCRTTKYPREIPPLPWYRGTIPQMAMAGFLPFSAIYIELYYIFASVWGHKIYTIYSILFIVFIILIIVTAFITVALTYFQLAVEDHEWWWRSVLCGGSTGVFIFGYCLYYYHARSDMSGFMQTSFFFGYMTCICYGFFLMLGTVGFRASLLFVRHIYRSIKCE

SEQ ID NO: 3082 - protein, 585 aa, Pinus pinaster
MGRFLVLALALALLFGYGVEGSASDHRYSKGDHVPLYANKVGPFHNPSETYRYFDLPFCPPDKVTEKREDLGEVLNGDRMVGARYKLHFQEDKNSELLCRKKLTTEDLGKFREAVKKDYYFQMYYDDLPIWGFIGKTDKENNGVPILLYKHLHFEILYNNDRVIEITVRTDPNFTVDITEDKEVEVDFTYSVKWVETQTPFERRMDKYSKSSSLPQHLEIHWFSIINSCVTVLLLTGFLATILMRVLKNDFIKYSHDEESTDDQEETGWKYIHGDVFRYPPYKSLFCAVLGSGTQLFTLAIFIFMLALVGVFYPYNRGALYTALVVIYALTSGIAGYTAASFYRQLEGSNWVRNLLLTGCLFCGPLFLTFCFLNTVAIAYNATAALPFGTIVVILLIWTLVTSPLLVLGGIAGKNSKAEFQAPCRTTKYPREIPLLPWYRGTIPQMAMAGFLPFSAIYIELYYIFASVWGHKIYTIYSILFIVFIILIIVTAFITIALTYFQLAVEDHEWWWRSVLCGGSTGVFIFGYCLYYYFARSDMNGFMQTSFFFGYMTCICYGFFLMLGTVGFRASLLFVRHIYRSIKCE

SEQ ID NO: 3083 - protein, 592 aa, Amorphophallus konjac
MAEGMGAVVVVLGLLLFCGSRVEADGSDHKYHERDHVPLYANKVGPFHNPSETYRYYDLPFCAPDHVTDKKEALGEVLNGDRLVDAPYKLNFREDKQSKTICRKTLSKEDVAKLRDAVSKDYYFQMYYDDLPFWGFLGKVDKDDKLDPSDHKYLLFKHIHFDILYNDDRVIEINVQTDPNLAVDITEEKEVDVDFSYSVAWKSTEIPFEKRMEKYSKASSLPQHLEIHWFSIINSCVTVLLLTGFLATILMRVLKNDFTKYSHDEDSAEDQEETGWKYIHGDVFRFPDHKSLFSAVLGSGTQLLALSIFIFLLALVGVFYPYNRGALFTALVVIYALTSGIAGYTATSMYLQLEGTNWVRNLLWTGCLFCGPLFLTFCFLNTVAIAYSATAALPFGTILVIILIWALVTSPLLVLGGVAGKRSNTEFQAPCRTTKYPREIPALPWYRGTIPQMAMAGFLPFSAIYIELYYIFASVWGHKIYTIYSILFIVFIILIIVTAFITVALTYFQLAVEDHQWWWRSVLCGGSTGIFIFLYCFYYYHARSDMSGFMQTSFFFGYMACICYGFFLMLGTVGFRASLLFVRHIYRSIKCE

SEQ ID NO: 3084 - protein, 556 aa, Vinca minor
RSDAWDHKYKPGDQVPLYANKVGPFHNPSETYHYFDLPFCSPAHVKEKREALGEILNGDRLVVAPYKLEFLSDKDAEIVCKKKLSKEEFAQFQSAVSKDYYFQMYYDDLPLWGFLGKVDKEGRADPSEYKYYLFKHLHFEIFYNKDRVIEINARTDPNALVDITKEKEVDVDFMYSVKWKETSTAFEKRMEKYSQSSSLPHHLEIHWFSIINSCVTVLLLTGFLATILMRVLKNDLFKYAHDEDAADDQEETGWKYIHGDVFRYPKYKSLLAAALGSGSQLFTMTICIFILALVGVFYPYNRGALFTVLVIIYALTSGVAGYIASSFYCQLEGTNWVRNVLLTGGLFCGPLFLTFCFLNTVAIAYTATAALPFGTIVVIFLIWALITSSLLVMGGIAGKNSKAEFQAPCRTTKYPREIPPLPWYRGTLPQMAIAGFLPFSAIYIELYYIFASVWGHRIYTIYSILFTVFTYFQLAAEDHEWWWRSFLCGGSTGLFIYGYCLYYYYARSYMSGFMQTSFFFGYMACICYAFFLMLGTVGFRAALFFVRHIYRSIKCE

SEQ ID NO: 3085 - protein, 585 aa, Abies balsamea
MTRFLVLALSLVFVFAYGVEGSASNHKYSKGDHVPLYANKVGPFHNPSETYRYFDLPFCPPDKVTEKREDLGEVLNGDRMVDARYKLNFQENKNSEVLCKKKLTKEDLEKFREAVKKDYYFQMYYDDLPIWGFIGKADKENSADPFLLYKHLHFEIMYNNDRVIEISVRTDPSFSVDITEDKEIEVDFTYSVKWVETQIPFERRMDKYSKSSSLPQHLEIHWFSIINSCVTVLLLTGFLATILMRVLKNDFIKYSHDEESNDDQEETGWKYIHGDVFRYPPHKSLFCAVLGSGTQLFTLAIFIFMLALVGVFYPYNRGALYTALVVIYALTSGIAGYTAASFYRQLEGSNWVRNLLMTGCLFCGPLFLTFCFLNTVAIAYNATAALPFGTIVVILLIWTLVTSPLLVLGGIAGKNSKAEFQAPCRTTKYPREIPPLPWYRGTIPQMAMAGFLPFSAIYIELYYIFASVWGHKIYTIYSILFIVFIILIIVTAFITIALTYFQLAVEDHEWWWRSVLCGGSTGVFIFGYCLYYYFARSDMNGFMQTSFFFGYMACICYGFFLMLGTVGFRASLLFVRHIYRSIKCE

SEQ ID NO: 3086 - protein, 592 aa, Sequoia sempervirens
MAGSLNISTAILALVLAFVCGVNGGASDHKYSKGEHVPLYANKVGPFSNPSETYRYFDLPFCLPDKVNEKREDLGEVLNGDRMVDARYKLDFQENKDSELLCSKKLTKEDLEKFREAIKKDYYFQMYYDDLPIWGFIGKFEKESKAVPNGARYLLYKHIHFEIFYNNDRVIEINVRTDPSFTVDITEDKEVEVDFMYSVKWVETKVPFERRMDKYAKQSSLPQHLEIHWFSIINSCVTVLLLTGFLATILMRVLKNDFIKYSHDEESTDDQEETGWKYIHGDVFRYPRHKSLFCAVLGSGTQLFALAIFIFMLALVGVFYPYNRGALYTALVVIYALTSGIAGYTAASFYHQLEGSNWVRNLLLTGCLFCGPLFLTFCFLNTVAIAYNATAALPFGTIMVILLIWTLVTSPLLVLGGIAGKNSKAEFQAPCRTTKYPREIPPLPFYRGTISQMAMAGFLPFSAIYIELYYIFASVWGHKIYTIYSILFIVFIILIIVTAFITIALTYFQLAVEDHEWWWRSVLCGGSTGVFIFGYCLYYYFARSDMTGFMQTSFFFGYMACICYGFFLMLGTVGFRASLLFVRHIYRSIKCE

SEQ ID NO: 3087 - protein, 544 aa, Brachypodium distachyon
MYYDDLPLWGFIGKLEKTAKADPSEWKYYLYRHIIFDILYNNDRVIEITVHTDQSALVDLTEDKEANVEFLYTVKWKETATPFEKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKGPSRSPSGAPCSAPSSSGIATSTPPRTTRPRRPSATPLPTPCCRAPSHPGPTSSSPPSSGAATRTATGSSPPSSRLSET

SEQ ID NO: 3088 - protein, 317 aa, Cicer arietinum
SLWSSLFLPNPNKTNRFPTFSPANRKLSTAFAIPPLSTATAADVSGAIDGTTIAVVSGGFVAGLTALLSLTDPEKRRREQAEEVGGGDKEVVKEYFNNSGFQRWKKIYGDTDDVNRVQRDIRLGHSKTVENALQMLKDEGSLKGVTVCDAGCGTGSLSIPLAKEGAIVCASDISAAMVAEAEKQAKEQLVSSENGVSSLMPKFVVSDLESLDGKYDTVVCLDVLIHYPQNKADGMIAHLTSLAEKRLILSFAPKTFYYDALKRVGELFPGPSKATRAYLHSEGDIERALRKVGWTIKKRGLTTTQFYFSRLIEAVPM

SEQ ID NO: 3089 - protein, 324 aa, Cajanus cajan
MAFSSSLWSSLFVPNPNQTNILPRFSPKPSKLPLPPAFAIPPLSTAAAADVSGAIDGTTIAVLSGGFVAAVAAAVSLTDPERRRQMQAEEVGGGDKEVVREYFNNSGFQRWKKIYGDTDEVNRVQRDIRVGHAKTVENTLLMLKDEGSLQGVTVCDAGCGTGSLSIPLAKEGAVVYASDISAAMVAEAEKQAKEQLVGSENGSAPVIPKFVVKDLESLDGKYDTVVCLDVLIHYPQSKADGMIAHLASLANNRLILSFAPKTFYYDLLKRVGELFPGPSKATRAYLHSEADVERALRKVGWTIRKRGLITTQFYFAKLVEAVPM

SEQ ID NO: 3090 - protein, 324 aa, Lotus japonicus
MAFSPSLGSSLFAPNPNRTNRFPRFSPSPANPKLPLSTAFAIPPLSTATAADVTGAIDGTTLAVVSGGFVAGLAALLSLTDPERRRQTQAEEVGGGDKEVVREYFNNNGFQRWKKIYGDTDDVNRVQRDIRVGHAKTVENVLQMLKDEGSLNGVTVCDAGCGTGSLSIPLAKEGAVVLASDISAAMVSEAEKKAKDELVGSANGAVMPKFVVKDLESLDGKYDTVVCLDVLIHYPQSNADGMIGHLASLAENRLILSFAPKTFYYDLLKRIGELFPGPSKATRAYLHSEGDVERALQKVGWKIRKRGLIATQFYFAKLVEAVPM

SEQ ID NO: 3091 - protein, 324 aa, Vigna unguiculata
MAFSSSLWSSLIVPNPNRTTISPRFSHKPHKLPLSPAFAIPPLSTATAADVAGAIDGTTVAVVSGGFVAALAAVLSLTDPERRRQMQAEEVGGGDKEVVREYFNNSGFQRWKKIYGDTDEVNRVQRDIRLGHSKTVESTLNMLKDEGSLQGVTVCDAGCGTGSLSIPLAKEGAVVYASDISAAMVAEAEQQAKEQLVASENGSAPVLPKFVVKDLESLDGKYDTVVCLDVLIHYPQSKADGMIGHLASLANNRLILSFAPKTFYYDILKRIGELFPGPSKATRAYLHSEADVERALKKVGWTIRKKGLITTQFYFARLIEAVPM

SEQ ID NO: 3092 - protein, 324 aa, Phaseolus coccineus
MAFSSSLWSSLIVPNPNRTTSLPRFSHKPHKLPLSPAFAIPPLSTATAADVSGAIDGTTVAVVSGGFVAALAAVLSLTDPERRRQLQAEEVGGGDKEVVREYFNNSGFQRWKKIYGDTDEVNRVQRDIRLGHAKTVENTLNMLKDEGSLQGVTVCDAGCGTGSLSIPLAKEGAVVFSSDISAAMVAEAEKQAKEQLVADGNGSAPVLPKFVVKDLESLDGKYDTVICLDVLIHYPQSKADGMIGHLASLANNRLILSFAPKTFYYDILKRIGELFPGPSKATRAYLHSEADVERALKKVGWTIRKKGLITTQFYFAKLIEAVPM

SEQ ID NO: 3093 - protein, 324 aa, Glycine max
MAFSSSLWSSLFVANPNRTAISTRFSHKPPKLPLSPAFAIPPLSTATAADVSGAIDGTTIAVVSGGFVAALAAVLSLTDPERRRQLQAEEVGGGDKEVVREYFNNSGFQRWKKIYGDTDEVNRVQRDIRLGHAKTVENTLSMLKDEGSLQGVTVCDAGCGTGSLSIPLAKEGAVVFASDISAAMVAEAEKQAKEQLATSEDGSVPVMPKFVVKDLESLDGKYDTVVCLDVLIHYPQHKADGMIAHLASLANNRLILSFAPKTFYYDLLKRVGELFPGPSKATRAYLHSEADVERALQKVGWTIRKRGLTTTQFYFARLIEAVPM

SEQ ID NO: 3094 - protein, 325 aa, Glycine max
MAFSSSIWSSSIFVPNPNRTTISTRFSHTPSKPPLSPAFAIPPLSTATATDVSGVIDGTTIAVVSGGFVAALAAVLSLTDPERRRQMQAEEVGGGDKEVVREYFNNSGFQRWKKIYGDTDEVNRVQRDIRLGHAKTVENTLSMLKDEGSLQGITVCDAGCGTGSLSIPLAKEGAVVFASDISAAMVAEAEKQAKEQLVTSEDGSGPVMPKFVVKDLESLDGKYDTVVCLDVLIHYPQSKADGMIAHLASLANKRLILSFAPKTFYYDLLKRVGELFPGPSKATRAYLHSEADVERALQKVGWTIRKRGLTTTQFYFARLIEAVPM

SEQ ID NO: 3095 - protein, 329 aa, Arachis hypogaea
MAFSASFWSSLIPPNRGFRFARAPPANQKPTTKQHPLTTAFAIDPLSTATAAEVTGAIDGTTIAVIGGGSVAALAAVLSLSDPERRRKEQAEVVGGGDKEVVREYFNNTGFQRWKKIYGDTEDVNRVQLDIRLGHSKTVESTLMMLKDEGLLEGVTVCDAGCGTGSLAIPLAKEGAIVSASDISAAMVAEAEKQAKEQLGSSEDSVSPAAAMPKFVVKDLESLDGKYDTVVCLDVLIHYPQNKADGMIAHLASLASNRLILSFAPKTFYYDLLKRIGELFPGPSKATRAYLHSEADVERALQKVGWKIRKRGLITTQFYFAKLVEAVPM

SEQ ID NO: 3096 - protein, 440 aa, Medicago truncatula
MATLNVFSQPLHPTTISSSLCSSSSSNSTFSCHFSLLSSHSSPTLSKLSNHVHTHFSKSGNGSSWLQSSSTADSIAHKKGPVYSVFPSSPAQVSSVQDLYEFICSGPLLYKIGLTPEKVAESIDKWLSYGRQLCRLFQLNELFLTEPQKVRLYHYYIPVFLWCESEIAQHQAKFKDKEDIPPLVIGFSAPQGCGKTTLVFALDYLFQMIGRYAFSFEAILIEFIFYFDDYINFQEVCQNKLREANPGNALLEYRGNAGSHDLPFSVETLTALTKMSREGTKMKLPRYDKSAFGGRGDRADPSTWPEIEGPLTVVLFEGWMLGFKPLPVEAVKAVDPQLEIVNKNLKAYYDAWDKYIQSWIVIKIKDPSCVYQWRLQAEIAMREAGNPGMSDDEVRDFVSRYLPAYNAYLPTLYSEGPSGSDPQHLLNIEIDEKRNPILGV

SEQ ID NO: 3097 - protein, 414 aa, Cicer arietinum
MATLNVFSQTLHPTISSFCCFSNSNNSKFHFFSNSLSSHFSKSGSGSSWMQSSSPAASIEHKKGPVYSVFPSTPAQVSSVQDLFEFICSGPLVEKIGLTQEKVAESIDKWLSYGRQLCRLFQLNELFLTEPQKVRLYHYYIPVFLWCESEIVQHQSKFKDEEDIPPLVIGFSAPQGCGKTTLVFALDYLFQMIGRKSATISIDDFYLTAEGQNKLREANQGNALLEFRGNAGSHDLAFSVETLTALTKMSKEGTKMKLPRYDKSAFGGRGDRADPSTWPEIEGPLTVVLFEGWMLGFKPLPVDAVTSVDPQLETVNKSLEAYYDAWDKYIDSWIVIKIKDPNCVFQWRLQAEIAMREAGNPGMSDDEVRDFVSRYLPAYNAYLPTLYSQGPNGSDPQHLLSIEIDEKRNPILGV

SEQ ID NO: 3098 - protein, 222 aa, Medicago truncatula
MLKFSRMLHSSSRNHLLEVLYARDFSTATNNNYSAKGYTSDRIFAPYSVYKGKAAFSLSPCLPTFTKLDSGALVVDRHGSIMMSFMPAIGERKYDWEKRQIFALSATEVGSLIAIGPQDSCEFFHDPSMKSSNAGQVRKSLSIKPHSNGYFVSLSVVNSVLNTKDNFSVPVTTAEFAVMKTACSFALPHIMGWDRLTNQQSSGTVSFQPKMNSQILDLEWEK

SEQ ID NO: 3099 - protein, 225 aa, Trigonella foenum-graecum
MLKFSRILPSSSSSRNQLLEVLSARDFSTSTNNNYSAAKGYTSDRIFAPYSVYKGKAAFSLSPCLPTFTKLHSGSLVVDRRGSIMMSFVPAIGDRKYDWEKRQRFALSATEVGSLIAIGPQDSCEFFHDPSMKSSNAGQVRKSLSIKPHSNGYFVSLTVVNTVLNTKDNLSVPVTTAEFAVMKTACSFALPHIMGWDRLTNQQSSGTVSFQPKINSQSLDLEWEK

SEQ ID NO: 3100 - protein, 230 aa, Cicer arietinum
LSRALRSYSRHQLLEVVSSTKVEVAGFSTATNNYSAKGYNNNYNSSDRIFAPYSVYKGKAAFSLSPCLPTFTKLDSGALVVERRGSIMMSFMHAIGEHKYDWEKRQRFALSATEVGSLIAIGPQDSCEFFHDPSMKSSNAGQVRKNLSIKPHSNGYFVSLNVVNIVLNTKDSFSVPVTTAEFAVMKTACSFALPHIMGWDRLTNQQMQSNGTVGFQSKTNPQILDLEWDK

SEQ ID NO: 3101 - protein, 173 aa, Cicer arietinum
MDSSSSSSSANREGHYRGVRKRPWGRYAAEIRDPWKKTRVWLGTFDTPEEAALAYDGAARSLRGAKAKTNFPPAPVAAGLCLDLNAPSSDHRWPPVPSRSFVVTEFLQTGVLKDFNTPQPPPVAAVAGLRRHDGAFSVSGGVQVAEHTSTASYLGLVRRGIPIDLNEPPPLWL

SEQ ID NO: 3102 - protein, 167 aa, Lotus japonicus
MASSSSSASREGHYRGVRKRPWGRYAAEIRDPWKKTRVWLGTFDTPEEAALAYDGAARSLRGAKAKTNFPPAPLAAGLCLDLNAPSSDLHHHRWPSVPSRGLALSEFLHTGVLKDINPPQPPPVTVAVSAPYVTVAQVAEPSPTASFLGLIRRGIPIDLNEPPPLWL

SEQ ID NO: 3103 - protein, 181 aa, Medicago truncatula
MKILQDEIQNEVGNKRMVEEKDLKKLNYLDMVVDETLRLYPVAPLLVPPKCRENITIDDYFIKEKTRIMVNAWAIGRDPNVWSENAEEFYPKRFIEKKMNYQRQEFESLPFDYGRRRCPGIQLGLTTVKLVIAQFVHCFNWELSHNISPFNLNMEEKFGLTIPRAQHLHAIPSYRLDYAKH

SEQ ID NO: 3104 - protein, 464 aa, Medicago truncatula
MSFALTTTMFAFLLFTFMYFLFKLYLHPKQKTLNHKKPPGPPSLPIIGNLHILGKLPHRTLQSLSKKYGPIMSLQLGQVPTIIISSSKAAESFLKTHDIVFASRPKSQGSELMLYGSKGIVFSDYGPYWRSVRKFCTLKLLSASKVEMSGPIRKEELSILVNTLKKAALVGEVVNVSEVVENLIEDIVYKLMFGRSKYEQFDLKNLVQQELVLIGAFNLADYVPWTKAANVNKTHHKDFVDILLSIMHQTIDVEGEQNLVIDRSNIKAILLDMIVAAIDTSATSILMDEIQNEVGNKRMVEEKDLKKLNYLDMVVDETLRLYPVAPLLVPPKCRENITIDDYFIKEKTRIMVNAWAIGRDPNVWSENAEEFYPKRFIEKKMNYQRQEFESLPFDYGRRRCPGIQLGLTTVKLVIAQFVHCFNWELSHNISPFNLNMEEKFGLTIPRAQHLHAIPSYRLDYAKHK

SEQ ID NO: 3105 - protein, 362 aa, Cicer arietinum
MKFKDSADNHLSASEDLSNKKKNVFMIHRRRGGSSKKMYHSEWLDTIDSEPDIISMHLLPLTSLLLGIRGSGFVTHAINLYLRYKPPIEDLHQFFEFQLPRQWAPILSEMRLGSYWKHQMNTWLRFNIFGPKLYINTYPVDVGNRPVIGLRLQLEGRRSNRLAIHLQHLTSLPKSLPLADNANAYLSCDSYSCSFHKKVKWSCFSYICTAPVESDDSLSIVTGAQLQVEKKCLLLRLRFSKVIGATLQKPPEWDQSCNIGQFKSMSRGVLAFVPKEGQRGRPKPGDVTIGSTTYSAALPAPVNTPKLQRYVDITEMMRGPEDTPGYWVVSGARLYVQNGKIYLLVKYSLLNFVIMQCENEAS

SEQ ID NO: 3106 - protein, 487 aa, Cicer arietinum
LISSRHSPQFTPIQEEHEFDEYCSENRSQSRRTTPSGSTPKHQYHPPTPIVNKINKSNHKKKRSETEEDGSVSCNKCRPHSRDKIFILPFDHSNNNNSNNNKYSSLLQSPNGIFKSIVSKLTRKSPMSTTSTTTTNNNNNDPLSSSREEQWKIAVAELSHKLVHATRKRDEALQEASRLMHSMSELEKKLNKLELYCHSLKSGLEECSSINSPHVFDTKSLSNFHHVQDTDNVVQHFLVSVSEARSSVRLLSRSLTMQLRHIGSKVFEKVSLLLQPYDIKISFSKNPRSLLFYLEALLNKTFFEDFESIGFQKNAYNRILNPMERCEASLASFNMIHGLTWEEVLSKGTRHFSEDFSRFCDRKMSEIVAMLGWNRAWPEPLLQAFFVASKSVWMVHLLANSVHPSLPIFRVDKGVNFDSVYMEDMGGDKSSRLVPNMVRIMVAPGFYVYGSAVKCKVLCRYLTSANNNNINNHSYGNKENKGLTPSP

SEQ ID NO: 3107 - protein, 636 aa, Glycine max
MAVHPSVAAAPASLYVGDLHPDVSDSHLVDAFSEFKSLASVRVCKDSSTGKSLCYGYLNFVSPQDAIRAIELKNNSTLNGKAMRVMWSRRDPDARKSAIGNLFVKNLPESIDNAGLQDIFKKYGNILSSKVVTSEDGKSKGYGFVQFESEESSKVAIEKLNGYTVADKELYVGKFVKKSDRILPGPDARYTNLYMKNLDLDVSEATLQEKFSSFGKIVSLVIAKDNNGMSKGFGFVNYDNPDDAKKAMEAMNGSQLGSKILYVARAQKKAEREQILHHQFEEKQKEQILKYKGSNIYVKNIDDHVSDEELRDHFSACGTITSAKIMRDDKGISKGFGFVCFSTPEEANKAVNTFHGFMYHGKPLYVALAQRKEDRKAQLQLQYAQQLARLSGPSTAIIPSGYPPYYYAASGVISHVPPRAGLMYQHLALRPGWGANGFAPPARSFQQSPVPAVSNNTRQHRQNRGKLNGNSIAQGNTHSGTYLPQAQQISQPVISSRDSSTQQRTGQARYIPSGRQRDVEKGSGSSSVGSNSGRGGSQGSEMLHSLLAGAAPEQQKEILGEHLYMLVHKLKPTLAAKITGMLLEMDNGELLLLLESPESLSAKVEEAVQVLKNSKTKVSGQDVLHSNFLSAEVAVN

SEQ ID NO: 3108 - protein, 646 aa, Glycine max
MAVPPSVAAAPASLYVGDLHPNVSDNHLVDAFSDFESLASVRVCKDSSTGKSLCYGYVNFVSPQDAIRAIELKNNSTLNGKAMRVMWSRRDPDARKNAIGNLFVKNLPESIDNAGLQDMFKKYGNILSSKVVMSEDGKSKGYGFVQFESEESSNVAIEKLNGSTVGDKQLYVGKFVKKSDRILPGPDARYTNLYMKNLDLDVSEATLQEKFSSFGKIVSLVIAKDNIGMSKGFGFVNYDNPDDAKRAMEAMNGSKLGSKILYVARAQKKAEREQILHHQFEEKRKEQILKYKGSNIYVKNIDDHVSDEELRDHFSACGIITSAKIMRDDKGISKGFGFVCFSTPEEANKAVNTFHGFMFHGKPLYVALAQRKEDRKAQLQLQYAQQVAGLSGPSTAIIPGGYPPYYYAATGVISHVPPRAGLMYQHLPMRPGWGANGFALPARSFQQSPVPAVSNNTRQHRQNRGRLNGNPIAQGNTHSVTYLPQAQQISQPVISSSTQQRTGQAKYLPSGRQRDMEKGSGSSSSGSNSGRGSQGSEMLHSMLAGAAPEQQKEILGEHLYMLLLKVKFLNSYVYLLCYVEQPTLAAKITGMLLEMDNGELLLLLESPESLSAKVEEAVQVLKNSKTKVSGQDVLHSNFLSAEVAVN

SEQ ID NO: 3109 - protein, 131 aa, Medicago truncatula
MTSITSSIATLVTPLPLFMNTKNKIQSRSSKMTRIRCDVGEEDSSSSTAKIGSRVRVKVPLKVYHVPKVPEVDLTGREGQIKQNVTFWKDNKRISANLPYKVEFVADDIQGPRGPLKFVAHLKDDEFEFLE

SEQ ID NO: 3110 - protein, 349 aa, Triticum aestivum
MRLHGDVSDDEEEGAVMDPALLSSSSPPAGAAAAAASRLVVGYALTKKKVKSFLQPKLLLLARKKGISFIPIDETRPLSEQGPFDIILHKKTSKEWQRFLEDYHEVHPEVTVLDPPNAIEHLNNRQSMLEEVADLNLSSFYEEVCTPRQLVIMKDPSSIPTAVAMAGLTLPLVAKPLVVDGTSKSHELSLAYDEASLPMLDPPLVLQEFVNHGGILFKVYIIGEAIQVVRRFSLPDVNTYDLLNNVGIYRLPRVSCAAASADHADLDPRIAELPPRPLLEKLGRELRGRLGLRLFNIDMIRELGANDRYYIIDINYFPGYGKMPGYEHIFTDFLQSLGQNKYQRCLSGG

SEQ ID NO: 3111 - protein, 349 aa, Secale cereale
MRLHGDVSDDEEEGAVMDPALLSSSSPPAGAAAAAAPRLVVGYALTKKKVKSFLQPKLLLLARKKGISFISIDETRPLSEQGPFDIILHKKTSKEWQRFLEDYHEVHPEVTVLDPPNAIEHLNNRQSMLEEVADLNLSSFYEEVCTPRQLVIMKDPSSIPTAVAMAGLTLPLVAKPLVVDGTSKSHELSLAYDEASLSMLDPPLVLQEFVNHGGILFKVYIIGEAIQVVRRFSLPDVNTYDLLNNVGIYRLPRVSCAAASADHADLDPRLAELPPRPLLEKLGRELRGRLGLRLFNIDMIRELGANDRYYVIDINYFPGYGKMPGYEHIFTDFLQSLGQNKYQRCLSGG

SEQ ID NO: 3112 - protein, 348 aa, Sorghum bicolor
MRLHAEVRDEMEESEEGAVMSSAALSPIIGAAAPAPRLVVGYALTKKKVKSFLQPKLLLLARKNGISFVSIDESLPLSEQGPFDVILHKITRKEWQQVLEDYHEEHPEVTVLDPPNAIKHLNNRQSMLEEVADLNLSNFYGEVCTPRQLVITEDPSSIPTAVAMAGLTLPLVAKPLVVDGTSKGHELYLAYDEASLSMLDPPLVLQEFINHGGILFKVYIIGETIQVVRRFSLPDVNTYDLLNNVGVYRLPRVSCAAASAEDADLDPLIAELPPRPLLEKLGRELRGRLGLRLFNIDMIRELGTKDRYYIIDINYFPGYGKMPGYERMFTDFLLSLAQSKYKRYLSGT

SEQ ID NO: 3113 - protein, 386 aa, Zea mays
MRLHAEVRDEMEEGSEEGAVTASAGLSPPPLIGAAAPVPRLVVGFALTKKKVKSFLQPKLLLLARKNGISFVSIDESLPLSEQGPFDVILHKITRKEWQKVLEDYHEEHPEVTVLDPPNAIEHLNNRQSMLEEVADLNLSNFYGEVCIPRQLVITKDPSSIPTSVAMAGLTLPLVAKPLVVDGTSKGHELYLAYDEASLSMLDPPLVLQEFINHGGILFKVYIIGETIQVVRRFSLPDVNTYDLLNNVGIYRLPRVSCAAASADDADLDPLIAELPPRPLLEKLGRELRGRLGLRLFNIDMIRELGTKDRYYIIDINYFPGYGKMPGYERMFTDFLLSLAQSKYKRYASPPRQCTFAGDISISGRLEEVGKSQCVCSKSVAHAGLE

SEQ ID NO: 3114 - protein, 353 aa, Setaria italica
MRLHADVLDQMEGEGEEGAAMASSVLSPPLMGAAAAAATAPRLVVGYALTKKKVKSFLQPKLLQLARKNGITFVSIDESLPLSEQGPFDVILHKITSKEWQQVLEDYHEEHPEVTVLDPPNAIEHLNNRQSMLEEVADLNLSNLYGEVCTPRQLVITKDPSSIPTAVSMAGLTWPLVAKPLVVDGTSKGHELYLAYDEASLSMLHPPLVLQEFINHGGILFKVYIIGETVKVVRRFSLPDVNAYDLLNNVGVYRLPRVSCAAASADDAELDPLIAELPPRPLLEKLGRELRSRLGLRLFNVDMIRELGTKDRYYIIDINYFPGFGKMPGYEIMFTDFLLSLAQSKYKKYLSGT

SEQ ID NO: 3115 - protein, 344 aa, Panicum virgatum
EMEGQEEEGAAMASTVLSPPLVGAAVAAATAPRLVVGYALTKKKVKSFLQPKLLMLARRNGISFVSIDESLPLSEQGPFDVILHKITSKEWQQVLEDYLEEHPEVTVLDPPNAIEHLNNRQSMLEEVADLNLSNFYGEVCTPRQLVITKDPSSIPTAVAMAGLTFPLVAKPLVVDGTSKGHELYLAYDEASLSMLHPPLVLQEFINHGGILFKVYIIGETVQVVRRFSLPDVNTYDLLNNVGIYRLPRVSCAAASADDADLDPLIAELPPRPLLEKLGRELRSRLGLRLFNVDMIRELGNKDRYYIIDINYFPGFGKMPGYEHMFTDFLLSLAQSKYKRYLSGT

SEQ ID NO: 3116 - protein, 344 aa, Oryza sativa
MHRFSLCCVVLLVLAPLAAVAWRPWPPRNGSGEVEGIGASKKFEGSSDFVKLQYHMGPVLAADITVHPIWYGRWPAEQKRTIRAFLRSLSPPGSGSGDGGIPSPSVAAWWRTVRLYTDQTSANVSGVVRLGREKCDARASRGGRLTRLDIQSVVRDAVTARTRPLPVDSSGVYLVLTSPEVVVENFCGQVCGFHYFTFPSVVGYTLPYAWVGNSAARCPEVCAYPFAIPSYVGGGRRAEAPPNGDVGVDGMVSVIAHELAELASNPLANAWYAGEDPSFPTEIADLCEGIYGTGGGGAYTGQLLTDGRSGASYNVNGVGGRKFLVQWVWNPILSYCSGPNALDQ

SEQ ID NO: 3117 - protein, 345 aa, Triticum aestivum
MPHRGAVLVFVLALAAAPLAVAWRPWPPRDASGALAGLGASKKFEGSSDFVKLEYHMGPVLAADITVHPIWYGAWPAEQKRTIRAFLRSLSPQASGEKEGAVPSPSVADWWRTVRLYTDQTTANVSAVVALGQEKCDARMSRGASLSRMDIQTVVKDAVTARTRPLPVDAGGVYLVLTSPEVRVENFCGQVCGFHYFTFPSVVGYTLPYAWVGNSAGRCPEVCAYPFAIPAYVPGRRPEAPPNGDPGVDGMVSVIAHELAEMASNPLANAWYAGGDPSFPTEIADLCEGIYGTGGGGAYTGQLLTDGRSGASYNLNGVGGRRFLVQWVWDPYRSYCSGPNALDQH

SEQ ID NO: 3118 - protein, 341 aa, Sorghum bicolor
MQHLGVLLVLAALTASPLAAAWRPWPPRANGTTAGLGASKKFEGSSEFVKLEYHMGPVLASAITVHPIWYGAWPAAQKRTIRAFLRSLAPPPDSSARIPPPSVSAWWRTVRLYTDQTSANVSAAVTLGAEKCDARMSRGARLSRMDIQSVVRDAVTARTRPLPVDSSGGVYLVLTSPDVSVEDFCGQVCGFHYFTFPSVVGYTLPYAWVGNSARRCPEVCAYPFAIPSYVPGRKAEAPPNGDVGVDGMVSVIAHELAELASNPLANAWYAGSDPSFPTEIADLCEGIYGTGGGGAYTGQLLTDARSGAAYNVNGVGGRRFLVQWVWNPVLSYCSGPNALDQ

SEQ ID NO: 3119 - protein, 333 aa, Triticum aestivum
ALAAAPLAVAWRPWPPRDASGALAGLGASKKFEGSSDFVKLEYHMGPVLAADITVHPIWYGAWPAEQKRTIRAFLRSLSPQASGEKEGAVPSPSVADWWRTVRLYTDQTTANVSAVVALGQEKCDARMSRGASLSRMDIQTVVKDAVTARTRPLPVDAGGVYLVLTSPEVRVENFCGQVCGFHYFTFPSVVGYTLPYAWVGNSAGRCPEVCAYPFAIPAYVPGRRPEAPPNGDAGVDGMVSVIAHELAEMASNPLANAWYAGGDPSFPTEIADLCEGIYGTGGGGAYTGQLLTDGRSGASYNLNGVGGRRFLVQWVWDPYRSYCSGPNALDQH

SEQ ID NO: 3120 - protein, 344 aa, Setaria italica
MRHLGLLLLVAALLAAPPAVSAWRPWPPRNETGGGAASGLGASKKFEGSSEFVKLQYHMGPVLATAITVHPIWYGPWPVEQKRTIRAFLRSLAPPPEEEARIPRPSVAAWWRTVRLYTDQTDANVSAAVSLGAEKSDARMSRGARLSRMDIQAVVRDAVGARTRPLPVDSGGVYLVLTSPEVVVEDFCGQVCGFHYFTFPSVVGYTLPYAWVGNSARRCPEVCAYPFAIPAYVHGRRPESPPNADVGVDGMVSVIAHELAELASNPLANAWYAGTDPSFPTEIADLCEGIYGTGGGGAYTGQLLTDARSGAAYNVNGAGGRRFLVQWVWNPVLSYCSGPNALDQ

SEQ ID NO: 3121 - protein, 342 aa, Panicum virgatum
MRRLAALLVAALLAAPPAVAAWRPWPPPRNGTAVEGLGASKKFEGSSEFVKLQYHMGPVLAASITVHPIWYGPWPAPQKRTIRAFLRSLAPPPAEEARIPRPSVAAWWRTVRLYTDQTGANVSAAVSLGAEKSDARMSRGARLSRMDIQAVVRDAVAARTRPLPVDAGGVYLVLTSPEVLVEDFCGQVCGFHYFTFPSVVGYTLPYAWVGNSARRCPEVCAYPFAIPAYVPGRRPESPPNADVGVDGMVSVIAHELAELASNPLANAWYAGTDPSFPTEIADLCEGIYGTGGGGAYTGQLLTDARSGAAYNVNGAGGRRFLVQWVWNPVLSYCSGPNALDQD

SEQ ID NO: 3122 - protein, 343 aa, Saccharum officinarum
MQQHLCVLLVLAALTASPLAAAWRPWPPRDNATTAAGLGASKKFEGSSEFVKLEYHMGPVLASAITVHPIWYGAWPAAQKRTIRAFLRSLAPPPDSEARIPPPSVSAWWRTVRLYTDQTLANVSAAVSLGAEKCDARMSRGARLSRMDIQAVVRDAVTARTRPLPVDSSGGVYLVLTSPEVSVEDFCGQVCGFHYFTFPSVVGYTLPYAWVGNSARRCPEVCAYPFAIPAYVPGRKPEAPPNGDVGVDGMVSVIAHELAELASNPLANAWYAGSDPSFPTEIADLCEGIYGTGGGGAYTGQLLTDARSGAAYNVNGAGGRRFLVQWVWNPVLSYWSGPNALDQ

SEQ ID NO: 3123 - protein, 349 aa, Brachypodium distachyon
MPSPPAPPAMRCLFFFLLAAPLASAWRPWPPRNGSSNAASGIGVSKKFEGSSDFVKLEYHMGPVLAADITVHPIWYGAWPATQKRTIRAFLRSLSPEAQSAAAIPSPSVAAWWRTVRLYADQTDANVSAVVNLGQEKSDTRMSRGASLTRLDIQRVIHDAVTARTKPLPVDSSGGLYLVLTSPEVHVETFCGQVCGFHYFTFPSIVGYTLPYAWVGNSAARCPEICAYPFAIPSYVANGRKPEMAPNGDVGVDGMVSVIAHELAEAASNPLANAWYAGGDPSFPTEIADLCEGIYGTGGGGAYTGQLLTDGRSGAAYNVNGVRGRRFLVQWVWDPYRSYCSGPNALDHQ

SEQ ID NO: 3124 - protein, 337 aa, Hordeum vulgare
MPQRGGAPLLLLLALAAAPLAMAWRPWPPRDAVAALGASKKFEGSSDLVKLEYHMGPVLAADITVHPIWYGAWPADQKRTIRAFLRSLSPQSPVPSPSVADWWRTVRLYTDQTTANVSAVVALGQEKCDVRMSRGASLSRMDIQSVVKDAVTARTRPLPVDAGGVYLVLTSPEVRVESFCGQVCGFHYFTFPSVVGYTLPYAWVGNSAGRCPEVCAYPFAIPAYVPGRRPEAPPNGDPGVDGMVSVIAHELAEMASNPLANAWYAGGDPSFPTEIADLCEGIYGTGGGGAYTGQLLTDGRSGASYNLNGVGGRRFLVQWVWDPYRSYCSGPNALDHH

SEQ ID NO: 3125 - protein, 309 aa, Triticum aestivum
MKAWAYEEYGDASVLKLDEAVSVPAVGEDQVLVRVAAAALNPVDSKRRMGKFKATDSPLPTVPGYDMAGVVVKVGSQVKNLKEGDEVYGHISEKVLEGPKQFGSLAEYTAVEEKLVALKPKSIDFAQAAGLPLAIETAHEGLERAGFSAGKSILVLGGAGGVGTLVIQLAKQVYGASKVAATASTPKLELLKSLGADVAIDYTKENFEDMPEKYDVVFDAVGQGEKAVKVVKEGGSVVVLTGAVAPPGFRFVVTSDGSVLAKLNPYLESGKVKPVVDPKGPFPFSQVVEAFSYLETGRATGKVVISPVP

SEQ ID NO: 3126 - protein, 323 aa, Zea mays
MFHRLLRRAMPLPPPQSPLPAPRMPGVTGGRLFASLPSPPPLQSRREVHVWYLLPDELKDASQLKMYTELLSPSERKTALSMNGEKLQKGAVLSRALLRTTLSRYTDCKVDPRSFEFKKNKFGKPEVLWRSDDSRMEWPLHFNISHTSSLIVCGITMDTPIGIDVEEKTRKTAKNILSLARRYFTPSEIDYLAKIPDPDAQQKEFVKLWTLKEAYVKALGRGFSGAPFNKFSIILAANGRIQISVAPKVSNGSDSIHDCLSENWQFALAELNSSHYMAICIEDDSTSSDSGNGRLPLGLKVWKTTPFVEDILVSGTEAVKLVS

SEQ ID NO: 3127 - protein, 298 aa, Saccharum officinarum
PSPTTGQHCWRSRNPSPSSPSPAPRTPGVAGGRLFASLPPPPPPRSRREVHVWYLLPDELNDASQLKMYTELLSPSERKTALSMNGEKLQKGAVLSRALVRTTLSRYTDCKVDPRSFEFKKNKFGKPEILWRSDDSRMERPLHFNISHTSSLIACGITMGTPIGIDIEDKKRKTAKNILSLARRYFTPSEIDYLAKIPDPDGQQKEFIKLWTLKEAYVKALGRGFSGAPFNKFSIILAANNRIKISVAPKVSNDSDSKCDCLSENWQFAVAELNSSHYMAICIEDDSISQILGTVDCH

SEQ ID NO: 3128 - protein, 323 aa, Setaria italica
MRHLLLRRRAMPLPPPASPPPPRMPGVAGARLFSSLPPPLPLQSRREVHVWYLLPDELNDASQLKMYMDLLSPSERKAALAMNGEKFQKGAVLSRALVRTTLSRYTDCKVDPRSFEFKKNKFGKPEILWQPDDNRMGWPLHFNISHTSSLIACGVTMDTPIGIDIEEKKRKTKKNFLSLARRYFTPSEVDYLDKIPDPDAQQKEFIKLWTLKEAYVKALGRGFSGAPFNKFSIVLAAKNGIQISVAPKVFNDSDSCDCLSENWQFALAELNNSHYMAVCVEDDSRSSDSGNGRRLPLALKIWKTVPFLEDTLVSGTEAVTLIS

SEQ ID NO: 3129 - protein, 264 aa, Panicum virgatum
MRRRLLRRAMPLPPPTPPAPRTPGIAGGRLFSSLRPPPPPLQSQREVHVWYLLPDELNDASQLKIYMDLLSPSERKNALSMNTEKLQKGAVLSRALVRTTLSRYTDCKVDPGSFEFKKNKFGKPEILWQSDDNKIEWPLHFNISHTSSLIACGITMDNPIGIDIEEKKRKTAKNILSLARRYFTPSEVDYLAQIPDPDAQQKEFIKLWTLKLLEWDFQVLLSISSQSKWKQRTESEFLWHQKYSRILTLLVTVCPRIGNLHLRS

SEQ ID NO: 3130 - protein, 319 aa, Setaria italica
MRQCLLRRAMPLPPPPPPRTPGVTGGRLLSSLSPPPRLQSRREVHIWYLSPDELNDASQLKMYMELLSPSERKNALSMNGENLQKVAVLSRALVRTTLSRYTDCKIDPRLFEFKKNKFGKPEILWRADDDRIEWPLHFNISHTSSLIACGVTMDAPIGIDIEEKKRNTAKNVLSLADRYFTPSEFDHLVNLPDPDAQQKEFIKLWTLKEAYVKALGRGFSGAPFNKFSIILAANNGIQISVEPKALNDSNSSCDCLSENWKFALAELYGSYYMAACMEDDSRSSGSEDDRSPLGLKVWKTIPFLEDILVSGTEAVKFIS

SEQ ID NO: 3131 - protein, 559 aa, Zea mays
MRRSRSCLSCVPMGTAALPIENHFVAPAALPSVPASDSEDGGFGKGSIDLGGLEVRQVTTFAKVWSTTQGGQDGLGATFFKPSPVPAGFSVLGHYAQPNNRPLFGHVLVGRDTSGAGGALLAAPVDYALVWSSPDGAGHFWLPTAPEGYKAVGVVVTAAADKPSPDEVRCVRADFTDACEAEDSVWSSDKDGFSASTLRPAVRGIEARGVHAGTFLAQSSATPAAAAGVSTTLACLKNNSASYTSSMPDLAQLNSLLAAYAPHVYLHPNEPYFPSSVAWFFENGALMYQKGSSQTPTPVAADGSNLPQGGGNDGGYWLDLPADGNQREKAKRGDLAGAKVYVQAKPMLGGTVADLAVWIFYPFNGPARAKVGLIPSIPLGEIGEHVGDWEHVTLRVSNFSGELLRMYFSQHSAGTWVDASRLEYLDGGDGGGSRPVAYASLHGHAFYPNAGTVLQGNSGLGIGIRNDCARGSRLDTGAGRCEVVSAEYLGVKEPAWLGFEREWGPRDEYDIGREINRAARLLPRSVRERLAKLVEKVLVGEGPTGPKMHGNWRNDEREA

SEQ ID NO: 3132 - protein, 553 aa, Setaria italica
MQRSKSCLPCVPMGTAALPIEKHFVPPVALPSWPASVSDGGFAKGSIDLGGLEVRQITTFAKVWSTTQGGEDGVGATFFKPSPVPAGFSVLGHYAQPNSRPLFGHVLVARDTSGTGALLAAPVDYNLVWSSPDGAGHFWLPTAPDGYKAVGAVVTATSDKPSPDEVRCVRADFTDACETEKPELSNSDKDGFSAATLRPAVRGIDARGVHAGTFLAQSSVTPANASSLACLKNNSASYTSAMPDLAQVNSLLAAYAPHVYLHPNESYFPSSATWFFENGALLYQKGSQIPTPVAADGSNLPQGGGNDGGYWLDLPADNKQREKVKKSDLASAKVYVQAKPMLGGTVTDLAVWIFYPFNGPARAKVGFLTIPLGEIGEHVGDWEHVTLRVSNFSGELRRMYFSQHSAGTWVEASQLEYLDAGDGGNRPVAYASRHGHALYPKAGLVLQGDSRLGVGIRNDTSRGSRLDTGGAGRCEVVSAEYLGVAEPAWLGFERGWGPKEEYVIGRVINRVAWILPRSVRERLAKLVEKVFVGDGPTGPKMHGNWRNDEREAR

SEQ ID NO: 3133 - protein, 119 aa, Zea mays
MDRSKSYAGGRMQIEPYYDGGGARPDFRSYSYSAGGSGMGTSSYAYQYEYGGAGAGAGEEMKRSKSKRRWLALADPDMERKRRVAAYKAYGVEGKMKGSFRKSFKWIKDRYLNLVYGWS

SEQ ID NO: 3134 - protein, 122 aa, Setaria italica
MDRSKSYAGGRMQIEPYYGGGARPDFRSYSYSAGGGGGMGMSSYSYQYEYGGGAAGAAADGDLKRSKSSKRRWLALGDPDMERKRRVAAYKAYAVEGKVKGSFRKSFKWIKDRYLHLVYGWS

SEQ ID NO: 3135 - protein, 130 aa, Panicum virgatum
MDRSKSYAGGRMQIEPYYGSGGGARPDFRSYSYSAGGGVGGGMGMSSYSYQYEYGYGGGAAGAGAAADGDLKRSKSSKRRWLALGDPDLDRKRRVVAYKAYAVEGKVKGSFRKSFKWIKDRYLHLVYGWS

SEQ ID NO: 3136 - protein, 232 aa, Saccharum officinarum
MSSLRNAIPRRAHKERSQPEARKKFGLLEKHKDYVVRARAYHIKEATIAKLKEKAAFRNPDEFYFKMINSRTVGGIHRPKPEDNKYTEEELLLLKNKDMGYILQSVQSEKKKIEKLRSTLHELDNKPQNKHVYFAEDREEAKEIQSRIGQSSNMPGFDNIPSRIKKKTASSYRELEERKQRLQKLEKLYADMALQKELKKPGRKRKLKLNEDEETDNQTSQPVYKWRAQRKR

SEQ ID NO: 3137 - protein, 232 aa, Zea mays
MSSLRNAIPRRAHKERAQPEARKKFGLLEKHKDYVVRARAYHIKEATIAKLKEKAAFRNPDEFYFKMINSRTVGGIHRPKPEDNKYTEEELLLLKNKDMGYILQSVQSEKKKIEKLSSTLHELDNKPQNKHVYFAEDREEAKEIQSRIGQSSNMPDLDNIPSRIKKKIASSYRELEERKQRLQKLEKLYADMALQKELKKPGRKRKLKLHEDEETDNQTSRPVYKWRAQRKR

SEQ ID NO: 3138 - protein, 229 aa, Setaria italica
MSSLRNAIPRRAHKERAQPEARKKFGILEKHKDYVVRATAYHRKEKIIAKLREKAAFRNPDEFYFKMINNRTVGGVHRPKPEDNKYTEEELLLLKNKDMGYIFQSIQSEKKKIEKLSSTLHELDTKRPNKHVYFAEDREEAKEIRSRIGESSNMPSFDNIPSRIKKKTASSYRELDERKQRLQKLEKLYGDMALQKELKKPGHKRKLREDETVNPTSQPVYKWRAQRKR

SEQ ID NO: 3139 - protein, 229 aa, Pennisetum glaucum
MSSLRNAIPRRAHKERAQPEARKKFGILEKKKDYVVRAKAYHRKEEIIAKLKEKAAFRNPDEFYFKMINSRTVGGVHRPKPEDNKYTEEELLLLKNKDMGYILQSIQSEKKKIEKLSSTLHELDAKRPNKHVYFAEDREEAKEIRSRIGESSNKPSFDNIPSRIKKKTASSYRELDERRQRLQKLERLYGDMALQKELKKPGRKRKLREDEMVNPTSQPVYKWRAQRKR

SEQ ID NO: 3140 - protein, 229 aa, Panicum virgatum
MSSLRNSIPRRAHKERAQPEARKKFGLLEKHKDYVVRAKAYHRKEEIIGKLKEKAAFKNPDEFYFKMINSRTVGGVHRPKPEANKYTEEELLLLKNKDMGYILQSIQSEKKKIEKLSSTLHELDTKRPNKHVYFAEDREEAKEIQSRIGECSNTPGFDNIPSRIKKKTASSYRELEERKQRLQKLEKLYGEMALQKELKKPGRKRKLREDEMVSPTSQPVYKWRAQRKR

SEQ ID NO: 3141 - protein, 229 aa, Oryza sativa
MSSLRNAIQRRAHKERAQPESRKKFGLLEKHKDYIVRAKAFHQKEETIRKLKEKASFRNPDEFYFKMINSKTVDGIHRPKPEANKYTEDELMLLKTKDMGYILQGIQSEKKKIEKLSSMLHELDNKRPNKHVYFAEDREEVKEIQSRIEQKSSSLGLDNIPSRIKRKTASSYRELEERKQRVQKLEKLYADMALQKELKKPGRKRKLREDEIENQTSRPVYKWRAQRKR

SEQ ID NO: 3142 - protein, 228 aa, Brachypodium distachyon
MSSLRNAISRRAHKERAQPEARKKFGLLEKHKDYVVRAKAFHRKEDFIRKLKEKASFKNPDEFYFKMINSRTVDGVHKAKPENEYTEEELLLLKNKDMGYILQGIQSEKKKIERLSSTLHQLDNKRSNKHVYFAEDREEAKEIQSRIEQSSNATHFGNIPSRIRRKTASSYKELEGRKLRVQKLEKLYADMALQKELKKPGRKRKLREEEMENPTSQPVYKWRAQRKR

SEQ ID NO: 3143 - protein, 243 aa, Cynodon dactylon
MSSLRNAIPRRAHKERAQPGARKKFGLLEKHKDYVVRARAYHRKEETIRKLKEKAAFKNPDEFYFKMINTKTVDGIHKPKPEANKYTEEELMLIKNKDMGYILQCIQSEKKKVEKLNSVLHELDSKRPNKHIYFAEDREEAKAIQSRIEESSNVPVLSNIPSRIKKKTASSYRELEERKQRLQKLERLYADMALKKELQKPGHKRKLREDEIENPTSQPVYKWRAQRKQYDDLNGWKMKEKWY

SEQ ID NO: 3144 - protein, 229 aa, Avena sativa
MSSLRNAISRRAHKERSQPEARKKYGLLEKRKDYIIRAKAFHRKEDLIRNLKEKASFRNPDEFYFKMINSKTVDGIHRPKPETNKYTEEELMLLKHKDMGYILQAIQSEKKKIERLSSTLHELDNKPSNKHVYFAEDREEAKEIHSRIEESSSTPDFGNIPARIKKKTASSYKELEARKLRVQKLEKLYADMALQKELKKPGRKRKLREEEIENPTSQPVYKWHAQRKR

SEQ ID NO: 3145 - protein, 610 aa, Setaria italica
MGPGGVARLACVLLLAAAAAGHAGVQPLSRIAIHRARVALDASAAVRASPALLGTQGEDTAWVTVDFVAPHPSGDDWIGIFSPSNFNASTCPGSHGSGPGPVICSAPIKYQFANYSSDYGTSGKGTLKFQLINQRQDFSFALFTGGLSNPKLIAVSNAIAFANPKAPVYPRLAQGKSWNEMTVTWTSGYDISEAYPFVEWGMKGRPAVRTAAGTITFDRESICGEPARSVGWRDPGFIHTAFLTDLWPNKEYYCKIGHMLPDGNVTWGKFSSFRAPPYPGQKSLQRVVIFGDMGKAERDGSNEYSNYQPGSLNTTDTLIKDLDNIDIMFHIGDISYANGYISQWDQFTQQVEAITSRVPYMIASGNHERDWPNSGSFFNGTDSGGECGVLAETMYYTPTENRANYWYSTDYGMFRFCIADSEHDWREGTEQYKFIENCFATVDRKNQPWLIFIAHRVLGYSSGYFYGIDGAFAEPTSRQSLQKLWQKYRVDMAFYGHVHNYERTCPVYEEQCMSSEKSHYSGTMNGTIHVVVGGGGSHLSNFTTEVPAWSIYREMDYGFVKLTAFNYTSLLYEYKRSSDGKVYDSFTVHREYKDVLACVKDSCPPTIPAT

SEQ ID NO: 3146 - protein, 611 aa, Zea mays
MRPAEGAARLVCLLLLAAVAAGHAGVQPLARIAIHRARFALDASAAVRASPELLGTKGEDTAWVKVDLVTPHPSADDWVGVFSPSKFNASTCLGSHGSGPGPVICSAPIKYQFANYSSGYGESGKGALQFQLINQRQDFSFALFTGGLSNPKLIAVSNAIAFANPKAPVYPRLAQGKSWNEMTVTWTSGYESDEAYPFVEWGMKWSPPVRSAAGTVTFDRESVCGEPARSVGWRDPGFIHTAFLTDLWPNKEYYYKIGHMLPDGSVVWGKLSSFKAPPFPGQKSLQRVVIFGDMGKAERDGSNEYSNYQPGSLNTTDTLVKDLDNIDMVFHIGDITYANGYISQWDQFTQQVEEITSRVPYMVASGNHERDWPNSGSFFNGTDSGGECGVVAETMYYTPTENRANYWYSADYGMFRFCVADSEHDWREGTEQYEFIESCLATVDRKKQPWLVFIAHRVLGYSSGFFYGVDGSFAEPMSRQSLQKLWQKYRVDLAFYGHVHNYERTCPVYEEQCMSSEKSHYSGTMNGTIHVVVGGGGSHLSNFTAQVPPWSVYREMDYGFVKLTAFNYSSLLYEYKRSSDGQVYDSFTMHREYRDLLACVKDSCPPTSPAT

SEQ ID NO: 3147 - protein, 630 aa, Oryza sativa
MAMPLGGILLLFLVLLAAAAAGGGGGVWAFSSSSSSSSYSRIGEQPLSLIGIHRATVGIDAAASVQASPRLLGVKGEDTAWVTVDFAAPHASDGDWIGVFSPSNFNASTCPGPSGSDSGPVICSAPIKYQLANYSSDYGKTGKGTLKFQLINQRQDFSFALFTGGLSNPKLIAVSNKIAFANPKAPVYPRLAQGKSWNEMTVTWTSGYDIKEAYPFVEWGMKWSPPTRTAAGTVTFDRESLCGEPARTVGWRDPGFIHTAFLTDLWPNKEYYYKIGHMLPDGKIVWGKFYSFKAPPFPGQKSLQRVVIFGDMGKAERDGSNEYSNYQPGSLNTTDTLIKDLDNIDIVFHIGDITYANGYISQWDQFTQQVEPITARVPYMIASGNHERDWPNSGSFFNGTDSGGECGVLAETMYYTPTENRANYWYKTDYGMFRFCVADSEHDWREGTEQYAFIESCLATVDRKKQPWLVFIAHRVLGYSSGFFYGAGGAFAEPTARQSLQRLWQRHRVDLAFYGHVHNYERTCPVYDGRCASPERSRYSGAVGGTIHAVVGGGGSHLSNFTAEAPPWSVYREMDYGFVKLTAFNYTSLLYEYRRSSDGEVHDSFTVHREYRDVLACVADSCPPTIPPAT

SEQ ID NO: 3148 - protein, 549 aa, Pennisetum glaucum
WVTLDFVAPHPSGDDWIGVFSPSNFNASTCPGSHVSDPGPVICSAPIKYQFANYSSDYGISGKGTLKFQLINQRQDFSFALFTGGPSNSKLIAISNAIAFANPKAPVYPRLAQGKSWNEMTVTWTSGYGISEAYPIVEWAMKGRPSVRTAAGTVTFDRESICGEPARSVGWRDPGFIHTAFLTDLWPNKEYYYKIGHMLPDGNVTWGKFSSFRAPPSPGQKSLQRVVIFGDMGKAERDGSNEYSNYQPGSLNTTDTLIKDLNNIDIMFHIGDISYANGYISQWDQFTQQVEAITSRVPYMIASGNHERDWPNSGSFFNGTDSGGECGVLAETMYYTPTENRANYWYLTDYGMFRFCIADSEHDWREGTEQYKFIENCFATVDRKKQPWLIFMAHRVLGYSSGYFYGIDGTFAEPSSRQSLQKLWQKYRVDIAFYGHVHNYERTCPIYDEKCMSSDKSHYSGTMNGTIHVVVGGGGSHLSNFTIEVPAWSIYREMDYGFVKLTAFNYTSLLYEYKRSSDGKVYDSFTVHREYKDVLACVKDSCPPTIPAR

SEQ ID NO: 3149 - protein, 586 aa, Zea mays
MSGGASLGLRSSGSYGSLPQQQLGGCQSSSPPLAARKPAKMSLGGTSGPRVCARICKLAGRRQRMLLLLLVSVAVAFCFLFSSLVSKDEDASPGVETMLVFSDHVRSFVNPVWTSSGRPVAQRGSLTVNGLNTPSQMEKQSDSKQVQELMQSFPPAIVVDHHPCENFSLSPPPVDRKRTGPRPCPVCYLPVEQALALRPAKPSLSPVLQSLNYVLEEILIPKESKSGSLFGGFPSLEERDKSYDIKDSMTVHCGFVRGKVPGLNTGFDIDEADHSEMQLCQSTVVASAIFGNYDVMQQPENISKFSKDTVCFFMFLDEETEAAIKNTTIGHTKKIGLWRVVVVRNLPFTDARRNGKVPKLLLHRLFPNARYSIWIDGKLKLVRDPYQVLERFLWRKNVSFAISRHYRRFDVFEEAEANKAGGKYDNTSIDYQIEFYKREGLTHYSSAKLPITSDVPEGCVIIREHIPITNLFTCLWFNEVDRFTSRDQLSFSTVRDKIRWRVNWTADMFLDCERRDFVVQSYHRELLEQRQSALRRWPPQRSPVARFQPRKMLPDNAAREPWKASATKKLSRKRARDKKSSSRRTH

SEQ ID NO: 3150 - protein, 612 aa, Setaria italica
MSGGASLGLRSSGSYGSLLQQQLGGCHSSPSPAPSASPPLAARKPAKMSLGGAGGGGGPRVFARICKLAGRRQRMLLLLLVAVAVAFCFLFSSLVSKDEDASPGVETMLVFSDHVRSFVNPVWTSSGRPVAQRDSLTVNGLNTASQMEKQSDSSRKQVQSPMRRFPPAVVLNHHPCENFSLSPPPIDRKRTGPRPCPVCYLPVEQALALRPAQLSASPVLQSLNYISEANLVSEESNGGSLFGGYPSLEERDKSYDIKDLTTVHCGFVRGKIPGLNTGFDIDEADRSEMQQCERTVVASAIFGNYDILQQPENISDFSKDTVCFFMFLDEETEAALKNSTTIDHTKRIGLWRVVVVRNLPYSDARRNGKVPKLLLHRLFPNVRYSIWIDGKLKLVRDPYQVLERFLWRKNVSFAVSRHYRRFDVFEEAEANKAGGKYDNASIDYQIEFYKSEGLTHYSSAKLPITSDVPEGCVIIREHIPITNLFTCLWFNEVDRFTSRDQLSFSTVRDKIRSRVNWTADMFLDCERRDFVVQSYHRELLEQRQATLRSRPPLRPPMVQIQPRKMLPDNAAKEPGKASSAKKLPGKRTRDKKSSSKRAHQTKVIGGKEAIQL

SEQ ID NO: 3151 - protein, 546 aa, Zea mays
MSLGGTSGPRVCARICKLAGRRQRMLLRLLVSVAVAFCFLFSSLVSKDEDASPGVETMLVFSDHVRSFVNPVWTSSGRPVAQRGSLTVNGLNTPSQMEKQSDSKQVQELMQSFPPAIVVDHHPCENFSLSPPPVDRKRTGPRPCPVCYLPVEQALALRPAKPSLSPVLQSLNYVLEEILIPKESKSGSLFGGFPSLEERDKSYDIKDSMTVHCGFVRGKVPGLNTGFDIDEADHSEMQLCQSTVVASAIFGNYDVMQQPENISKFSKDTVCFFMFLDEETEAAIKNTTIGHTKKIGLWRVVVVRNLPFTDARRNGKVPKLLLHRLFPNARYSIWIDGKLKLVRDPYQVLERFLWRKNVSFAISRHYRRFDVFEEAEANKAGGKYDNTSIDYQIEFYKREGLTHYSSAKLPITSDVPEGCVIIREHIPITNLFTCLWFNEVDRFTSRDQLSFSTVRDKIRWRVNWTADMFLDCERRDFVVQSYHRELLEQRQSALRRWPPQRSPIARFQPRKMLPDNAAREPWKASATKKLSRKRARDKKSSSRRTH

SEQ ID NO: 3152 - protein, 886 aa, Zea mays
MRAVLLLALLLSACAAAAAQGANSTAFVPRDDIRLDCGAKGQGNDTDGRVWTGDAGSKYAPPDNLASVASASGQDPSVPQVPYLTARVSASPFTYSFPLGPGRKFLRLHFYPANYTDRDAADGLFSVSVAAPGGNLTLLSNFSAYQTAAAITYSYLIREFSVNVSSPTLDLTFTPEKAHPNAYAFVNGIEVVSSPDLFDISTPNMLAGDGNLQPFPIDAGTAMQTMYRLNVGGQAISPSKDTGGYRSWDDDSSYIFGASFGVSYPKDSKVTITYPSNVPEYVAPEDVYGTARSMGPDKNVNMNYNLTWMLEVDAGFMYLIRMHFCEIQYPITKINQRVFNIYINNQTAVKGADVNAWAAVSGATTLIGTPVYQDYVVSTTGLGAMDLWVALHPNPDSKPQIYDAILNGMEVFKLQLTNGSLAGLNPVPSVAPVPDGTTKKKSSVGPIVGGVVGGLVVLALGYCCFVICKRRRNAGKDAGMSDGHSGWLPLSLYGNSHTSSSAKSHTTGSYASSLPSNLCRHFSFAEIKAATNNFDESLILGVGGFGKVYRGEVDGGTTKVAIKRGNPLSEQGVHEFQTEIEMLSKLRHRHLVSLIGYCEEKNEMILVYDYMAHGTLREHLYKTQKPPLTWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLPKEEVSLAEWALHCQKKGILDQIVDPYLKGKIAPQCFKKFAETAEKCVSDQGIDRPSMGDVLWNLEFALQMQEGAEESGSLGCGMSDEGAPLMVGKKDPNDPSIESSTTTTTTTSISMGDQSVASIDSDGLTPSAVFSQIMNPKGR

SEQ ID NO: 3153 - protein, 888 aa, Zea mays
MRALLLLALLLATCAAAAAQAANSTAFVPRDDILLDCGAKGQGNDTDGRVWTGDAGSKFAPPDNLASVASASGQDPSVPQVPYLTARVSASPFTYSFPLGPGRKFLRLHFYPANYSNHDAADGLFSVSVAVPGGKLTLLSNFSAYQTAAAITYSYLIREFSVNVSSATLDLTFTPEKGHPNAYAFVNGIEVVSSPDLFDISTPNMVTGDGNLQPFPIDAGTAVQTMYRLNVGGQAISPSKDTGGYRSWDDDTAYIFGAGFGVSYPKDNNVTITYPSNVPEYVAPEDVYGTARSMGPDKNVNMNYNLTWMLQVDAGFMYLIRLHFCEIQYPITKINQRVFSIYINNQTAVKDADVNAWATMSGATTLIGTPVYQDYVVTTSGLGAMDLWIALHPNPDSKPQIYDAILNGMEVFKLPLTNGSLAGLNPIPSVAPMTGGTAKKKSTVGPIVGGVIGGLVVLALGYCCFFVICKRKRSAGKDAGMSDGHSGWLPLSLYGNSHTSSSAKSHTTGSYASSLPSNLCRHFSFAEIKAATNNFDESLILGVGGFGKVYRGEVDGGTTKVAIKRGNPLSEQGVHEFQTEIEMLSKLRHRHLVSLIGYCEEKNEMILVYDYMAHGTLREHLYKTQKPPLTWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLPKEEVSLAEWALHCQKKGVLDQIVDPYLKGKIAPQCFKKFAETAEKCVSDQSIDRPSMGDVLWNLEFALQMQESAEESGSLGCGMSDEGTPLVMVGKKDPNDPSIESSTTTTTTTSLSMGDQSVASMDSDGLTPSAVFSQIMNPKGR

SEQ ID NO: 3154 - protein, 884 aa, Setaria italica
MRALLLLALLLAACAAAAAQAAGGRNSTAFVPRDDILLDCGAKGQGNDTDGRMWGGDEGSKYAPPSNLAAAAPASGQDPSVPQVPYLTARVSASPFTYSFPLGPGRKFLRLHFYPANYSNRDAADGVFSVSVGKLTLLSNFSAYQTAAAITFSYLVREFSVNVSSTLDLTFTPEKSHPNAYAFVNGIEVVSSPDLFGLTPPNMVTGDGNNQPFSIDASVAMQTMYRLNVGGQAISPSKDTGGYRSWDDDSPYIFGASFGVSYPSDPNVTITYPSNVPEYVAPMDVYSTARSMGPDKNVNLNYNLTWMLQVDAGFNYLVRMHFCEIQYPITKINQRVFDIYINNQTAMNGADVIAWASVSGATTGIGTPVYQDYVVSTYGLGPMDLWVALHPDVDSKPERYDAILNGLEVFKLQLSNGSLAGLNPIPSVEPTDDGETKKKSAVGPIVGGVVGGLVLLALGYCLFVFCRRRSAGKDAGMSDGHSGWLPLSLYGNSHTSSSAKSHTTGSYASSLPSNLCRHFSFAEIKAATNNFDESLILGVGGFGKVYRGEVDGGTTKVAIKRGNPLSEQGIHEFQTEIEMLSKLRHRHLVSLIGYCEEKNEMILVYDYMAHGTLREHLYKTQKPPLTWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIAPQCFKKFAETAEKCVSDQGIDRPSMGDVLWNLEFALQMQESAEESGSLGCGMSDEGTPLVMVGKKDPNDPSIESSTTTTTTTSISMGDQSVASMDSDGLTPSAVFSQIMNPKGR

SEQ ID NO: 3155 - protein, 665 aa, Pennisetum glaucum
MQTMYRLNVGGQAISPSKDTGGYRSWDDDSPYIFGASFGVSYQSDPNVTITYPSNVPEYVAPMDVYSTARSMGPDKNVNVNYNLTWMLQVDAGFDYLVRMHFCEIQYPITKPNQRVFDIYINNQTAMNGADVILWASLSGATTYIGTPVYQDYLVSTYGLGPMDLWVALHPDVDSKPERYDAILNGLEVFKLQLSNGSLAGLNPIPSVEPTEEGENKKKSTVGPIVGGVVGALVLLAFGYCLLVFCRRRRSAGKDAGMSDGHSGWLPLSLYGNSHTSSSAKSHTTGSYASSLPSNLCRHFSFAEIKAATNNFDESLILGVGGFGKVYRGEVDGGTTKVAIKRGNPLSEQGIHEFQTEIEMLSKLRHRHLVSLIGYCEEKNEMILVYDYMAHGTLREHLYKTQKPPLTWRQRLDICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIAPQCFKKFAETAEKCVSDQGIDRPSMGDVLWNLEFALQMQESAEESGSLGCGMSDEGTPLVMVGKKDPNDPSIESSTTTTTTTSISMGDQSVASMDSDGLTPSAVFSQIMNPKGR

SEQ ID NO: 3156 - protein, 865 aa, Oryza sativa
AAAPAPAAGAGPFVPRDDILLDCGATGKGNDTDGRVWSGDAGSKYAPASLGSASAAGQDPSVPQVPYLTARVSAAPFTYSFPLGAGRKFLRLHFYPANYSSRDAADARFSVSVPAANVTLLSNFSAYQTATALNFAYIVREFSVNVTTPTMELTFTPEKGHPNAYAFVNGIEVVSSPDLFDISTPNLVTGDGNNQPFPIDAGTALQTMYRLNVGGQAISPSKDTGGYRSWDDDSPYVFGAAFGVSYPKDDNVTIAYPSNVPEYVAPVDVYATARSMGPDKNVNLAYNLTWIMQVDAGFTYLVRLHFCEIQYPITMINQRVFNIYINNQTAFQGADVIAWTNNNGIGSPVYQDFVVTTVGSGAMDLWVALYPDVQAKPQYYDAILNGLEVFKLPLSNGSLAGLNPVPTVEPSLDGGAVKKSSVGPIVGGVIGGLVVLALGYCCFMICKRRSRVGKDTGMSDGHSGWLPLSLYGNSHSSGSAKSHTTGSYASSLPSNLCRHFSFAEIKAATNNFDESLLLGVGGFGKVYRGEIDGGVTKVAIKRGNPLSEQGVHEFQTEIEMLSKLRHRHLVSLIGYCEEKNEMILVYDYMAHGTLREHLYKTKNAPLTWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGDQSVASIDSDGLTPSAVFSQIMNPKGR

SEQ ID NO: 3157 - protein, 896 aa, Oryza sativa
MGSSRFVLLLLLLLAVAACVARGQGGGNSSSAAAPAPAAGAGPFVPRDDILLDCGATGKGNDTDGRVWSGDAGSKYAPASLGSASAAGQDPSVPQVPYLTARVSAAPFTYSFPLGAGRKFLRLHFYPANYSSRDAADARFSVSVPAANVTLLSNFSAYQTATALNFAYIVREFSVNVTTPTMELTFTPEKGHPNAYAFVNGIEVVSSPDLFDISTPNLVTGDGNNQPFPIDAGTALQTMYRLNVGGQAISPSKDTGGYRSWDDDSPYVFGAAFGVSYPKDDNVTIAYPSNVPEYVAPVDVYATARSMGPDKNVNLAYNLTWIMQVDAGFTYLVRLHFCEIQYPITMINQRVFNIYINNQTAFQGADVIAWTNNNGIGSPVYQDFVVTTVGSGAMDLWVALYPDVQAKPQYYDAILNGLEVFKLPLSNGSLAGLNPVPTVEPSLDGGAVKKSSVGPIVGGVIGGLVVLALGYCCFMICKRRSRVGKDTGMSDGHSGWLPLSLYGNSHSSGSAKSHTTGSYASSLPSNLCRHFSFAEIKAATNNFDESLLLGVGGFGKVYRGEIDGGVTKVAIKRGNPLSEQGVHEFQTEIEMLSKLRHRHLVSLIGYCEEKNEMILVYDYMAHGTLREHLYKTKNAPLTWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPHLKGKIAPQCFKKFAETAEKCVSDEGIDRPSMGDVLWNLEFALQMQESAEDSGSIGCGMSDEGTPLVMPGKKDPNDPSIESSTTTTTTTSISMGDQSVASIDSDGLTPSAVFSQIMNPKGR

SEQ ID NO: 3158 - protein, 898 aa, Brachypodium distachyon
MGRSPRCVLLLLLAACAAALVPAAGAQGGGNSTAPAPAAAGSAPFVPRDDILLDCGATGNGNDTDGREWGGDAGSKYAPANLGSAIAGAQDPSVPQVPYLTARVSAAPFTYSFPLGPGRKFLRLHFYPANYSNRNAADAFFSVTVPAAKVTLLSNFSAYQTSTALNFAYLIREFSVNVTGQTLDLTFTPEKGHPNAYAFINGIEVVSSPDLFDLSTPELVMGDGNNQPYTMEAGTALQTMYRLNVGGQAISPSKDTGGYRSWDDDTPYIWGAGAGVSYQNDANVTITYPDNVPGYVAPTDVYATARSMGPDKDVNLAYNLTWIMQVDAGFFYLVRLHFCEIQSPITKPNQRVFDIYINNQTAMAGADVILWASPNGIGSPVYKDYVVNTMGSGTMDFWVALHPDVTQKPQYFDAILNGMEVFKLQQSNGSLVGLNPVPSAEPLVDGGSGKKKSTVGPIVGGVVGGLAVLALGYCFIVICKRRRRAGKDAGMSDGHSGWLPLSLYGNSHTSGSAKSHTTGSYASSLPSNLCRHFSFAEIKAATKNFDESLILGVGGFGKVYRGEVDGGTTKVAIKRGNPLSEQGIHEFQTEIEMLSKLRHRHLVSLIGYCEEKNEMILVYDYMAHGTLREHLYKTQNAPLSWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIVPQCFKKFAETAEKCVADNGIERPSMGDVLWNLEFALQMQESAEESGSIGCGMSDEGTPLVMVGKKDPNDPSIDSSTTTTTTTSISMGDQSVASIDSDGLTPSAVFSQIMNPKGR

SEQ ID NO: 3159 - protein, 891 aa, Secale cereale
MRGGPRCALLLLLAAAAAFVPAARAQGATAPAPSAGAPFVPRDDILLDCGATGKGNDTDGRQWDGDAGSKYAPPNLASASAGAQDPSVPQVPYLTARVSAAPFTYSFPLGPGRKFLRLHFYPANYSNRDAADAFFSVSVPAAKVTLLSNFSAYQTTTALNFAYIVREFSVNVTGQNLDLTFTPEKGHPNAYAFINGIEVVSSPDLFDLATLQFVTGDGNSQPYEMDPAAALQTMYRLNVGGQAISPSKDSGGARSWDDDTPYIYGAGAGVSYQNDPNVTITYPDNVPGYVAPSDVYATARSMGPDKGVNMAYNLTWILQVDAGYQYLVRLHFCEIQSPFTKPNQRVFNIYLNNQTAMQGADVIQWADPNGIGTPVYKDYVVSTVGSGIMDFWVALHPDAETKPQYYDAILNGLEVFKLQLTNGSLVGLNPVPSADPPAGSGSGDKKSIVAPIVGGVIGGLAVLALGYCCFICKRRRKAAKASGMSDGHSGWLPLSLYGHSHTSSSAKSHATGSYASSLPSNLCRHFSFAEIKAATKNFDESRILGVGGFGKVYHGEIDGGTTKVAIKRGNPLSEQGIHEFQTEIEMLSKLRHRHLVSLIGYCEEKNEMILVYDYMAHGTLREHLYKTQNAPLSWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIVPQCFKKFAETAEKCVADNGIERPSMGDVLWNLEFALQMQESAEESGSIGCGMSDEGTPLVMAGKKDPNDPSIDSSTATTTTTSLSMGDQSVASIDSDGLTPSAVFSQIMNPKGR

SEQ ID NO: 3160 - protein, 889 aa, Secale cereale
MGGGPRCALLLLAACVALVPAAWAQGSTAPAPSGAPFVPRDDILLDCGATGKGNDTDGREWRGDAGSKYAPPNLASADAGAQDPSVPQVPYLTARVSAAAFTYSFPLGPGRKFLRLHFYPANYSNRDAADALFSVSVPAAKVTLLSNFSAYQTTTALNFAYIVREFSVNVTGPTLDLTFTPEKGHPKAYAFINGIEVVSSPDLFDLATPLFVTGDGNNQPFPMDPGAALQTMYRLNVGGQAISPSKDSGGARSWDDDTPYIYGAGAGVTYPNDPNVTITYPDNVPGYVAPSDVYATARSMGPDKDVNLAYNLTWIVQVDAGFTYLVRLHFCEIQSPITLPNQRVFNIYLNNQTAVEGADVIQWVDPLSTGTPLYKDYVVSTVGSGIMDFWVALHPNTGSKPQYYDAILNGMEVFKLQLSNGSLAGPNPVPSADPPAHTGQGKKNSLVGPIAGGVIGGLAVLALGYCCFICKRRRKAAKDTGMSDGHSGWLPLSLYGNSHTSSSAKSHGTGSIASSLPSNLCRHFSFAEIKAATKNFDESRILGVGGFGKVYQGEIDGGTVKVAIKRGNPLSEQGIHEFQTEIEMLSKLRHRHLVSLIGYCEDKNEMILVYDHMAHGTLREHLYKTQNAPLSWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIVPQCFKKFAETAEKCVADNGIERPSMGDVLWNLEFALQMQESAEESGSFGCGMSDEGTPLVMAGKKDPNDPSIDSSTTTTTTTSLSMGDQSVASIDSDGLTPSAVFSQIMNPKGR

SEQ ID NO: 3161 - protein, 892 aa, Oryza sativa
MVSSRFVAVLLLVALAPAARGQGGGGGNSSAPAASPPGPFVPRDNILLDCGATGQANDTDGRLWTGDTGSKYLPANLAAAAATAQDPSVPQVPYLTARFSAAPFTYSFPVGAGRKFLRLHFYPANYSNRNAADALFSVSIPDPNITLLSNFSAYQTALALNFDYLVREFSVNVTASTLDLTFTPEKGHPNAFAFVNGIEVVSSPDLFGSSNPMEVTGDGSGTPFPIDAGTAMQTMYRLNVGGNAISPSKDTGGYRSWEDDTPYIPFASFGVSYANDTNVPINYPDSIPQYVAPADVYSTARSMGPDNNVNLQYNLTWAMQVDAGYQYLVRLHFCEIQSGISKINQRTFDIYINNQTAFSGADVIAWSTGLGIPVYKDFVVFPMGSGPMDLWVDLHPNVKNKPQYYNAILNGMEVFKLQLTNGSLAGLNPVPSIVPTASGGNSGKKSSVGPIIGGVIGGLVVLALGCCCFFVICKRRQRAGKDSGMSDGHSGWLPLSLYGNSHTSSSAKSHTTGSHASSLPSNLCRHFSFVEIKAATNNFDESLLLGVGGFGKVYRGEIDGGATKVAIKRGNPLSEQGVHEFQTEIEMLSKLRHRHLVSLIGYCEEKNEMILVYDYMAHGTLREHLYKTQNAPLSWRQRLDICIGAARGLHYLHTGAKHTIIHRDVKTTNILLDEKWVAKVSDFGLSKTGPTMDHTHVSTVVKGSFGYLDPEYFRRQQLTDKSDVYSFGVVLFEVLCARPALNPTLAKEEVSLAEWALHCQKKGILDQIVDPHLKGKIAPQCFKKFAETAEKCVSDQGIDRPSMGDVLWNLEFALQMQESAEESGSLGCGMSDDSTPLVIVGKKDPNDPSIESSTTTTTTTSISMGEQSVASIDSDGLTPSAVFSQIMNPKGR

SEQ ID NO: 3162 - protein, 849 aa, Triticum aestivum
DILLDCGATGKGNDTDGREWRGDAGSKYAPPNLASADAGAQDPSVPQVPYLTARVSAAPFTYSFPLGPGRKFLRLHFYPANYSGRAAADAFFSVSVPAAKVTLLSNFSAYQTATAFNFAYLVREFSVNVTGPTLDLTFTPEKGRPNAYAFINGIEVVSSPDLFDLATPFFVTGDGNNQPFPMDPGAALQTMYRLNVGGQAISPSKDSGGARSWDDDTPYIYGAGAGVSYPNDPNVTITYPPSVPGYVAPLDVYATARSMGIDKGVNLAYNLTWIVQVDAGFTYLVRLHFCEIQSPIDKPNQRVFNIYLNNQTAVEGADVLQWVDPRSTGTPLYKDFVVGTVGSGIMDFWVALHPDIRNKPQYYDAILNGMEVFKLQLTNGSLAGPNPVPSADPAAHTGQGKKSSLVGPIAGGVIGGLAVLALGYCCFICKRRRKVAKDAGMSDGHSGWLPLSLYGNSHTSSSAKSHATGSIASSLPSNLCRHFSFAEIKAATKNFDESRILGVGGFGKVYQGEIDGGTTKVAIKRGNPLSEQGIHEFQTEIEMLSKLRHRHLVSLIGYCEDKNEMILVYDHMAHGTLREHLYKTQNAPLSWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIVPQCFKKFAETAEKCVADNGIERPSMGDVLWNLEFALQMQESAEESGSFGCGMSDEEGAPLVMAGKKDPNDPSIDSSTTTTTTTSLSMGDQSVASIDSDGLTPSAVFSQIMNPKGR

SEQ ID NO: 3163 - protein, 850 aa, Triticum aestivum
TTSCSTAAPREGERHGRPPRGTATPGSKYAPPNLASASPGAARTPPVPQVPYLTARVSAAPFTYSFPLGPGRKFLRLHFYPANYSNRDAADAFFSVSVPAAKVTLLSNFSAYQTTTALNFAYIVREFSVNVTGQNLDLTFTPEKGHPNAYAFINGIEVVSSPDLFDLATPQLVTGDGNSQPYEMDPAAALQTMYRLNVGGQAISPSKDSGGARSWDDDTPYIYGAGAGVSYQNDPNVTITYPDNVPGYVAPSDVYATARSMGPDKGVNMAYNLTWILQVDAGYQYLVRLHFCEIQSPFTKPNQRVFNIYLNNQTAIEGADVIQWADPNGIGTPVYKDYVVSTVGSGILDFWVALHPDAETKPQYYDAILNGMEVFKLQLTNGSLVGLNPVPSADPPAHSGSGDKKSKVAPIVGGVIGGLAVLALGYCCFICKRRRKAAKASGMSDGHSGWLPLSLYGHSHTSSSAKSHATGSYASSLPSNLCRHFSFAEIKAATKNFDESRILGVGGFGKVYHGEIDGGTTKVAIKRGNPLSEQGIHEFQTEIEMLSKLRHRHLVSLIGYCEDKNEMILVYDHMAHGTLREHLYKTQNAPLSWRQRLEICIGAARGLHYLHTGAKHTIIHRDVKTTNILLDEKWVAKVSDFGLSKTGPSMDHTHVSTVVKGSFGYLDPEYFRRQQLTEKSDVYSFGVVLFEVLCARPALNPTLAKEEVSLAEWALHCQKKGILDQIVDPYLKGKIVPQCFKKFAETAEKCVADNGIERPSMGDVLWNLEFALQMQESAEESGSFGCGMSDEGTPLVMAGKKDPNDPSIDSSTTTTTTTSLSMGDQSVASIDSDGLTPSAVFSQIMNPKGR

SEQ ID NO: 3164 - protein, 223 aa, Glycine max
MEKAESSASTSEPDSDDNHHRHPTNHHLNPPSGLTPLEFASLVPSVAEHHSYLVGPGQCSSLLAQRVHAPPDAVWSFVRRFDKPQTYKHFIKSCAVKEPFHMAVGVTRDVNVISGLPAATSTERLDFLDDVRRVTGFSIIGGEHRLRNYRSVTTVHSFDDDNASADGKIYTVVLESYVVDVPDGNTEEDTRLFADTVVKLNLQKLASVTEGTNGDGDGKPHSR

SEQ ID NO: 3165 - protein, 219 aa, Vigna unguiculata
MEKGESSASTSEPDSDDNHRIPTNHHLNPPSGLTPHEFSSLVPSITEHHTYLVGPGQCSSLLAQRVQAPPEAVWSVVRRFDKPQTYKHFIKSCAVKDPFHMAVGVTRDVNVISGLPAATSTERLDLLDDDRRVTGFSIIGGEHRLSNYRSVTSVHAFDSDADAKIYTVVLESYIVDVPDGNTEEDTRLFADTVVKLNLQKLATVTEGTNRDGDHKPHSR

SEQ ID NO: 3166 - protein, 219 aa, Phaseolus coccineus
MEKGESSATTSEPDSDDNHRIPTNHHLNPPFGLTPHEFGSLVPSITEHHIYLVGPGQCSSLLAQRVQAPPEVVWSVVRRFDKPQTYKHFIKSCAVKEPFHMAVGVTRDVNVISGLPAATSTERLDYLDDDRRVTGFSIIGGEHRLRNYRSVTTVHAFDSDADAKIYTVVLESYIVDVPDGNTEEDTRLFADTVVKLNLQKLATVTEGTNRDGDYKPHSR

SEQ ID NO: 3167 - protein, 221 aa, Cajanus cajan
MEKGESSASTSEPDSDESRHPTAHHLTPPAGLTPDEFVSLVPSVMEHHTYLMGPGQCSSLLAQRVHAPPDAVWSVVRRFDKPQAYKHFIKSCAVKHPFHMAVGCTRDVNVISGLPAATSTERLDLLDDLRRVTGFSIIGGEHRLRNYRSVTTVHSFHHHDDDDDDKIYTVVLESYIVDVPDGNTEEDTRLFADTVVKLNLQKLASVTEGTNRDGDAKPHVR

SEQ ID NO: 3168 - protein, 95 aa, Glycine max
MARSFSNLKVLSALVADGFSNTLTRRGYAVATQSATRGGAASISGKSGEDKVLGGGAEKVSWVPDPVTGYYKPENIKEIDVAELRATVLGKKFNH

SEQ ID NO: 3169 - protein, 97 aa, Cajanus cajan
MARSFSNVKVLSALVADGLSNTLTRRGYAAATQSATRGGGGSISGKIAPKSGEDKVGGAEKVSWVPDPVTGYYKPENTKEIDVAELRATLMRKKFNH

SEQ ID NO: 3170 - protein, 99 aa, Phaseolus coccineus
MARSFTTVKVLSALVADGFSNTLTRRGFAAAAATQSATRGGGASISGNITPKSGEEKGRGAEKVSWVPDPVTGYYKPENTNEIDVADLRAMVLGKKFNH

SEQ ID NO: 3171 - protein, 97 aa, Vigna unguiculata
MARSFANVKVLSALVADGFSNTLTRRGFAAAATQSATRGGASIGGNMVPKSGEEKVRGGEKVSWVPDPVTGYYRPENTNEIDVADLRAMVLGKKFNH

SEQ ID NO: 3172 - protein, 99 aa, Phaseolus coccineus
MARSFTTVKVLSALVADGFSNTLTRRGFAAAAATQSATRGGGASISGNRTPKSGEEKGRGAEKVSWVPDPVTGYYKPENTNEIDVADLRAMVWGKKFNH

SEQ ID NO: 3173 - protein, 196 aa, Phaseolus coccineus
  misc_feature (196)..(196): Xaa can be any naturally occurring amino acid
MQNLKLQLLLLLSLSTFQAVFSFTNGLLPNGNFERGPKASEMKGSVVIGQNAIPNWTITGLVEYIKSGQKQGDMLLVVPEGDYAVRLGDEASIKQKVKLNEGFFYAITFGAARTCAQEEKLNVSVVPTTEKRDWGIIPIQTMYGSNGWESFTCGFRADFPEAEIVIHNPGKEEDPACGPLIDQLPSRFWTPQKNQX

SEQ ID NO: 3174 - protein, 292 aa, Cajanus cajan
MANKYHVRSISLPTRSHPSTIRVEEELSKLKIWEETSTSISTLDSIHTGLSLLEDLYLSLDDLLNMASTQQVISHHRGDKCVEEVLDGSVRILDTCGITRDTMLQIKENVQALHSALRRRKGESCVETSVAEYKLFTKMMKKNANKLITSLKQMDGKFGVSPLLGLDHHLGAVIRVLREAILINLSVFQFILSFLTMSSSNSKGTKWLVVAKLMHKGVKPCEENSENVNELQCVEAALSTLLNEGANDEKMQVAHERLEALENATESVENGLESVFRRLIKTRASLLNIISQ

SEQ ID NO: 3175 - protein, 291 aa, Phaseolus coccineus
MANKYHVRSISLPSRSHPSTIRVEEELSKLKTWEGTSTSSSHSIQTALSLLKDLYLALDDLLNMSSTQQVISLHKGDKCVEEVLDGSMRILDMCGITRDTMLQIKENVQALHSALRRRKGDSSVETSVAEYKLFAKKMKRNVNKLITSLKQMDGKFGVSPLLDLDHHLACVTRVLREVIVINLSVFQSILSFLAMSSSNSKATTKWFLVAKFMHKGVKPSEENSENENELQCVEIALSTLLNEGTHDDNIRVAHERLEALENAIESVENGLESVFRRLIKTRASLLNIISQ

SEQ ID NO: 3176 - protein, 443 aa, Glycine max
MVDLDWQTKMVHSNMPPKSPKLSLPDNNIPIPLRQNDITAASSPICAAYDNYLRLPELRALWASNDFPNWANEPILKPTLHALEITFRLLATVLSDPRPYINKREWTRRVESLATAQIQIIAMLCEDEEENPETRGTTPPVSDINGFIAQSRSYSEESLLPRLATWHKSKDVARRILDSVEYQMMRCTYTLGLGEANLAGKKIFLYDAVCRPSEIHSLETTPFDYVGNCENKTLHATQQIAECWTRAVRKLLERVAESVERKTLEKAARECHAVERIWKLLTEVEDVHVMMDPEDFLRLKKELGMMRNCGEMVAFCFRSRELVEVARMCRDLRQKVPEILEVEVDPTGGPGMMEAAMKVYSEKEKRNGFEKVHVLQGMQAIEVAMKRFFYAYKQVVAVMMGSSEADNGFTQIFLEPTYFPSLDAAKTFLAYYWENNNQNVVPC

SEQ ID NO: 3177 - protein, 610 aa, Glycine max
MEIEKSTKSNAEMGEKEEKKKKHRRGGIRTLPFILANEVCDRFASAGFHGNLISYLTQELNMPLVSASNTLTNFGGTSSFTPLIGAIVADSFAGRFWTITVASLIYELGLISITVSAILPQFRPPPCPTQVNCQEATSSQLWILYISLLLTSVGSGGIRPCVVPFSADQFDMTKSGVASRKWNLFNWYFFSMGLASLSALTIVVYIQDNMGWGWGLGIPCIAMLISIIAFVLGSPLYKTVKPEGSPLVRLAQVTVAAIKKRKEALPEDPQLLYHNWELDTPISLEGRLLHSNQYKWLDKAAIVTEEEARDQTTTPNLWKLATVHRVEELKSIIRMLPIWASGILLITSSSHLHSFVIQQARTMDRHLSPSFQISPASMSIFSVLTMMSGVVLYERLFVPFARRFTGNPSGITCLQRMGIGFIINIIATVVAGLMEMKRKSFAAKYHLLDDPKATIPISVFWLVPQYCLHGVAEIFMSVGHLEFLFEQAPESMRSSATALYCITTAIGNYMGTLLVSLVHKYTGKENNWLPDRNLNRGGLDYYYFLLSGIQVVNLVYYLICAWFYTYKPVDEISERTKEEDLEQANEHISPDDKLLKDGRDEEKRELTKDE

SEQ ID NO: 3178 - protein, 609 aa, Phaseolus coccineus
MEIEKKAKKSEEMEGEKEVKRSEPRRGGIRTLPFILANELCDRFASAGFHGNLISYLTQELNMPLVSASNTLTNFGGTSSFTPLIGAIIADSFAGRFWTITVASLIFELGLVSITVSAILPHFRPPPCPTQVNCQEATSSQLWILYISLLLTSVGSGGIRPCVVPFSADQFDMTKTGVASRKWNLFNWYFFSMGLASLSALTIVVYIQDNMGWGWGLGIPSIAMLISIIAFVLGSPLYKTVKPEGSPLVRLAQVIAAAVKKRNKALPEDPKLLYHNWELDAPIALEGMLLHSDQYKWLDKAAIVTEEEARDPSTTPDLWRLATVHRVEELKSIIRMLPIWASGILLITSSSHLHSFVIQQARTMDRHLSPSFQISPASMSIFSVLTMMSGVVLYDRFFVPFARRFTGKPSGITSLQRMGIGFIINIIATVVAALIEMKRKSVAARYHLLDDPKAIIPISVFWLVPQYFLHGVAEIFMSVGHLEFLFEQSPESMRSSATALYCITTAIGNYLGTLLVTLVHKYTGNERNWLPDRNLNRGGLDYYYFLVTVIQLVNLVYYFICAWFYTYKPVAETTERNKEEDLEQTNEHISSYNFKDGEEEEKRGFTKVE

SEQ ID NO: 3179 - protein, 609 aa, Cajanus cajan
MEIEKRTKGCEEVDQKEEKKKKKHQQGGIRTLPFILANEVCDRFASAGFHGNLISYLTQELNMPLVAASNTLTNFGGTSSFTPLIGAIIADSFAGRFWTITIASLIYELGLISITVSAIMPNLRPPPCPTQVNCQEATSSQLWVLYICLLLTSIGSGGIRPCVVPFSADQFDMSKSGVASRKWNLFNWYFFSMGLASLSALTIVIYIQDNMGWGWGLGIPTIAMLISIIAFVLGSPLYKTVKPEGSPLVRLAQVIVAAIKKRKEALPEDPKLLYQNWELDDPISLDGRLLHSKQYKWLDKAAIVTEDEAREPSATPNLWQLATVHRVEELKSIIRMLPIWASGILLVTSSSHLHSFVILQARTMDRHLTHSFQMSPASMSIFSVLTMMSGVVLYERLFVPFARRFTGNPSGITSLQRMGIGFVINIIATVVAGFLEMKRKSVAAKYHLLDDPKATIPMSVFWLVPQYCLHGVAEIFMSVGHLEFLFEQSPESMRSSATALYCVTSAIGNYTGTLLVSLVHKYTGKERNWLPDRNLNRGRLDYYYFLASGIQVVNFVYYLICAWFYKYKSLEEIIERKKEEDLEQADEHVSSVNLKDGREEEKRGFTNGE

SEQ ID NO: 3180 - protein, 616 aa, Lotus japonicus
MEIEKKIVSSVRMTEKEVETPENDNRKQHRRGGIRTLPFILANEACDRFASAGFHSNLISYLTQELNMPLVAASNILTNFGGTSSFTPLIGALIADSFAGRFWTITIGSLIYELGLVSITVSVLLPNMRPPPCPTQVNCQEATSSQLSILYICLLLTSLGSGGIRPCVVPFSADQFNMTKDGVASRKWSLFNWYFFIMGFASLSALTIVVYVQDNLGWAWGLGIPTIAMLISIIAFVLGAPLYKSVKPEGSPLVRLAQVIVAAVKKRNEALPNDCKLLYQNRELDAPIALEGRLLHSDQYKWLDKAAIVTEEEAKDSKAPPNLWKLTTVHRVEELKSIIRMLPIWASGILLITSSSHIGSFVIQQARTMDRHLSHSSSFQISPANMSIFSVLTMMIGVMLYERFFVPFVRRFTGNPSGITCLQRMGVGFVVNIVATIVSALVEIKRKEVAAKYHLLDDPKAIIPISVFWLVPQYCLHGVAEVFMSVGHLEFLFDQSPESMRSSATALYCITIAIGSYLGTFLVSLVHNYTGKERNWLPDRNLNRGRLECYYFLVSGIQVLNFIYYVICAWFYTYKPLEELSERIEEEDLEQADENVSFVNLKHGKEEEKKQFTKDE

SEQ ID NO: 3181 - protein, 613 aa, Medicago truncatula
MEIEKGIKNNMEMVEKEVETDSKKMNHPRRGGIRTLPFILANEVCDRFAGAGFHSNLISYLTQELNMPLVAASNTLTNFGGTSSFTPLIGALLADSFAGRFWTITVGCLIYELGLISITVSTILPHFRPPPCPTQVNCKEATSSQLLPLYMSLLLTSLGSGGIRPCVVPFSADQFDMTKEGVASRKWNLFNWYFFIMGFASLSALTIVVYVQDNVGWGWGLGIPTIAMMISVISFVLGSPLYKTVKPEGSPLVRLAQVVVAAVKKRKETLPDDPKFLYHNRELDAAISLEGSLLHSNQYKWLDKAAIITEEEAKDSNAPPNLWNLVTVHRVEELKAIIRMLPIWASGILLIMSSSHLGSFVIQQARSMDRHLTHSFQIAPANMSIFGVLTMMIGVMLYERFFVPFARRFTKNPAGITCLQRMGVGFVVNIIATIVSALVETKRKTVAAKFNLLDDPKAIIPFSVFWLVPQYCLHGVAEVFMSVGHLEFLFDQSPESMRSSATALYCITTAIGNYSGTLLVSIVHKYTGKENNWLPDRNLNRGRLDYYYYLISGIQVINLIYYIVCAWFYTYKPMGEVCERSKEEDLEQASANISIENLKDGKEEEKKGFTKDE

SEQ ID NO: 3182 - protein, 691 aa, Phaseolus coccineus
MEVESFEDAAVAKLLNDWFVSIKVDREERPDVDKVYMTYVQALYGGGGWPLSVFLSPDLKPLMGGTYFPPDDKYGRPGFKTILRKVKQAWDSKRDMLIKSGAFAIEQLSEAMSISSTSDKLPDGVPADALRLCSEQLSGGYDSKFGGFGSAPKFPRPVEINLMLYHSKKLEETGKLDGANGSQKMVLFSLQCMAKGGIHDHIGGGFHRYSVDECWHVPHFEKMLYDQGQLANVYLDAFSITKDTFYSYISRDILDYLRRDMIGPEGEIFSAEDADSAETEGAARKKEGAFYIWASKEVQDILGEHAALFEEHYYIKQSGNCDLSGMSDPHNEFKEKNVLIERKELSELASKYGMSVETYQEILGECRRKLFEARSRRPKPHLDDKVIVSWNGLAVSSFARASKILKSEAEGTKFYFPVVGTEPKEYMRIAEKAAFFIRKELYDVETRRLYHSFRRSPSKAPGFLDDYAFLISGLLDLYEFGGGVSWLLWAIELQETQDSLFLDKAGGGYFNNTGEDPSVLLRVKEDHDGAEPSGNSVSAINLIRLASMVSGSKAENYKRNAEHLLAVFEKRLKDMAMAVPLMCCAADMLRVPSRKQVVVVGGRTSEEFENMLTAAHALYDPNRTVIHIDPSNKEEMEFWEVNNSNVSLMAKNNYAVNKVVALVCQNFTCSPPLTDRSSLEALLSKKPSSFT

SEQ ID NO: 3183 - protein, 692 aa, Cajanus cajan
MEVESFEDEAVANLLNDWFVSIKVDREERPDVDKVYMSYVQALYGGGGWPLSVFLSPDLKPLMGGTYFPPDDKYGRPGFKTILRKVKEAWDSKRDMLIKSGSYAIEQLSEAMSASSDSDKLPDGVPAEAIHLCSEQLSGSYDSKFGGFGSAPKFPRPVEVNLMLYHSKKLENMGKLDGADGSKKMVLFSLQCMAKGGIHDHIGGGFHRYSVDECWHVPHFEKMLYDQGQLANVYLDAFSITKDTFYSYISRDILDYLRRDMIGPEGEIFSAEDADSAETEGAARKKEGAFYIWTSKEVEDILGEHAALFEEHYYIKQPGNCDLSGMSDPHDEFKGKNVLIERKESSEIASKYGMSGETYQGILGECRRKLFEVRSRRPKPHLDDKVIVSWNGLAISAFARASKILEGEPEGTKFYFPVVGTEPKEYMRIAERAAFFIRNQLYNVETHRLHHSFRRSPSKAPGFLDDYAFLISGLLDLYEFGGGINWLIWAIELQETQDALFLDRDGGGYFNNTGEDSSVLLRVKEDHDGAEPSGNSISAINLIRLACMVAGSKAEHYKKNAEHLLAVFEKRLKDMAMAVPLMCCAADMLRVPSRKEVVVVGERTSKEFEHMLAAAHALYDPNRTVIHIDPNNKEEMEFWEVNNSNIALMAKNNYAVNKVVALVCQNFTCSPPVTDHASLEALLSKKPSSSFT

SEQ ID NO: 3184 - protein, 692 aa, Cicer arietinum
MEVESFEDEGIAKLLNDWFVSIKVDREERPDVDKVYMTYVQALYGGGGWPLSVFLSPDLKPLMGGTYFPPDDKYGRPGFKTILRKVKEAWEDKRDMLVKSGAFAIEQLSEALSSSSDSGKLPDGVSDEALQLCSEQLSESYDSEFGGFGSAPKFPRPVEINLMLYHSKKLENTGKLDGANESQKMVFFTLQCMAKGGIHDHVGGGFHRYSVDECWHVPHFEKMLYDQGQLANAYLDAFSITKNTFYSCISRDILDYLRRDMIGPEGEIFSAEDADSAETEAATRKKEGAFYIWTREEVEEILGEHAALFEEHYYIKQMGNCDLSRMSDPHNEFKGNNVLIERNDASEMASKYGMSVETYQEILGECKRKLFEVRSKRPKPHLDDKVIVSWNGLAISSFARASKILKGEAEGIKFNFPVVGTEPKEYMRIAEKAASFIRKQLYNAETHRLQHSFRNSPSKAPGFLDDYAFMISGLLDLYEFGGGINWLLWAIELQETQDALFLDRDGGGYFNNTGEDSSVLLRVKEDHDGAEPSGNSVSAINLIRLASMVSGSKAEHYKGIAEHLLAVFEKRLKDMAMAVPLMCCAADMLCVPSRKQVVVVGERTSEEFETMLAAAHTLYDPSRTVIHIDPNNKEEMEFWEVNNSNIALMAKNNYAVSKVVALVCQNFTCSPPVTDHLTLEALLSQKPSSKLK

SEQ ID NO: 3185 - protein, 544 aa, Lotus japonicus
MLILHHLHRSLGRIFHYHHHHLLPSSNSPFSFSLPLNLKLKKKPLSLSLSNSMATSHSNPHHKHANRLAAEQSPYLLQHAHNPVDWYPWGEEAFAEARRRDAPIFLSIGYSTCHWCHVMEVESFENEEIAKLLNDWFVSIKVDREERPDVDKVYMTYVQALYGGGGWPLNVFLSPDLKPLMGGTYFPPDDKYGRPGFKTLLRKVKEAWEDKRDMLVKSGAFAIEQLSEALSGRSDSDKLADGVPDDAIRLCSEQLSDSYDSKFGGFGSAPKFPRPVEINLMLYHSKKLVEAGKLARAHESQKKVFFSLQCMAKGGIHDHIGGGFHRYSVDKCWHVPHFEKMLYDQGQLANVFLDAFSITKDNFFSCVSRDILDYLRRDMIGPEGEIFSAEDADSAETDGATTKKEGAFYVWTSKEVEDILGEHAALFEEHYYIKESGNCDLSRMSDPHDEFKGKNVLIERKDPSEMASKYGMSVETYQEVLGECRRKLFEVRSRRSRPHLDDKVIVSWNGLAISSFARASKILKVEPEGTRFNFPVVSTEPGNT

SEQ ID NO: 3186 - protein, 755 aa, Medicago truncatula
MATSSHSDQHKFTNRLASEQSPYLLQHAHNPVDWYPWGEEAFAEARRRDAPIFLSIGYSTCHWCHVMEVESFEDEGIAKLLNDWFVSIKVDREERPDVDKVYMTYVQALYGGGGWPLTVFLSPDLKPLMGGTYFPPEDKYGRPGFKTILRKVKEAWENKRDMLVKSGTFAIEQLSEALSSSSNSDKLPDGVSEDALRLCSEQLSENYDSEYGGFGSAPKFPRPVEINLMLYKSKKLEDTGKLDGANKSQKMVFFTLQCMAKGGVHDHVGGGFHRYSVDECWHVPHFEKMLYDQGQLANVYLDAFSITKDTFYSSLSRDILDYLRRDMIGPEGEIFSAEDADSAENEGDTRKKEGAFYVWTSKEVEDLLGEHAALFEEHYYIKQMGNCDLSEMSDPHNEFKGKNVLIERKDSSEMASKYGMSIETYQEILGECRRKLFEVRLKRPKPHLDDKVIVSWNGLVISSFARASKILKGEAEGIKFNFPVVGTEPKEYLRIADKAASFIKNQLYNTETHRLQHSFRNSPSKAPGFLDDYAFLISGLLDLYEFGGEINWLLWAIELQETQDTLFLDKDGGGYFNNTGEDSSVLLRVKEDHDGAEPSGNSVSALNLIRLASLVSGSKAEHYKRNAEHLLAVFEKRLKDTAMAVPLMCCAADMLRVPSRKQVVLVGERTSEEFESMLGAAHALYDPNRTVIHIDPNNKEEMDFWEVNNSNIALMAKNNYSGSKVVALVCQNFTCSAPVTDHSSLEALLSQKPSS

SEQ ID NO: 3187 - protein, 692 aa, Glycine max
MEVESFEDEAVAKLLNDWFVSIKVDREERPDVDKVYMSYVQALYGGGGWPLSVFLSPDLKPLMGGTYFPPDDKYGRPGFKTILRKLKEAWDSKRDMLIKRGSYAIEQLSEAMSASSDSDKLPDGVPADALRLCSEQLSGSYDSKFGGFGSAPKFPRPVEINLMLYHSKKLEDTGKLDGANRIQKMVFFSLQCMAKGGMHDHIGGGFHRYSVDECWHVPHFEKMLYDQGQLANVYLDAFSITKDTFYSYISRDILDYLRRDMIGPEGEIFSAEDADSAETEGAARKKEGAFYIWTGKEVADILGEHAALFEEHYYIKQSGNCNLSGMSDPHDEFKGKNVLIERKEPSELASKYGMSIETYQEILGECRHKLFEVRSRRPKPHLDDKVIVSWNGLAISSFARASKILKGEVEGTKFYFPVVGTEAKGYLRIAEKAAFFIWKQLYNVETHRLHHSFRHSPSKAPAFLDDYAFLISGLLDLYEFGGGINWLLWAIELQETQDALFLDRTGGGYFNNTGEDSSVLLRVKEDHDGAEPSGNSVSAINLIRLASMVAGSKAEHYKQNAEHLLAVFERRLKDMAMAVPLMCCAADMLHVPSRKQVVVVGERTSGDFENMLAAAHALYDPNRTVIHIDPNNKEEMGFWEVNNSNVALMAKNNFAVDKVVALVCQNFTCSPPVTDHSSLESLLSKKPSSSLT

SEQ ID NO: 3188 - protein, 89 aa, Cyamopsis tetragonoloba
MDGHDSEDPKQSTADMTAFVQNLLQQMQIRFQTMSDSIISKIDEMGNRINELEQSINDLRAEMGVESNPSPVAPLKPKEEVSNKEEGSA

SEQ ID NO: 3189 - protein, 88 aa, Glycyrrhiza uralensis
MDGHDSEDPKQSTADMTAFVQNLLQQMQIRFQTMSDSIISKIDEMGNRIDELEQSINDLRAEMGVESSPSPVAPAKPKEEESNKEGSA

SEQ ID NO: 3190 - protein, 92 aa, Vigna unguiculata
MDGHDSEDPKQSTADMTAFVQNLLQQMQIRFQTMSDSIITKIDEMGNRINELEQSINDLRAEMGVESTPSPVAPVARAKRKEEESNKEEGSA

SEQ ID NO: 3191 - protein, 88 aa, Cicer arietinum
MDGHDSEDPKQSTADMTAFVQNLLQQMQTRFQTMSDSIISKIDDMGSRINELEQSINDLRAEMGVEGSPSPVAPAKPNEEESNKEGSA

SEQ ID NO: 3192 - protein, 92 aa, Vigna unguiculata
  misc_feature (80)..(80): Xaa can be any naturally occurring amino acid
  misc_feature (91)..(91): Xaa can be any naturally occurring amino acid
MDGHDSEDPKQSTADMTAFVQNLLQQMQIRFQTMSDSIITKIDEMGNRINELEQSINDLRAEMGVESTPSPVAPVARAKXKEEESNKEEGXA

SEQ ID NO: 3193 - protein, 88 aa, Cajanus cajan
MDGHDSEDPKQNTADMTAFVQNLLQQMQTRFQTMSDSIISKIDEMGNRIEELEQNINDLRAEMGVESTPSLSPAKPKEEESKKEEGSA

SEQ ID NO: 3194 - protein, 88 aa, Medicago truncatula
MDAHDSEDPKQSTADMTVFVQNLLQQMQTRFQTMSDSIISKIDEMGSRINELEQSINDLRAEIGVESSPSPVAPVKPKEEELKKEGSA

SEQ ID NO: 3195 - protein, 85 aa, Medicago truncatula
HDSEDPKQSTADMTVFVQNLLQQMQTRFQTMSDSIISKIDEMGSRINELEQSINDLRAEIGVESSPSPVAPVKPKEEELKKEGSA

SEQ ID NO: 3196 - protein, 88 aa, Trigonella foenum-graecum
MDGHDSEDPKQNTADMTVFVQNLLQQMQTRFQTMSDSIISKIDEMGSRIDELEQSINDLKAEMGVESSPLPVAPVKPKEEELKKEGSA

SEQ ID NO: 3197 - protein, 89 aa, Medicago truncatula
MDSHDSNDPKQSPADMTAFVQNLLQQMQSRFQTMSDSIVTKIDDMGSRINELEQSINDLRAEMGVESSPSPAAPEKPKEEESKKEEGSD

SEQ ID NO: 3198 - protein, 86 aa, Lotus japonicus
DGQDSQDPKQSPADMTAFVQNLLQQMQSRFQTMSDSIVTKIDDMGSRINELEQSINDLRAEMGVESSPSPVAPAKPKEEDKEEGSA

SEQ ID NO: 3199 - protein, 89 aa, Cicer arietinum
MDSQDSQDAKQSPADMTAFVQNLLQQMQSRFQTMSDSIVTKIDDMGNRINELEQSITDLRAEMGVEGSPSPVAPAKSKEEESNKEEGSA

SEQ ID NO: 3200 - protein, 88 aa, Glycine max
MDGHDSQDPKQSPADMTAFVQNLLQQMQNRFQTMSDSIVTKIDDMGSRINELEQSINDLRAEMGVESSPSPATPAKPTEEITKEEGSA

SEQ ID NO: 3201 - protein, 88 aa, Phaseolus coccineus
MDGHDSQDPKQNPADMTAFVQNLLQQMQNRFQTMSDSIVTKIDDMGSRINELEQSINDLRAEMGVESSPSPVPTAKPTEDETKEEGSA

SEQ ID NO: 3202 - protein, 88 aa, Cajanus cajan
MDGQDSQDPKQSPADMTAFVQNLLQQMQNRFQTMSDSIVTKIDDMGNRINELEQSINDLRAEMGVEGSPSPVAPAKPTEETTKEEGST

SEQ ID NO: 3203 - protein, 85 aa, Trifolium pratense
MDGHDSEDPKQSTADMTVFVQNLLQQMQTRFQTMSDSIITKIDDMGSRITELEQSINDLRAEMGVESSPSPAKPKEEGSNKEDSA

SEQ ID NO: 3204 - protein, 88 aa, Glycine max
MDGHDPQDPKQSPADMTAFVQNLLQQMQNRFQTMSDSIVTKIDDMGSRINELEQSINDLRAEMGVESSPSPAAPAKLTEEITKEEGSA

SEQ ID NO: 3205 - protein, 88 aa, Manihot esculenta
MDGHDSEDPKQSTADMTAFVQNLLQQMQSRFQTMSDSIVTKIDEMGTRINDLEQSINDLRAEMGVEGSPSPLASKQKPNEDNRGEGSA

SEQ ID NO: 3206 - protein, 88 aa, Vigna unguiculata
MDGQDSQDPKQNPADMTAFVQNLLQQMQNRFQTMSDSIVTKIDDMGNRINELEQSINDLRAEMGVESSPSPVPTAKPTEEETKEGGSA

SEQ ID NO: 3207 - protein, 91 aa, Cucurbita pepo
MDGHDSEDPKQSTADMTVFVQNLLQQMQSRFQTMSDSIITKIDEMGSRINELEQSINDLKSEMGVEGSPSPMTPSKSSADEVKKDEGSALK

SEQ ID NO: 3208 - protein, 89 aa, Quercus alba
MDGHDGEDPKQSTADMTVFVQNLLQQMQTRFQQMSDSIVTKIDEMGGRINELEQSINDLRAEMGVESSPSPVPPTKPQLDDVKKEEGSA

SEQ ID NO: 3209 - protein, 89 aa, Trigonella foenum-graecum
MDSHDSNDAKQSPADMTAFVQNLLQQMQSRFQTMSDSIVTKIDDMGNRINELEQSINDLRAEMGVESSPSPAAPEKPKDEELKKEEGSD

SEQ ID NO: 3210 - protein, 619 aa, Glycine max
MAAKTVTPDAVSMLLANTCPDSSSDLPEIVVQVLDLKATGNKYMFTANDGKTKLKAMISSDMCSQVLSGAIQNLGLIRVLDYTVNVIPNKSDKYLIVTKCEPVSPALEIEIKSEESGSGILLKSKVEGGVNTEGPAAAGILLKPKQVVTKSANQILREHGNSAPAARMAMTRRVRPLVSLNPYQGNWTIKVSVTSKGNMRNYKNARGDGCVFNVELTDEDGTQIQATMFNNAARKFYDKFILGRVYYISKGTLKVANKQFKTVQNDYEMTLNENSEVEEVAGEASFVPETKFNFVQIDQLGPHVNKSELVDVIGIVKNVSSTMTIRRKSDNESIPKRDITIADDTKKTVVVSLWNELATTTGQELLDIVDKSPVVAIKSLKVGDFQGVSLSTIGKSVVLVNPVIPEAKNLRSWYDFEGKDAAMDSVGSGSSPTSNNGIRSVYTDRVLLSDITSNPSLGDGKPAFFSLRGHISFIKPDQAMWYRACKTCNKKVTESVGSGYLCDGCQKSDEQCSLRYIMVAKVSDASAETYISAFNQEAEKIIGCSADDLDNLKSQEGEVNPYQMTLKEATWAQHLFRVSVTPNEYNGEKRQRITVRAVVPVDFAAESRFLLEDLSKMRA

SEQ ID NO: 3211 - protein, 617 aa, Phaseolus coccineus
MAAKSITPDAVSTLLANPSPDSSSDLSDIVVQVVDLKPSGNRYMFSASDGKKKLRAILPSNMYSEVLSGNIQNLGLVRILDYTLNDIPNKSEKYLIVTKCEPVSPALEKEIKSDEPAILLKPKEEVGAKSEGAAGILLKQKQEVVTKSAAQILNEQHRNSAPAARLAMTRRVRPLVSLNPYQGNWTIKVSVTSKGNMRTYKNARGEGCVFNVELTDEEGTQIQATMFNDAARKFYDRFVLGKVYYISKGTLKVANKQFKTVQNDYEMTLNENSEVEEVADEASFVPETKFSFVQIDQLGPYVNKSELVDVIGVVKSVSSTMSIRRKSDNESIPKRDITIADETKKTVVVSLWNDLATNTGQELLDIVDKSPVVAIKSLRVGDFQGVSLSTISRSVVLVNPDVPEAKKLRSWYEFEGKDAAMDALGSGSSPTSNNGIRSVYSDRVALSHITSNQSLGDMKPAFFSLKGYISFIKPDQAMWYRACKTCNKKVTESIGSGYWCEGCQKSDEQCSLRYIMVARVCDTSGEAFISVFNDEAEKIVGCSADDLDDLKSQEGEDNPYNLKLKQATWVPHLFRVSVSQNEYNNEKRQRITARAVVPVDFAAESRIMLEEISKMRA

SEQ ID NO: 3212 - protein, 610 aa, Cajanus cajan
MAAKSVTHDAVSTLIANPSPNSSSVFPEIVVQVLDLKPSGNRYMFNASDGKMKLRAILPSNVSSEVHSGNIQNLGLIRILDYTVNDIPNKSEKYLIVTSCETVSPALEMEIKSEGSEEGVVKSEGAAGILLKPKQEVVTKSAVQILHEQRGNSAPTARMAMTRRVRPLVSLNPYQGNWTIKVSVTSKGNMRTYRNARGEGCVFNVELTDEDGTQIQATMFNDAARKFYDKFVLGKVYYISKGTLKVANKQFKTVQNEYEMTLNENSEVEEVAGEASFVPETKFNFVQIDQLGPFVNKLELVDVVGVVKNVSSTMSIRRKSDNESIPKRDITIADETKKTVVVSLWNDLATKIGQELLDIADNSPIVAIKSLRVGDFQGVSLSTISRSVVLINPDIPEARKLRSWYDLEGKDAAMDSVGSGSSPTSNNGSRSVYSDRVSLSHITSDPSLGDVKPAFFSIRGYISFIKPDQAMWYRACKTCNKKVTESIGSGYWCEGCQKNDEQCSLRYIMVAKVSDASGEAFVSVFNEEAEKIVGCSAEELDDLRSQEGEDNPYQLKLKQATWVPHLFRVSVTQNEYNNEKRQRITARAVVPVDFAAEARIMLEEISKMRV

SEQ ID NO: 3213 - protein, 528 aa, Glycine max
MEAKGVRFLAYQSIFSSVGSGDFDGVKKLVEEVKKEEGSSLSDVMSLQNDAGETALYIAAENNLQEMFSFLLSICHFEVVKIRSKADMNAFHVAAKRGNLDIVRELLNIWPEVCKLCDSSNTSPLYSAAVQDHLDVVDAILDVDVSSMFIVRKNGKTSLHNAARYGVHRIVKTLIARDPGIVCIKDKKGQTALHMAVKGQCTSVVEEILLADPSILNERDKKGNTALHMATRKCRSQIVGLLLSYSAVDVNAINKQQETALDLADKLPYGDSALEIKEALAEYGAKHARYVGKEDDAMELKRTVSDIKHEVQSQLIQNETTRRRVSGIAKELKKLHREAVQNTINSVTLVAVLFASIAFLAIFNLPGQYITDEGKEIGKAKIADHVSFQVFCLLNSTSLFISLAVVVVQITLVAWDTRAQKQIVSVVNKLMWAACACTCGAFLAIAFEVVGKKTWMAITITLLGVPVLVGTLASMCYFVFRQHFGIFRSDSQRRIKRASGSKSFSWSYSANISDLDEYNSDIEKIYAL

SEQ ID NO: 3214 - protein, 529 aa, Phaseolus coccineus
MESKGVRFLAYQSIFSSVGSGDFDGVKKLVEKVKNEEESSLSDVMSLQNDAGETALYIAAEHNLQEIFSYLLNLCDFEALKIRSKSDMNAFHVAAKRGHLDIVKELLNVWPELCKLCDSSNTSPLYSAAVQDHLDVVNAILDVDVSSMFIVRKNGKTSLHNAARYGLVRIVKAVIGRDPGIVCIKDRKGQTALHMAVKGQCTLVVEEILLADSSILNERDKKGNTALHMATRKCRSQIVILLLSYSAMDVNAINKQQETALDLADKLPYGDSALEIQEALAEYGAKHARHVGKVDEAMELKRTVSDIKHEVQSQLIQNETTRRRVSGIAKELKKLHREAVQNTINSVTVVAVLFASIAFLAIFNLPGQYQVKPGEEIGKANIADHLSFQVFCFLNSTSLFISLAVVVVQITLVAWDTRAQKQIVSVVNKLMWAACACTCGAFLAIAFEVVGGKTWMAITITLLGVPILVGTLLSMCYFVFRQHFGIFRSDSQRRIKRASGSKSFSWSYSANISDLDDEYDSDIEKIYAL

SEQ ID NO: 3215 - protein, 529 aa, Cajanus cajan
MESKGLRFIAYQSIFSRVGSGDFDGVKRVVEQVKKEDASLLSDVMSLQNDAGETALYIAAENNLLEIFRFLLSLCDFDVVKIRSKSDMNAFHVAAKRGHRDIVRELLNTWPEVCKLCDSSNTSPLYSAAVQDHLDVVNAILDVDVSTMFIVRKNGKTSLHNAARYGVVQIVKTLIARDPGIVCIKDKKGQTALHMAVKGQCTAVVEEILLADPSILNERDKKGNTALHMATRKGRSQIVNLLLSYSAVDVNAINKQQETALDLADKLPYGDSALEIKEALAEYGAKYARYVGKVDEAMELKRTVSDIKHEVQSQLIQNEKTRRRVSGIAKELKKLHREAVQNTINSVTVVAVLFASIAFLAIFNLPGQYITEGPEAGEANIASHHHVGFQVFCFLNSTSLFISLSVVVVQITLVAWDTRAQKQLVSVVNKLMWAACACTCGAFLAIAFEVVGKKKWMAITITLLGAPILVGTLASMCYFVFRQHFGIFRSDSQRRIKRASGSKSFSWSYSANISDLDEYNSDIEKIYAL

SEQ ID NO: 3216 - protein, 211 aa, Cajanus cajan
MESKGLRFIAYQSIFSRVGSGDFDGVKRVVEQVKKEDASLLSDVMSLQNDAGETALYIAAENNLLEIFRFLLSLCDFDVVKIRSKSDMNAFHVAAKRGHRDIVRELLNTWPEVCKLCDSSNTSPLYSAAVQDHLDVVNAILDVDVSTMFIVRKNGKTSLHNAARYGVVQIVKTLIARDPGIVCIKDKKRQNCTAYGCQRTVYCSGGGDITS

SEQ ID NO: 3217 - protein, 539 aa, Lotus japonicus
MESKALRFITHQSIFSIVGSGDFDGLKKVVEQLKNDDGGGDGSSSSSSSSSLSEVMSLQNDAGETALYIAAERNLKEVFSFLLKLCDYEVVKIRSRSDMNAFHVAAKRGHLDIVRELLSTWPEVCKLCDSTNTSPLYAAAGQDHLDVVNAILDVDVSSMFIVRKNGKTSLHNAARYDVLRIVKALIARDPGIVCIKDKKGQTALHMAVKGQSTLVVEEILLADPTILNERDKKGNTALHMATRKGRSQIVNLLLIYTATDINAINKQQETALDLADKLPYGDSALEIKEALSEYGAKYARHVGKVDEAMELKRTVSDIKHEVQSQLIQNEKTRKRVSGIAKELKKLHREAVQNTINSVTVVAVLFASIAFLAIFNLPGQYIMTGSETGKANIADHVGFQVFCFLNSTSLFISLAVVVVQITLVAWDTRAQKQIVSVVNKLMWAACACTCGAFLAVAFEVVGKKTWMAITITILGVPILLGTLAILCYFVFRQHFGIFRSDSQRRIKRASGSKSFSWSYSAHISDLDDEYNSDIEKIYAL

SEQ ID NO: 3218 - protein, 468 aa, Cicer arietinum
MESKTLRFMTHQSIFSMVGSGDLDGLKKLVEELKKEDNDNGSSSSSSSMLVSDLMCLQNEHGETTLYIAAERNLKQVFSFLLQLCDFEVLKIRSKSDMNAFHVAAKRGNLDIVREILSVWPEVCKLCDSSNTSPLYSAAVQDHLDVVSAILDIDVSSMFIVRKNGKTALHNAVRYGVLRIVKALISRDPGIVCIKDKKGQTALHMAVKGQCTSVVEEILQADPTILNERDKKGNTALHMATRKSRSQIVILLLSYASLDVNAINKQQETALDLADKLPYGTSALEIQEALAEYGAKYARHVGKVDEAMELKRTVSDIKHEVQSQLIQNEKTRRRVSGIAKELKKLHREAVQNTINSVTVVAVLFASIAFLAIFNLPGQYITKGSETGKSNIADHVGFQVFCLLNSTSLFISLAVVVVQITLVAWDTRAQKQIVSVVNKLMWAACACTCGAFLAIAFEVVGKKNGWQSP

SEQ ID NO: 3219 - protein, 538 aa, Medicago truncatula
MESKGLRFMTHQSIFTTVGSGDLDGLKKLLEKLNKEEDGDISNGSSSSSMSVSDVMSLQNDHGETPLYIAAHNNLKEVFTFLIKLCDFEVLKIRSKSDMNAFHVAAKRGHLDIVREILSAWPAVCKLCDSTNTSPLYAAAVQDHLDVVNAILDVDVSSMFIVRKNGKTALHNAVRYGVDRIVKALIVRDPGIVCIKDKKGQTALHMAVKGQSTSVVEEILQADPTILNERDKKGNTALHMATRKGRSQIVSYLLSYAAVDVNAINKQQETALDLADKLPYGSSALEIQEALSEYGAKYARHVGKVDEAMELKRTVSDIKHEVQSQLIQNEKTRRRVSGIAKELKKLHREAVQNTINSVTVVAVLFASIAFLAIFNLPGQYIMKGSHIGESNIADHVGFQIFCLLNSTSLFISLAVVVVQITLVAWDTRAQKQIVSVVNKLMWAACACTCGAFLAIAFEVVGKKKWMAITITGLGIPILVGTLASMCYFVFRQHFGIFQSDSQRRIKRASGSKSFSWSYSANISDIDEYTSDIEKIYAL

SEQ ID NO: 3220 - protein, 231 aa, Glycine max
MASGFGESTGRSPPSPSYFNNNNNNDAANFECNICFELAQDPIITLCGHLFCWPCLYKWLHFHSQSRECPVCKALVEEEKLVPLYGRGKSSTDPRSKSIPGDNIPHRPAGQRPETAPPPETNHFHQHGFGFMGGLGGFAPPPMATTRFGNFALSAAFGGFIPSLFNFQLHGFHDAAMYGGGAGFPHGFANTFHGVHAHGFPLRTHQGQQDYYLKKLLLFVVLCVVLAFIWQ

SEQ ID NO: 3221 - protein, 232 aa, Cajanus cajan
MASGFGESAGRSPPSPSYFSNNNNNDAANFECNICFELAQDPIITLCGHLFCWPCLYKWLHLHSQSRECPVCKALVEEEKLVPLYGRGKTSTDPRSKSIPGVNIPHRPAGQRPETAPPPETNHFHQHGFGFMGGLGGGFAPPPVATTRFGNFALSAAFGGFIPSLFNFQLHGFHDGAMYGGAAGFPHGFSHSFHGVHAHGYPLRTHQGQQDYYLKRLLLFIVVCVLLAFVWQ

SEQ ID NO: 3222 - protein, 231 aa, Vigna unguiculata
MASGFGESTGRSPPSPSYFNNNNSNDAGNFECNICFELAQDPIITLCGHLFCWPCLYKWLHFHSQSRECPVCKALVEEEKLVPLYGRGKTSTDPRSKSIPGMNIPHRPAGQRPETAPPPETNNFPHHGFGFMGGLGGFAPPPMASTRFGNFGLPAAFGGFIPSFFNFQLHGFHDGALYGGASGFPHGFSNTFHGIHAHGYPLRTHQGQQDYYLKKLLLVVVFCVLLAFIWQ

SEQ ID NO: 3223 - protein, 219 aa, Cajanus cajan
MASGFGESAGRSPPSPSYFSNNNNNDAANFECNICFELAQDPIITLCGHLFCWPCLYKWLHLHSQSRECPVCKALVEEEKLVPLYGRGKTSTDPRSKSIPGVNIPHRPAGQRPETAPPPETNHFHQHGFGFMGGLGGGFAPPPVATTRFGNFALSAAFGGFIPSLFNFQLHGFHDGAMYGGAAGFPHGFSHSFHGVHAHGYPLRTHQGQQDYYLKRLLL

SEQ ID NO: 3224 - protein, 229 aa, Phaseolus coccineus
MASGFGESTGRSPPSPSYFNNNNNSNDAGNFECNICFELAQDPIITLCGHLFCWPCLYKWLHFHSQSRECPVCKALVEEDKLVPLYGRGKTSTDPRSKSIPGMNIPDRPAGQRPETAPPPETNSFHPHGFGFMSGFAPPPMATTRFGNFGLPAAFGGFIPSFLNFQLHGFHDGALYRGASGFPHGFSSTFHGVHAHGYPLRTHQSQQDYYLKNLLLGVVFCVLLAFIWQ

SEQ ID NO: 3225 - protein, 228 aa, Lotus japonicus
MASGFGESTSRSPPSPSYAGNNNSDAGNFECNICFDLAQDPIITLCGHLFCWPCLYKWLHFHSQSRECPVCKALVEEEKLVPLYGRGKTSSDPRSRSIPGVNIPHRPAGQRPETAPPPEPNPFAHHGFGFTGGLGGFAPAATARFGNFTLSAAFGGFIPSLFNFQLHGFHGATMYGGAPGFPYGFSNSFHGGHVHRYPLHTGQGQQDYYLKRLLFFVIFCVVLAFIWQ

SEQ ID NO: 3226 - protein, 229 aa, Cicer arietinum
MASGFGESTSRSPPSPPYSSNNNNNDAGNFECNICFDLAQDPIITLCGHLFCWPCLYKWLHFHSQSRECPVCKAMIEEEKLVPLYGRGKTSTDPRSKSIPGVNIPHRPAGQRPETAPPPESNPFSQHGFGFTGGLGGFAPAATARFGNFTFSAGFGGFIPSLFNFQLHGFHGGAMYGGAAGFPYGFSNSFHGGHVHRYPLHTGQGQQDYYLKRLLMFVIFCVVLAFIWQ

SEQ ID NO: 3227 - protein, 231 aa, Arachis hypogaea
MASGFGESTSKSPPSPSYSNNSNNNNDAGNFECNICFDLAQDPIITLCGHLFCWPCLYKWLHLHSQSQECPVCKAAIEEEKLVPLYGRGKTSTDPRSKTIPGLNIPHRPTGQRPETAAPPPEANHFHQHGFGLMGGLGGFAPMATARFGNFTLSAAFGGFIPSLFNFQLHGYHNGSMYGGAAGYPYGYSNSFHGVHAHRYPLHAGQGQQDYYLKRLLLFVVFFVVLAFIWQ

SEQ ID NO: 3228 - protein, 230 aa, Glycyrrhiza uralensis
MASGFGESTSRSPPSPPYSSSNNNNDAGNFECNICFDLAQDPIITLCGHLFCWPCLYKWLHFHSQSKECPVCKALIEEEKLVPLYGRGKSSTDPRSKSIPGVNIPHRPAGQRPETAPPPDPNPFSQHGFGFTGGLGAFAPAATARFGNFTFSAGFGGFIPSLFNFQLHGFHGGSMYSGAAGFPYGFSNSFHGGHVHRGYPLHTGQGQQDYYLKSLLLVVIFCVVLAFIWQ

SEQ ID NO: 3229 - protein, 228 aa, Manihot esculenta
MASGFGESTSRPPQNPSFSSNSNGDAGNFECNICFDLAQDPIVTLCGHLFCWPCLYKWLHFHSQSKECPVCKALVEEEKLVPLYGRGKTSTDPRSKSIPGVNIPNRPAGQRPETAPPPEPNHFAQHGFGFMGGLGGFAPMATARFGNFTLSAAFGGLIPSLFNLQLHGFPDPAMYGAAAGFPYGFSNSFHGGHAHGYPPHQGQGQQDYYLKRLLLFIGFCVLLALIWQ

SEQ ID NO: 3230 - protein, 229 aa, Trifolium pratense
MASGFGESTSRSPPSPPYSSNNNNNDAGNFECNICFDLAQDPIITLCGHLFCWPCLYKWLHFHSQSRECPVCKAMIEEEKLVPLYGRGKTSTDPRSKSIPGVNIPHRPAGQRPETAPPPESNPFSQHGFGFTGGLGGFAPATTARFGNFTFSAGFGSFIPSLFNFQMHGFHGGAMYGGAAGFPYGFSNSFHGGHVHRYPPHIGQGQQDYYLKRLLMFVIFCVVLALLWQ

SEQ ID NO: 3231 - protein, 191 aa, Phaseolus coccineus
PFSRWQVGLGNQLGGHPQALHTSTTIIIANDAGNFECNICFELAQDLIITLCGHLFCWPCLYKWLHFHSQSRECPVCKALVEEDKLVPLYGRGKTSTDPRSKSIPGMNIPDRPAGQRPETAPPPETNSFHPHGFGFMSGFAPPPMATTRFGNFGFPAAFGGFIPSFLNFQLHGFHDGAVVSGSLWFSSWIF

SEQ ID NO: 3232 - protein, 232 aa, Medicago truncatula
MASGFGESTSRSPPSPPYSSNNNNSDAGNFECNICFDLAQDPIITLCGHLFCWPCLYKWLHFHSQSRECPVCKAMIEEEKLVPLYGRGKTSTDPRSKSVPGVNIPHRPAGQRPETAPPPESNPFSQHGFGFTGGLGGFAPATTARFGNFTFAAGFGGLGGFIPSLFNFQLHGFHGGAMYGGAAGFPYGFSNAFHGGHVHRYPLHTGQGQQDYYLKRLLMFVIFCVVLALLWQ

SEQ ID NO: 3233 - protein, 134 aa, Medicago truncatula
MASGFGESTSRSPPSPPYSSNNNNSDAGNFECNICFDLAQDPIITLCGHLFCWPCLYKWLHFHSQSRECPVCKAMIEEEKLVPLYGRGKTSTDPRSKSVPGVNIPHRPAVRDLKLHLHLNQILFLNMDLDSQVD

SEQ ID NO: 3234 - protein, 232 aa, Trigonella foenum-graecum
MASGFGESTSRSPPSPPYSSNNNTNDAGNFECNICFDLAQDPIITLCGHLFCWPCLYKWLHFHSQSRECPVCKAMIEEEKLVPLYGRGKTSTDPRSKSIPGVNIPHRPAGQRPETAPPPESNPFSQHGFGFTGGLGGFAPATTARFGNFTFAAGFGGLGGFIPSLFNFQLHGFHGGAMYGGAAGFPYGFSNAFHGGHVHRYPLHTGQGQQDYYLKRLLMFVIFCVVLALLWQ

SEQ ID NO: 3235 - protein, 244 aa, Glycine max
MGANANDLSTEIDCTKKVSNCWGNGQIPFALPFLTLPNSNFTTLLSSPPQLLHTSFTTAADNFFRFVHSLASQNPFLNKVLSLPAEFHTLCVQIRKQRNVGLVSSHNFAAVLPGGSVAGLVVANGVLNFLNIYNTLLIVRLVLTWFPNTPPSIVSPLSTICDPYLNIFRGLIPPLGGTLDLSPILAFLVLNAFTSTAAALPAELPVTEQSKQGLAAPLPSTTSQKKWMRRFQGNRSRTSGDDAK

SEQ ID NO: 3236 - protein, 881 aa, Phaseolus coccineus
MAASVEHRPFTSHQHGVVRSFKSYPDVPRPKKLPLPQPLSDSTNDNDEEAAVWKELVLKSSAGVEPSIFDPRDDGTSDQWIKRNASMIRLTGKHPFNAEPPLPRLMQHGFITPSPIHYVRSHGPVPHARWEDWTVEVTGLVTRPTCFTMEQLVNDFPSHEFPATLVCAGNRRKEQNMVKQSIGFNWGAGGVSTSVWRGVSLRSLLKRCGIYSRAKGALHVCFEGAEDLPGGGGSNYGTSLMREVALDPSRDIILAYMQNGELLSPDHGFPVRMIIPGFIGGRMVKWLKRIVVSNQQSQSHYHYKDNKLFPSHVDAELANEEDWWYKPEYIINEVNINSVITTPSHQEILPINSWTTQMPYSMRGYAYSGGGRKVTRVEVTLDGGETWQVCSVERLEKPNKYGKYWCWCFWSLEVEVLDILGAKEIAVRAWDEAQNTQPEKLIWNTMGMINNCWFRVKTNVCKPKKGEIGIVFEHPTQPGNQSGGWMAREKQLEKSSESNPILKKSVSSPFMNTATKSYSLSEVRRHNNRDSAWIIVNGHVYDCTRFLKDHPGGEDSILLNAGTDCTEEFEAIHSDKAKKMLEDYRIGELMTTDYTSDSSSSNNSVHGNSETTHLAPIREVALNPREKIPCKLLSKTSISHDVRLLRFALPAEDQVMGLPVGNHVFLCATVDEKLCMRAYTPTSSVDEVGFFDLVVKVYFKGVHPNFPNGGIMSQHLDSLPIGSVVDVKGPLGHIEYTGRGNFLVHGKPRFAKRLTMLAGGTGITPIYQVVQAILKDPEDRTEMYVVYANRTEDDILLKEELDEWAKKHDRLKVWYVVQANIREGWEYSVGFITESILREHVPLASPDTLALTCGPPPMIQFAVQPNLEKLGYDIQNDLLVF

SEQ ID NO: 3237 - protein, 886 aa, Glycine max
MAASVDNRQYGTHINAVVRACGPDFNTPLPSDFDLDSSSDDEDQNDDASYLKELIQKANAETEASLLDPRDEGTADQWIPRNASMVRLTGKHPFNAEAPLPRLMHHGFITPSPLHYVRNHGPVPKIKWDEWTVEVTGLVKRSTHFTMEKLMREFPHREFPATLVCAGNRRKEHNMVKQSIGFNWGAAGASTSVWRGVPLRHVLKRCGILARMKGAMYVSFEGAEDLPGGGGSKYGTSVKREMAMDPSRDIILAFMQNGEPLAPDHGFPVRMIIPGFIGGRMVKWLKRIVVTEHECDSHYHYKDNRVLPSHVDAELANDEGWWYKPEYIINELNINSVITTPCHEEILPINSWTTQRPYVIRGYAYSGGGRKVTRVEVTLDGGETWHVCTLDHTEKPNKYGKYWCWCFWSLEVEVLDLLGAKEIAVRAWDEGLNTQPEHLIWNVMGMMNNCWFRVKTNVCKPHKGEIGIVFEHPTQPGNQPGGWMAKEKHLEKSQKPKPTLKKSVSTPFMNTSSKMFSISEVKKHSNPDSAWIIVHGHVYDCTRFLKDHPGGTDSILINAGTDCTEEFDAIHSDKAKKLLEDYRIGELITTGYTSDSSPNNSVHGNSEFTHLAPIKETTTPPSRSVALNPREKIPCKLVSKTSISHDARLFRFALPSEDQLLGLSVGKHIFLCATIDGKLCMRAYTPTSSVDEVGFFDLLIKVYFKGVHPKFPNGGLMSQHLDSLPIGSMLDVKGPLGHIEYTGRGNFMVHGKPRFAKRLAMLAGGTGITPIYQVAQAILKDPEDHTEMHVVYANRTEDDILLREELDEWAKIHNDRFKLWYVVEIAKEGWKYSVGFITESITREHLPKASRDSLALTCGPPPMIQFAVQPNLEKMGYDIKNDLLVF

SEQ ID NO: 3238 - protein, 790 aa, Cajanus cajan
MALCTPSFIFLSFFLFLFNLQPSLSQQQQQLTSFNISHSPWHPSQNRTLLSPNKNFTAGFFPLPNSPNLFTFSIWYSKVPITANPLVWSSKTQVNTSGSLVITPKGELFLDGSPFQDASNASSTSNSTQLVLQNDGNLVFGNWTSFKNPTNTVLPNQNFSTGIELHSSNGKYRFIKSQFLVLNSTNDQYYSTPSPLLSMDDAGKMTMAVNSFLTSDYGDPRFRKLVLGDDGNLRIYSFYPEPQNQWVEVWKGIWEMCKIIGRCGPNAICVPTEDLNISTYCVCPSGFSPNPGGPEEGCKRKAPLSQHTHFVRLDYVNYTSDGSVNQINAENFTICESRCSTDKTCLGFGFKYDGSGFCVLLKGTELRYGYWSPGTEAALFLKVDQSESASSNFIGMTEVMQTTCPVNISLPLPPKDSNTTARNIAIICTLFAAELIVGVAFFWSFLKRYIKYRDMATTLGLELLLPAGGPKRFTYSEIKAATNDFSNLIGKGGFGDVYKGELPDHRVVAVKCLKNVAGGEEFWAEVRIIARMHHLNLVRLWGFCAEKGQRILVYEHIPGGSLDKYLFRIKSHLPKDQSSPQPRPVLDWSMRYRIALGVARAIAYLHEECLEWVLHCDIKPENILLGDDFCPKISDFGLAKLRKKEDMVTMSRRRGTPGYMAPEWITADPITAKADVYSFGMVLLELVSGIRNFEIQDSVVRSEEWYFPGWAFDKMFKEMRVEEILDGQIREAYDSRAHFDMVNRMVKTAMWCLQDRPELRPTMGKVAKMLEGTVEITEPKKPTVFFLGEE

SEQ ID NO: 3239 - protein, 792 aa, Phaseolus coccineus
MPLSTPSFFLLTLFFFLLFNLQPSFSQQQFSSFNTSHSPWQPSQNRTLISTNKNFTAGFFPLPNTTLFTFSIWFSQVPNAKGIVWSDTTRVNSSGSLVITSEFELLLNGSPFQDTANTNASQLVLENNGNLVFGNWSSFRNPTNTILPNQNFTGIELLSSNGKFRFIKSQFLVLNSTADQYYGTPNPLVGMDDAGKMSMVGNSFLTSDYGDPRLRKVVLDDDGNLRIYSFYPEQNNKWVEVWKGLWEMCRIKGKCGSNAICVPGEDLNSSTHCVCPSGFNPNQGGSEEGCTRKKSLSQDTKFVRLDYVNYTSDGSLTEIKAGNFTICESGCSTDKTCLGFGFKYDGTGYCVWLTGTNLQFGYWSPGTEAAFFLKVDKSESTPSNFIGLTEVMQTTCPVNLSLPLPPKDSNTTARNIAIICTLFAAELIAGVAFFWSFLKRYIKYRDMATTLGLELLPAGGPKRFTYSEIKAATNDFSNLIGKGGFGDVYKGELPDHRVVAVKCLKNVTGGDAEFWAEVTIIARMHHLNLVRLWGFCAEKGQRILVYEHIPCGSMDKYLFRVNKSHSNNDKHLKDQSSPNTPQQKPTLDWNMRYRIALGVARAIAYLHEECLEWVLHCDIKPENILLGDDFCPKISDFGLAKLRKKEDMVTMSRRRGTPGYMAPEWVNSAEPITSKADVYSFGMVLLELVSGIRNFEIQDSVLRSEEWYFPGWAFDKFKEMRVEEILDRQIRNDYDSRAHFDMVNRMVKTAMWCLQEKPVLRPTMGKVAKMLEGTVEILEPKKPTVFFLGVEE

SEQ ID NO: 3240 - protein, 204 aa, Cajanus cajan
MALSLSSSCVRVPSCFWKQNGKSCKAAPKVSRDNKNPLLGIGIGVVTACVMGLTALDADATRIEYYATVGEPLCEYNYVKSGLGYCDIAEGFGDEAPYAELINIHYTARFADGTVFDSSYKRARPLTMRIGVGKVIKGLDQGILGGEGVPPMRIGGKRKLQIPPHLAYGPEPVGCFSGDCNIPGNATLLYDINFVELYSGNRSK

SEQ ID NO: 3241 - protein, 210 aa, Vigna unguiculata
MALSLCSSVRVPYCSPSCFWKPNGKNCEAPTKLPCAVHSNKNPLVGMGIGLVTAWVMGLTALDADATRIEYYATVGEPLCEYKYVKSGLGYCDIVEGFGVEAPLGELINVHYTARFADGIVFDSSYKRGRSLTMRIGVGKVIRGLDQGILGGEGVPPMRIGGKRKLQIPPQLAYGPEPAGCFSGDCNIPANATLLYDVNFVELYSGNRSR

SEQ ID NO: 3242 - protein, 212 aa, Phaseolus coccineus
MALSLCSGVRVPYCSPSCSWKPNGKNCEAPTKMSCTAVHSDKKNPLVGMGIGLVTAWVMGLTALDADATRIEYYATVGEPLCEYKYVKSGLGYCDIVEGFGVEAPIGELINVHYTARFGDGIVFDSSYKRGRSLTMRIGVGKVIKGLDQGILGGEGVPPMRIGGKRKLYVPPQLAYGPEPAGCFSGDCNIPANATLLYDVNFVELYSGNRSK

SEQ ID NO: 3243 - protein, 213 aa, Medicago truncatula
MALSFSLCSGTTVHNRFPSCMKLNGKSYKVSDKVLCSARNGNEKKPLVGIGIGIVAAWVMGLTALDADATRIEYYATVGEPMCELNYVKSGLGYCDYVEGFGDEAPLGELIDIHYTARFADGIVFDSSYKRARPLTMRIGVGKVIRGLDQGILGGEGVPPMRIGGKRKLTIPPLLAYGPEPAGCFSGDCNIPGNATLLYDIKFVGLYSGNRSQ

SEQ ID NO: 3244 - protein, 309 aa, Glycine max
MKAWVYGEYGGVDVLKLDSNVTVPDVKEDQVLIKVVAAALNPVDAKRRQGKFKATDSPLPTVPGYDVAGVVVKVGSQVKDFKVGDEVYGDVNEKALEGPKQFGSLAEYTAVEEKLLASKPKNLDFAQAAALPLAIETAYEGLERTGFSPGKSILVLNGSGGVGSLVIQLAKQVFGASRVAATSSTRNLDLLKSLGADLAIDYTKENFEDLPEKFDVVYDAIGQCDRAVKAVKEGGSVVALTGAVTPPGFRFVVTSNGAVLRKLNPYLESGKVKPIVDPKGPFSFDKLAEAFSYLETNRATGKVVIHPIP

SEQ ID NO: 3245 - protein, 309 aa, Cajanus cajan
MKAWVYGEYGGVDVLKLDSNVAVPDVNEDQVLVKVVAAALNPVDAKRRQGKFKATDSPLPTVPGYDVAGVVVKVGSQVKEFKVGDEVYGDVNEKALEGPKQFGSLAEYTAVEEKLLAPKPKTLDFAQAASLPLAIETAYEGLERTGFSPGKSILVLNGSGGVGSLVIQLAKQVFGASRVAATSSTRHLDLLKSLGADLAIDYTKENIEDLPEKFDVVYDAIGQCDRAVKVVKEGGSVVALTGAVTPPGFRFVVTSNGAVLRKLNPYLESGKVKPIVDPKGPFSFDQLDEAFSYLETNRATGKVVIHPIP

SEQ ID NO: 3246 - protein, 309 aa, Phaseolus coccineus
MKAWVYGEYGGVDVLKLDSNVAVPDVKEDQVLVKVAAAALNPVDGKRRQGKFKATDSPLPTVPGYDVAGVVVKVGSEVKDFKVGDEVYGDLSEKALEGPKQFGSLAEYTAVEEKLLALKPKNLDFAQAAALPLAIETAHEGLERTAFSPGKSILVLNGSGGVGSLVIQLAKQVFGASRVAATSSTRNLDLLKSLGADLAIDYTKENFEDLSEKFDVVFDAIGQCDRAVKAVKEGGSVVALTGAVTPPGFRFVVTSNGAVLRKLNPYLESGKVKPIVDPKGPFPFDQLAEAFSYLETNRATGKVVIHPIP

SEQ ID NO: 3247 - protein, 215 aa, Cajanus cajan
MKAWVYGEYGGVDVLKLDSNVAVPDVNEDQVLVKVVAAALNPVDAKRRQGKFKATDSPLPTVPGYDVAGVVVKVGSQVKEFKVGDEVYGDVNEKALEGPKQFGSLAEYTAVEEKLLAPKPKTLDFAQAASLPLAIETAYEGLERTGFSPGKSILVLNGSGGVGSLVIQLAKQVFGASRVAATSSTRHLDLLKSLGADLAIDYTKENIEDLPENLM

SEQ ID NO: 3248 - protein, 309 aa, Vigna unguiculata
MKAWVYGEYGGVEVLNLDSNVAVPDVKEDQVLVKVAAAALNPVDAKRRQGKFKATDSPLPTVPGYDVAGVVVKVGSEVKDFKVGDEVYGNVSEKALDGPKQFGSLAEYTAVEEKLLAAKPKNLDFSQAASLPLAIETAYEGLERTGFSPGKSILVLNGSGGVGSLAIQLAKQVFGASRVAATSSTRNLELLKSLGADLAIDYTKENFEDLSEKFDVVFDAIGQCERAVKAVKEDGGVVALTGAVTPPGFRFVVTSNGSVLRKLNPYLESGKVKAIVDPKGPFSFAQLAEAFSYLETNRATGKVVIHPIP

SEQ ID NO: 3249 - protein, 309 aa, Lotus japonicus
MKAWVYGEYGGVDVLKFDSNVAVPDLKEDQVLVRVVAAALNPVDAKRRQGKFKATDSPLPTVPGYDVAGVVVKVGSEVKEFRVGDEVYGDVNEKALEGPKQFGSLAEYTAVEEKLLAPKPKNLDFAQAASLPLAIETAYEGLERTGFSSGKSILVLNGSGGVGSLVIQLAKQVFGAARVAATSSTRNLELLKSLGVDLAIDYTKENFEDLPEKFDVVYDAIGQCDRAVKAIKEGGSVVALTGAVTPPGFRFVVTSNGTVLRKLNPYLESGKVKPIVDSKGPFPFTQLAEAFSYLETNRATGKVVIHPIP

SEQ ID NO: 3250 - protein, 309 aa, Cicer arietinum
MKAWVYGEYGGVDVLKFDSSIAVPDVKEDQVLVRVFAAALNPVDGKRRQGKFKATDSPLPTVPGYDVAGVVVKVGSEVKDFKVGDEVYGDVNEKALEGPKQFGSLAEYTAVEEKLLALKPKNLDFAQAASLPLAIETAYEGLERTGFSAGKSILVLNGSGGVGSLVIQLAKQVFGASRVAATASTRNLELLKSLGADLAIDYTKENFEDLPEKFDVVYDAIGQCDRAVKAIKEGGSVVALTGAVTPPGFRFVVTSNGAVLKKLNPYLESGKVKPIVDPKGPFPFDQVVEAFSYVETNRATGKVVIYPIP

SEQ ID NO: 3251 - protein, 309 aa, Arachis hypogaea
MKAWVYGEYGGVDVLKFDSSVGVPDVKEDQVLVKVVAAALNPVDAKRRQGKFKATDSPLPTVPGYDVAGVVVKVGSKVKDFKVGDEVYGDVNEKALEGPKQFGSLAEYTAVEERLLAPKPKNLNFAEAASLPLAIETAYEGLERLGFSPGKSILVLNGSGGVGTLVIQLAKKVFGASRVAATSSTRNLELLKSLGADLAIDYTKENFEDLPEKFDVVYDAIGQCEKAVKAVKEGGSVVALTGAVTPPGFRFVVTSNGAVLRKLNPYLESGQVKPVVDPKGPFSFAQLVEAFTYLETNRATGKVVISPIP

SEQ ID NO: 3252 - protein, 309 aa, Trifolium pratense
  misc_feature (117)..(117): Xaa can be any naturally occurring amino acid
MKAWVYGEYGDVDVLKFDSSVAVPDVKEDQVLVKVVAAALNPVDGKRRQGKFKATDSPLPTVPGYDVAGIVVKVGSGVKEFKVGDEVYGDVNEKALEGPKQFGSLAEYTAVEEKLLXLKPKNLDFAQAASLPLAIETAYEGLERTGFSSGKSILVLNGSGGVGSLVIQLAKQVFGASRVAATSSTRHLELLKSLGADLAIDYTKENFEDLPEKFDVVYDAIGQCDRAVKAIKEGGSVVALTGAVTPPGFRFVVTSNGDVLKKLNPYLESGNVKPIIDPKGPFNFAQVAEAFSYIETNKATGKVVIFPIP

SEQ ID NO: 3253 - protein, 292 aa, Cajanus cajan
MYTLKELLRATKDFHQDNKIGEGGFGSVYFGRTSKGVQIAVKRLKTMTAKAEMEFAVEVEVLGRVRHKNLLGLRGFYAGGDERLIVYDYMPNHSLLTHLHGPLAKECQLDWPRRMSIAIGAAEGLAYLHHESTPHIIHRDIKASNVLLDHEFQAKVADFGFAKLVPDGVTHLTTKVKGTLGYLAPEYAMWGKVSESCDVYSFGILLLEIISAKKPIEKFPGGVKRDIVQWITPYVNKGLFNNVADPKLKGKFDLEQLKTMITIALRCTDNSADKRPSMKEVVDWLKNGTGST

SEQ ID NO: 3254 - protein, 324 aa, Glycine max
MHLKQYCCFLKDERQSKIQVANKKNNRDYPWEMYTLKELLRATNNFDQDNKIGEGGFGSVYFGRTSKGVQIAVKRLKTMTAKAEMEFAVEVEVLGRVRHKNLLGLRGFYAGGDERLIVYDYMPNHSLLTHLHGPLAKKCQLDWPRRMSIAIGTAEGLAYLHHESTPHIIHRDIKASNVLLDAEFQAKVADFGFAKLVPDGVTHLTTKVKGTLGYLAPEYAMWGKVSESCDVYSFGILLLEIISAKKPIEKFPGEVKRDIVQWVTPYINKGLFNNIADPKLKGKFDLEQLKNVTTIALRCTDSSADKRPSMKEVVDWLKNGVGNT

SEQ ID NO: 3255 - protein, 324 aa, Phaseolus coccineus
MNFKQYCCFLLDEGQSKIQIAKKKNSRGYPWEMYTLKELLRATNNFHQDNKIGEGGFGSVYFGRTSKGVQIAVKRLKTMTAKAEMEFAVEVEVLGRVRHKNLLGLRGFYAGGDERLIVYDYMPNHSLLTHLHGPLAKECQLDWPRRMSIAIGAAEGLVYLHHESTPHIIHRDIKASNVLLDSEFQSKVADFGFAKLVPDGVTHLTTKVKGTLGYLAPEYAMWGKVSESCDVYSFGILLLEIISAKKPIEKFPGGVKRDIVQWATPYVNKGLFSNIADPKLKGKFDLQQLKNVITIALRCTDTSADKRPNMKEVVEWLKNGVGST

SEQ ID NO: 3256 - protein, 317 aa, Glycine max
MATLTVPPVPPSPRDDAMQLYRAFKGFGCDTSAVINILAHRDATQRAYIQQEYRSMYSEELSKRLASELSGKLETAVLLWLHDPAGRDATIIRKSLTADNRSIEGATEVICSHTPSQLQYLKQIYHSMFGVYLEHDIQTNTSPGDHQKLLLAYISTPRHEGPEVNREIAQKDAKALYKAGEKKLGTDEKTFIHIFSERSAAHLAAVSSYYHDMYGHSLKKAVKNETSGAFEHALLTIIQCAVNPGKYFAKVLRKAMKGLGTDDSTLIRVIVTRTEVDMQYIKAAYLKKHKKTLNDEVHSETSGHYRTFLLSLLGPNH

SEQ ID NO: 3257 - protein, 315 aa, Cajanus cajan
MATLSVPPVPPSPRDDAMQLYRAFKGLGCDTSAVINILAHRDATQRAYIQQEYRAMYSEELSKRLASELSGKLETAVLLWMHDPARRDSTIIRQSLIDRTLKGATEVICSRSPSQLQYLKQIYHSMFGVYVEQDIQINTSLGDHQKLLLAYLSTPRHEGPEVNREIAEKDAKVLYKAGEKKLGTDEKTFIHIFSERSAAHLAAVSSYYHDMYGHSLKKAVKNETSGHFAHALLTIIQCAVNPGIYFTKVLRKAMKGLGTDDSTLIRVIVTRTEVDMQYIKAEYLKKHKKTLNDEVHSETSGHYRAFLLSLLGPNH

SEQ ID NO: 3258 - protein, 317 aa, Vigna unguiculata
MATLTVPPVPPSPRDDALQLYRAFKGLGCDTSAVINLLAHRDATQRAYIQQEYKTMYSEELSKRLASELSGKLESAVLLWLKDPAGRDASIIRKSLVEVRSLEGATEVICSRTPSQLQYLKQVYHSLFGVYLEHDIQANTSPGSDHQKLLLAYISTPRPEGPEVNREIAQKDAKVLYKAGEKKLGTDEKTFIHIFSERSAAHLAAVSAYYHDMYGHSLKKAIKNETSGLFELALLTIVQCAIHPGKYFAKVLHKAMKGLGTDDSTLIRVIVTRTEVDMQYIKAEYSKKHRKTLNDAVHSETSGHYRAFLLSLLGPNI

SEQ ID NO: 3259 - protein, 317 aa, Phaseolus coccineus
MATLTVPPVPPSPRDDAVQLYRAFKGMGCDTSAVINILAHRDATQRAYIQQEYKTMYSEELSKRLASELSGNLETAVLMWLKDPAGRDAAIIRKSLIEIRDNIGATEVICSRTPSQLQYLKQIYHSLFGVYLENDIQATTSPGSDHQKLLLAYISTPRPEGPEVNREIAQKDAKALYKAGEKKLGTDEKTFIHIFSERSAAHLATVSAYYHDMYGHSLKKAIKKETSGPFEHALLTIIQCAIHPGKYFAKVLHKAMKGLGTNDSTLIRVIVTRTEVDMQYIKAEYSKKHRKTLNDEVHSETSGHYRAFLLSLLGPNI

SEQ ID NO: 3260 - protein, 317 aa, Phaseolus coccineus
MATLTVPPVPPSPRDDAVQLYRAFKGMGCDTSAVINILAHRDATQRAYIQQEYKTMYSEELSKRLASELSGNLETAVLMWLKDPAGRDAAIIRKSLIEIRDNIGATEVICSRTPSQLQYLKQIYHSLFGVYLENDIQATTSPGSDHQKLLLAYISTPRPEGPEVNREIAQKDAKALYKAGEKKLGTDEKTFIHIFSERSAAHLATVSAYYHDMYGHSLKKAIKKETSGPFEHALLTIIQCAIHPGKYFAKVLHKAMKGFGTNDSTLIRVIVTRTEVDMQYIKAEYSKKHRKTLNDEVHSETSGHYRAFLLSLLGPNI

SEQ ID NO: 3261 - protein, 315 aa, Cicer arietinum
MATLVVPPIPPSPRDDATHLYRAFKGFGCDTSAVINILAHRDATMRAYIQMEYKTTYSEELSKRLASELTGKLETAVLLWMHDPAGRDAEIIRKSLIVDRNLEAATEVICSRTPSQLQFLKQLYHSKFGVYLEHEIELNTSGDHQKILLAFISTPRHEGPEVNREISQKDAKVLYKAGEKKLGTDEKTFVHIFAERSAAHLAAVSSYYHDMYGHSLQKAVKNEASGNFGHALLTIIQCATNPGKYFAKVLHKAMKGLGTNDSTLIRVIVTRTEIDMQYIKAEYSKKYKKTLNDAVHSETSGHYRTFLLSLLGPNH

SEQ ID NO: 3262 - protein, 315 aa, Lotus japonicus
MATLTVPPVPPTPRDDAMQLYRAFKGFGCDTTAVINILAHRDATQRAYLQQEYKATYAEELSKRLISELSGKLETAVLLWMHDPAGRDATIIRQCLAVDMNFEGATEVICSRTPSQLQYLKQIYHSKFGVYLEHDIEATTSGDLKKILLAYVSTPRPEGPEVNREIAQKDAKVLYKAGEKKLGTDEKAFVHIFSERSGAHLAAISSYYHDMYGHKLNKAIKNETSGIFAHALLTIFQCAVNPAKYFAKVLHKAMKGLGTNDTTLIRVIVTRTEIDMQYIKAEYLKKYKKTLNDAVHSETSGHYRAFLLALLGPNH

SEQ ID NO: 3263 - protein, 315 aa, Trigonella foenum-graecum
MATLTLPPVPPSPRDDAMQLYRAFKGFGCDTTAVINILAHRDATQRAYLQQEYKATYSEELSKRLVSELKGKLETAVLLWLHDPAGRDAEIIRKSLVVDRNLEAATEVICSRTPSQLQYLKQLYHSKFGVYLEHEIELNTSGDHQKILLRYLSTPRHEGLEVNRDIAQKDAKVLYKAGEKKLGTDEKTFIQIFSERSGPHLAAVSSYYHDMYGHSLKKAVKNEASGNFGLALLTISECATNPAKYFAKVLYKAMKGMGTNDSTLIRVIVTRTEIDMQYIKAEYRKKYNKTLNDAVHSETSGNYRDFLLALLGPNH

SEQ ID NO: 3264 - protein, 315 aa, Medicago truncatula
MATLILPPIPPSPRDDAMQLYRAFKGFGCDTTAVINILAHRDATQRAYLQQEYKATYSEELSKRLISELKGKLETAVLLWLPDPAARDAEIIRKSLVVDRNLEAATEVICSRTPSQLQYLKQLYHSKFGVYLEHEIELNTSGDHQKILLRYLTTPRHEGLEVNREIAQKDAKVLYKAGEKKLGTDEKTFVQIFSERSSAHLAAVSSYYHDMYGHSLKKAVKNEASGNFGLALLTITECATNPAKYFAKVLYKAMKGMGTNDSTLIRVIVTRTEIDMQYIKAEYAKKYKKTLNDAVHSETSGNYRDFLLALLGPNH

SEQ ID NO: 3265 - protein, 315 aa, Medicago truncatula
MATLVVPPIPPSPRDDAMQLYRAFKGFGCDTSAVINILAHRDATQRAYIQQEYRTTYAEELSKRLISELSGKLETAVLLWMPDPAGRDAEIIRKSLIVDKNLEAATEVLCSRAPSQLQYLKQLYHSKFGVYLEHEIESNTSGDLQKILLAYVSTPRLEGPEVNREIAEKDAKVLYRAGEKKLGTDEKTFIQIFSERSGAHLVAVSAYYHDMYGHSLKKAVKNETSGNFGHALRTIIQCAHNPAKYFAKVLYKAMKGLGTNDTTLIRVIVTRTEIDMKYIKAEYAKKYKKTLNDAVHSETSGNYRAFLLALLGPNN

SEQ ID NO: 3266 - protein, 315 aa, Trigonella foenum-graecum
MATLVVPPVPPSPRDDAMQLYRAFKGFGCDTSAVINILAHRDATQRSYIQQEYRTTYAEELSKRLVSELSGKLETAVLLWMPDPAGRDVDIIRKSLIVDKNLEAATEVICSRTPSQLQYLKQIYHSKFGVYLEHEIESNTSGDLQKILLAYVSTPRLEGPEVNREIAEKDAKVLYRAGEKKLGTDEKTFVEIFSQRSGAHLVAVSSYYHDMYGHSLKKAVKNETSGNFGLALLTIIKCATNPPKYFAKVLYKAMKGLGTNDNTLIRVIVTRTEIDMKYIKAEYAKKYKKTLNDAVHSETSGQYRAFLLALLGPNN

SEQ ID NO: 3267 - protein, 315 aa, Arachis hypogaea
MSTLIVPPIPPSPRDDAMQLYRAFKGFGCDTSAVINILAHRDATQRAYIQQEYRTIYSEELSKRLEKELRGKLETAVLLWMHDPAGRDATIVRKCLTVDANIQGATEVICSRTPSQLQHLRQIYHSKFGTYMEHDIEATTFGDHKKILLAFLTTPRHEGYEVNREIAQQDAKFLYKAGEKKLGTDEKAFIRIFSERSAAHLAAISSYYHDMYGHSLEKAVKNETSGHFAYALLTIVRCAEHPGKYFAKVLHKAMKGLGTNDATLIRVIVTRTEIDMQYIKAEYLKKYRKTLNDAVHSETSGHYRDFLLQLLGPNV

SEQ ID NO: 3268 - protein, 315 aa, Glycine max
MATLNVPPLPPSPRDDAIQLYAAFKGFGCDTSVVINILAHRDATQRAYIQQEYKAMYSGDLLKRLSSELSGKLETALLLWMHDPAGRDAIILRQSLTLPKNLEAATQLICSRTPSQLHYLRQIYHSKFGVYLEHDIETNTSGDHKKILLAYVTTPRHEGPEVNREMAEKDAKVLYKAGEKRLGTDEKTFVQIFSERSAAHLAAITSYYHSMYGHSLKKAVKKETSGNFALALLTIVQCAENPAKYFAKVLRKAMKGLGTDDTKLIRVIVTRAEIDLQYIKAEYLKKYKKTLNDAVHSETSGHYRAFLLSLLGPNQ

SEQ ID NO: 3269 - protein, 503 aa, Glycine max
MATAAVIGLSGGKRLLSSSYHYSDIIEKLSYGSDFGSTHYQIVPTKSLIVAKKSSNYTPTFPASNQQNQSIKALKEHVDDAPTIADPWFQSYNSNDLEVESSEMGYSVEALLLLQKSMLEKQWNLSFEREVLTENSSKGKKCRKVAVTCSGVSARQRRMNTKRKTAIKTCGAMQLKSKISPELLQHRLKGYVKGLVSEELLSHAEVVNLSEKIKVGLSLEEHKSRLKEKLGCEPSDDQMATSLKISRTELRARMIECSLAREKLAMSNVRLVMSIAQKYDNLGAEMGDLVQGGLIGLLRGIEKFDSSKGFKISTYVYWWIRQGVSRALVENSRTLRLPAHLHERLSLIRNAKFRLEERGITPTIDRIAKYLNMSQKKVRNATEAISKIISLDREAFPSLNGLQGETHHSYIADNRVENIPWNGVDEWALKDEVNRLINVTLVEREREIIRLYYGLEKECLTWEDISKRIGLSRERVRQVGLVALEKLKHAARKRQMEAMLLKH

SEQ ID NO: 3270 - protein, 510 aa, Cajanus cajan
MATAAVIGLSGGKRLLSSSYHYSDIIEKLSCGSDFGSTHYQIAPTKSVIVSKKSSNYTSTFPASNRQNESIKALKEHVDGAPTTADPWFHSCNSNELEVESSEMGYSVEALLLLQKSMLEKQWNLSFEREVLTEHSSKEKNCRKVAVTCSGVSARQRRMNLKRKTAVKTGSSMVQPCGAVQLKSKISPELLQNRLKGYVKGVVSEELLSHAEVVNLSEKIKVGLSLDEHKSRLKERLGCEPSEDQIATSLKISCTELRERMLECSLAREKLTMSNVRLVMSIAQRYDNLGAEMADLVQGGLIGLLRGIEKFDSSKGFKISTYVYWWIRQGVSRALIENSRTLRLPAHLHERLSLIRNAKFRLEERGITPTIERIAKHLNMSQKKVRNATEAISTVISFDREAFPSLNGIQGETHHSYIADNRVENIPWNGVDEWALKDEVNKLINVTLVEREREIIRLYYGLDKECLTWEDISKRIGLSRERVRQVGLVALEKLKHAARKREMEAMLLKH

SEQ ID NO: 3271 - protein, 504 aa, Phaseolus coccineus
MASAAVIGLSGGKRLLSSSYHYSDIIEKLSYGSDFGSTHYQIVSTKSVIVAKKSSNYTPTFPAPNRQNQSIKVLKEIVDDAATVADAWFQSLSSNDLEVESSEMGYSVEALLLLQKSMLEKQWSLSFEGEGVTEHSSKEKNCRKVAAVTCSGVSARQRRMNAKRKTAVKTGGAVQLKSKISPELLQNRLKGYVKGVVSEELLSHAQVVSLSEKIKVGLSLEEHKSRMKERLGCEPSDDEIATSLKISSTELREKMLECSLAREKLAMSNVRLVMSIAQRYENAGTEMGDLVQGGLIGLLRGIEKFDSSKGFKISTYVYWWIRQGVSKALIENSRTLRLPAHLHERLSLIRNAKLRLEERGITPTIDRIAQHLNMSQKKVRNATEAISKTISLDREAFPSLNGLRGDTHHSYIADNRVENIPWEGVDEWALKDEVNRLINVTLKEREREIIRLYYGLGKECLTWEDISKRMGLSRERVRQVGLVALEKLKHGARNRELEAMLLKH

SEQ ID NO: 3272 - protein, 504 aa, Phaseolus coccineus
  misc_feature (225)..(225): Xaa can be any naturally occurring amino acid
  misc_feature (227)..(227): Xaa can be any naturally occurring amino acid
MASAAVIGLSGGKRLLSSSYHYSDIIEKLSYGSDFGSTHYQIVSTKSVIVAKKSSNYTPTFPAPNRQNQSIKVLKEIVDDAATVADAWFQSLSSNDLEVESSEMGYSVEALLLLQKSMLEKQWSLSFEGEGVTEHSSKEKNCRKVAAVTCSGVSARQRRMNAKRKTAVKTGGAVQLKSKISPELLQNRLKGYVKGVVSEELLSHAQVVSLSEKIKVGLSLEEHKXRXKERLGCEPSDDEIATSLKISSTELREKMLECSLAREKLAMSNVRLVMSIAQRYENAGTEMGDLVQGGLIGLLRGIEKFDSSKGFKISTYVYWWIRQGVSKALIENSRTLRLPAHLHERLSLIRNAKLRLEERGITPTIDRIAQHLNMSQKKVRNATEAISKTISLDREAFPSLNGLRGDTHHSYIADNRVENIPWEGVDEWALKDEVNRLINVTLKEREREIIRLYYGLGKECLTWEDISKRMGLSRERVRQVGLVALEKLKHGARNRELEAMLLKH

SEQ ID NO: 3273 - protein, 509 aa, Lotus japonicus
MATAAVIGLSGGKRLLSSSYYYSDIIEKLSCSSDFGSTHYQIVPAKSVTVAKKSSDYTQAFPASDRPNQSIKALKEHVDGVPAAAETWFQECDSNDLEVESSDLGYSVEALLLLQKSMLEKQWSLSCEREVLTEHPRQEKSSKKVAVTCSGVSARQRRINTKRKIPGKTGSAMQACDAMQMRSLISPELLQNRSKGYVKGVVSEQLLSHAEVVKLSEKIKVGLSLDEHKSRLKEKLGCEPSDDQIAASLKISRSELRAKTIECTLARERLAMSNVRLVMSIAQRYDNMGAEMADLVQGGLIGLLRGIEKFDSSKGFKISTYVYWWIRQGVSRALVENSRTLRLPTHLHERLSLIRTAKFRLEERGITPTIDRIAKSLNMSQKKVRNATEAISKVFSLDREAFPSLNGLPGDTHHCYIADNRLENIPWHGVDEWTLKDEVNKLINVTLVEREREIIRLYYGLDKECLTWEDISKRIGLSRERVRQVGLVALEKLKHAARKREMEAMLLKH

SEQ ID NO: 3274 - protein, 335 aa, Medicago truncatula
MATAAVIGLSGGKRLLSSSYHYSDIIEKFSHACDFGSTQYQLPPSKSVIVAKKSSKYTPTFPPERKNQSIKALKEHVVDSAQADSEQWFQGYNSNDFEVESSDMDYSLDSLLLLQKSMLEKQWSLSFERKVLSENSRREKIRRKVSVTCSGVSARQRRMTTKRKVAAKSGSAVMQLRSTISPELIQNRLKGYVKGVVCDELLSHAEVVKLSEKIKAGLSLDEHKSRLKERLGSEPSDDQVATSLKISRADLRAKIIECSLAREKLTMSNVRLVLSIAQRYDNMGAEMGDLVQGGLIGLLRGIEKFDSSKGFKISTYVYWWIRQGVSRALVENSRH

SEQ ID NO: 3275 - protein, 469 aa, Medicago truncatula
MATAAVIGLSGGKRLLSSSYHYSDIIEKFSHACDFGSTQYQLPPSKSVIVAKKSSKYTPTFPPERKNQSIKALKEHVVDSAQADSEQWFQGYNSNDFEVESSDMDYSLDSLLLLQKSMLEKQWSLSFERKVLSENSRREKIRRKVSVTCSGVSARQRRMTTKRKVAAKSGSAVMQLRSTISPELIQNRLKGYVKGVVCDELLSHAEVVKLSEKIKAGLSLDEHKSRLKERLGSEPSDDQVATSLKISRADLRAKIIECSLAREKLTMSNVRLVLSIAQRYDNMGAEMGDLVQGGLIGLLRGIEKFDSSKGFKISTYVYWWIRQGVSRALVENSRTLRLPAHLHERLSLIRNAEYKLEERGITPTIDRIAKSLNMSQRKVRNATEATSKVFSLDREAFPSLNGLPGDTHHSFIADKQNENIPWNVVDEWALKEEVNRLINLTLVERERELFVFIMDWIKNVLHGKTLVNG

SEQ ID NO: 3276 - protein, 348 aa, Glycine max
MCQALSAPSPPCTALLSFLFFLLTVVGPVSVSAWRPWPQKNNMNTTDYAFGDSKKYEGSSEFVKLRYHMGPVLTTNITVHTIWYGKWERNQKKIIREFINSISAANSAHPSVAGWWRTVQLYTDQTGANISKSVRLGEEKNDRFYSHGKSLTRLSIQTVIKSAITAKTRPLPINPRSGLYLLLTADDVYVQDFCTSVCGFHYFTFPSLVGYTLPYAWVGNSAKFCPGQCAYPFAVPAYIPNRKPFKSPNGDVGVDGMISVIGHEMAELATNPLANAWYAGQDPSFPVEIADLCEGIYGTGGGGSYTGQVLDARDGATYNMNGIRRRFLVQWVWSHVLNYCTGPNALDH

SEQ ID NO: 3277 - protein, 348 aa, Vigna unguiculata
MCQGLSAASPPFAAFLSLTLVVFSLLAGGPVAAWRPWPQNGKMNVTDYAFGDSKKYEGSSEFVKLRYHMGPVLTTNITVHTIWYGKWDRSQKKIIREFINSISATNSPHPSVAGWWRTVQLYTDQTGANISKTVRLGEEKNDRFYSHGKSLTRLSIQSVIKSAITAKTRPLPINPRSGLYLLLTADDVYVQDFCTSVCGFHYFTFPSLVGYTLPYAWVGNSAKLCPGQCAYPFALPAYIPNQKPFKSPNGDVGVDGMISVIGHEMAELASNPLANAWYAGQDPSFPVEIADLCEGIYGTGGGGSYTGQVLDARDGATYNMNGIRRRFLVQWLWSHVLNYCTGPNALDH

SEQ ID NO: 3278 - protein, 348 aa, Phaseolus coccineus
MCLGLSAPAPPSTVVLFFSLFLFALLAGGPVAAWRPWPQTAQMNVTDYAFGDSKKYEGSSEFVKLRYHMGPVLTTKITVHTIWYGKWERSQKKIIREFINSISAANSPHPSVAGWWRTVQLYTDQTGANISKTVRLGEEKNDRLYSHGKSLTRLSIQSVIKSAITARTRPLPINPRSGLYLLLTADDVYVQDFCTSVCGFHYFTFPSLVGYTLPYAWVGNSAKLCPGQCAYPFAVPAYIPNLKPFKSPNGDVGVDGMISVIGHEMAELTTNPLANAWYAGQDPSFPVEIADLCEGIYGTGGGGSYTGQVLDARDGATYNMNGIRRRFLVQWLWSHVLNYCTGPNALDH

SEQ ID NO: 3279 - protein, 365 aa, Vigna unguiculata
LGSLTPASVLPPPHTLKMCQGLSAASPPFAAFLSLTLVVFSLLAGGPVAAWRPWPQNGKMNVTDYAFGDSKKYEGSSEFVKLRYHMGPVLTTNITVHTIWYGKWDRSQKKIIREFINSISATNSPHPSVAGWWRTVQLYTDQTGANISKTVRLGEEKNDRFYSHGKSLTRLSIQSVIKSAITAKTRPLPINPRSGLYLLLTADDVYVQDFCTSVCGFHYFTFPSLVGYTLPYAWVGNSAKLCPGQCAYPFALPAYIPNQKPFKSPNGDVGVDGMISVIGHEMAELASNPLANAWYAGQDPSFPVEIADLCEGIYGTGGGGSYTGQVLDARDGATYNMNGIRRRFLVQWLWSHVLNYCTGPNALDH

SEQ ID NO: 3280 - protein, 339 aa, Cajanus cajan
MCPTPSPLLPLLLLLLAVAPASAWRPWPPRNNKMNTTDYAFGDSKKYEGSSEFVKLRYHMGPVLTSNITVHTIWYGKWEKRQKKIIREFINSISATAAPHPSVAGWWRTVELYTDQTGSNISKTVRLGEEKNDRLYSHGKSLSRLWIQSVIKSAITAKTRPLPINPRSGLYLVLTADDVYVQDFCTSVCGFHYFTFPSLVGYTLPYAWVGNSARFCPGQCAYPFAVPPYIPNRKPFKSPNSDVGVDGMISVIGHEMAELATNPLANAWYAGQDPSFPVEIADLCEGIYGTGGGGSYTGQVLDARDGATYNMNGIRRRFLVQWVWSHVLNYCTGPNALDH

SEQ ID NO: 3281 - protein, 341 aa, Arachis hypogaea
MNTAVHSNVAILVLVVLFAADPAAAWRPWPQNANRMNVSDYAFGDSKKYEGSSEFVKLRYHMGPVLTTNITVHTIWYGRWERNQKKIIREFINSISAVNSPHPSVAAWWRTVQLYTDQTGANISKSVRLGQEKNDRFYSHGKSLTRLSIQSVIKSAITARTKPLPINPRSGLYLLLTADDVYVQDFCTSVCGFHYFTFPSLVGYTLPYAWVGNSEKLCPGQCAYPFAVPAYIPNMKPFKSPNSDVGVDGMISVIGHEMAELATNPLANAWYAGQDPTFPVEIADLCEGIYGTGGGGSYTGQVLDAHDGATYNMNGIRRKYLVQWVWSHVLNYCTGPNALDH

SEQ ID NO: 3282 - protein, 308 aa, Phaseolus coccineus
AQMNVTDYAFGDSKKYEGSSEFVKLRYHMGPVLTTKITVHTIWYGKWERSQKKIIREFINSISAANSPHPSVAGWWRTVQLYTDQTGANISKTVRLGEEKNDRLYSHGKSLTRLSIQSVIKSAITARTRPLPINPRSGLYLLLTADDVYVQDFCTSVCGFHYFTFPSLVGYTLPYAWVGNSAKLCPGQCAYPFAVPAYIPNLKPFKSPNGDVGVDGMISVIGHEMAELTTNPLANAWYAGQDPSFPVEIADLCEGIYGTGGGGSYTGQVLDARDGATYNMNGIRRRFLVQWLWSHVLNYCTGPNALDH

SEQ ID NO: 3283 - protein, 347 aa, Lotus japonicus
MWKGFSTPSPPSSVVLLSLTIVLSSLLPLAAAWRPWPQNNKMNATDYVFEDSKKFEGSSEFVKLRYHMGPVLTSRITVHTIWYGKWERSQKKIIRGFINSISATEVPRPSVAGWWRTVQQYTDQTRSNISRTVQLGEEKNDRFYSHGKSLTRLTIQSVIKSAITATTKPLPINPKSGLYLLLTADDVFVQDFCTSVCGFHYFTFPSLVGYTLPYAWVGNSAKLCPGQCAYPFAVPAFIPNRKPFKSPNGDVGVDGMISVIGHEIAELATNPLANAWYAGQDPTFPVEIADLCEGIYGTGGGGSYTGQVLDGGDGATFNMKGIRRRFLVQWVWSHVLNFCTGPNALDI

SEQ ID NO: 3284 - protein, 123 aa, Medicago truncatula
MLKTSPTQPPPYTVALPLTILLLSLLTVDPVTAYRPWPQNPTKNITDYAFGTSKKYEGSSEFVKLRYHMGPVLTNIITVHTIWYGNWQKKPKENYTRVYKLNLSQKHTSSFSFRLVENRYALH

SEQ ID NO: 3285 - protein, 347 aa, Cicer arietinum
MSKLFPPPSMVVLTLTITLFSFLLTAAPTTGYRPWPQNPQTKNLTDYAFGTSKKYEGSSEFVKLRYHMGPVLTNIITVHTIWYGNWQRSQKKIIREFINSISAKNSPNPSVSGWWKTVMLYTDQTGSNISNTVQLGSEKNDRFYSHGKTLTRLTIQSVIKSAITAKTKPLPINPRSGLYLLLTSDDVYVQDFCTSACGFHYFTFPSLVGYTLPYAWVGNSAKLCPGMCAYPFAVPEYIPNVKPFKSPNGDVGVDGMISVIGHEIAELASNPLANAWYAGSDPSFPVEIADLCEGIYGTGGGGSYTGQVLDARDGATYNMNGIRRKFLVQWLWSHVLNYCTGPNALDH

SEQ ID NO: 3286 - protein, 229 aa, Medicago truncatula
MLYTDQTGSNISNTVHLGQEKNDRFYSHGKTLTRLSIQSVIKSAIRAKTKPLPINPRSGLYLLLTSDDVYVQDFCTSACGFHYFTFPSLVGYTLPYAWVGNSEKFCAGQCAYPYAVPQFMPNVKPFKSPNGDVGVDGMISVIGHELAELASNPLANAWYAGGDPSFPVEIADLCEGIYGTGGGGSYTGQVLDDHDGATYNMNGIRRKFLVQWLWSHVLNYCTGPNALDH

SEQ ID NO: 3287 - protein, 110 aa, Trigonella foenum-graecum
MPNVKPFKSPNGDVGVDGMISVIGHELAELASNPLANAWYAGGDPSFPVEIADLCEGIYGTGGGGSYTGQVLDDRDGATYNMNGIRRKFLVQWLWSHVLNYCTGPNALDH

SEQ ID NO: 3288 - protein, 420 aa, Glycine max
MDINEIDVPSFFLCPISLEIMKDPVTVSTGITYDRESIETWLFSKKNTTCPMTKQPLIDYTDLTPNHTLRRLIQAWCTMNTSHGIERIPTPKPPINKNQISKLLKDASHSPLTCLRRLKSIASGSETNKRCMEASGVVEFLASIVINNNNIVSSNEADSNEGSGFELRTSASDEALSLLHNLHLSDQGLKTLLSFKTGDFIESLTRVMQKGFFESRAYAVFLLKSMSEVAEPVQLLHLRQDLFVELVQVLKDQISQKTSKATLQTLIQFSPWGRNRIKAVEAGTVPVLVELLLDCKERKPCEMMLVLLEILCQCAEGRAELLNHAAGLAIVSKKILRVSTLANDRAVKILLSVSRFSATPHVVQEMLKLGVVAKLCLVLQVDSGNKAKEKAREILKLHARAWRNSPCIPNNLLNSYPNYV

SEQ ID NO: 3289 - protein, 420 aa, Cajanus cajan
MDNEIDVPSFFVCPISLEIMKDPVTVSTGITYDRESIETWLFSKKNTTCPVTKQPLLDYTDLTPNHTLRRLIQAWCTMNASHGIERIPTPKPPVNKTQISKLLKDASHSPLICLRRLKSIASGSETNKRCMEASGAVEFLASIVMNNNVDSSNLPQADPRYGSGFDLRTSASDEALGLLHNLGLSEQGLKTLLSLKNGEFIESLTRVMQKGFFESRAYAVFLLRSMAEVADPVQLLHLRQELFVELVQVLKDQISLKTSKATLQTLIQFSPWGRNRIKAVEAGTVPVLVELLLDCKERKPCEMMLVLLETLCQCAEGRAELLSHGAGLAIVSKKILRVSTLANDRAVRILFFVSKFSATPHVLQEMLKLGVVAKLCLVLQVDSGNKAKEKAREILKLHARAWKNSPCIPNNLLGSYPGYV

SEQ ID NO: 3290 - protein, 418 aa, Phaseolus coccineus
MDNDIDVPSFFLCPISLQIMKDPVTVSTGITYDRECIETWLFSRKNTTCPITKQPLTDYTDLTPNHTLRRLIQAWCTMNASHGIERIPTPKPPVNKTQISKLLKDASHSPLTCLRRLKSIASGSETNKRCMEAAGAVEFLASIVVNNNNDSSNGVDPNDGSGFELKTTASDEALSLLHTLDLSEQGLKTLISFRNGDFIESLTRVMQKGFFESRAYAVFLLKSMSEVADPVKLLHLRQELFVELVQVLKDQISTKTSKDIIQTLIQFSPWGRNRIKAVEAGTVPVLIELLLDCKDRKPCEMMLVLLEILCQCAEGRAELLSHGAGLAIVSKKILRVSTLANDRAVRILLCVSKFSATPHVVQEMLKLGVVAKLCLVLQVDSGNKAKEKAREILKLHARVWKNTPCIPNNMLSSYPAYA

SEQ ID NO: 3291 - protein, 418 aa, Phaseolus coccineus
  misc_feature (6)..(6): Xaa can be any naturally occurring amino acid
MDNDIXVPSFFLCPISLQIMKDPVTVSTGITYDRECIETWLFSRKNTTCPITKQPLTDYTDLTPNHTLRRLIQAWCTMNASHGIERIPTPKPPVNKTQISKLLKDASHSPLVCLRRLKSIASGSETNKRCMEAAGAVEFLASIVVNNNNDSSNGADPNDGSGFELKTTASDEALSLLHTLDLSEQGLKTLISFRNGDFIESLTRVMQKGFFESRAYAVFLLKSMSEVADPVKLLHLRQELFVELVQVLKDQISTKTSKDIIQTLIQFSPWGRNRIKAVEAGTVPVLIELLLDCKDRKPCEMMLVLLEILCQCAEGRAELLSHGAGLAIVSKKILRVSTLANDRAVRILLCVSKFSATPHVVQEMLKLGVVAKLCLVLQVDSGNKAKEKAREILKLHARVWKNTPCIPNNMLSSYPAYA

SEQ ID NO: 3292 - protein, 419 aa, Vigna unguiculata
MDNEIDVPSFFVCPISLEIMKDPVTVSTGITYDRESIETWLFSKKNTTCPVTKQPLMDYTDLTPNHTLRRLIQAWCTMNASHGVERIPTPKPPVNRNQISKLLKDASHSPLVCLRRLKSIASGSETNKRCMEAAGAVEFLASIVMNTNSNDSSNGVEPNEGSGFELKTTASDEALNLLHTLDLTEQGLKTLLGFRNGEFIESLTRVMQKGFFESRAYAVFLLKSMSEVADPVQLLHLRQEIFVELVQVLRDQISTKTSKDILQTLIQFCPWGRNRVKAVEAGAVPVLIELLLDCKERKPCEMMLVLLEVLCQCAEGRAELLSHGAGLAIVSKKILRVSTLANDRAVRILLSVSKFSATPHVVQEMLKLGVAAKLCLVLQVDSGNKAKEKAREILKLHARAWKNTPCIPNTLLSSYPAYA

SEQ ID NO: 3293 - protein, 284 aa, Glycine max
MGVFSENPNPDPVVIRQVWASNLESEFQLIRELIDHYPFISMDTEFPGVVFRPHLDPTKPYNHRNNNRNRHSDHYRLLKSNVDALNLIQVGLTLTDAAGNLPDLAGNRSIWEFNFRDFDVARDAYALDSIDLLRRQGIDFARNATDGVESTRFAELMMSSGLVCNDSVSWVTFHSAYDFGYLVKILTRRNLPTRLEEFLKTVKVFFGDNVYDVKHMMRFCDTLYGGLDRVARSLNVERAVGKCHQAGSDSLLTWHAFQKIVDIYFVKDEHRKHAGVLYGLEVFC

SEQ ID NO: 3294 - protein, 279 aa, Vigna unguiculata
MGVFSEDPNPIVIREVWASNIESEFELIRELIDRYPFISMDTEFPGVIFRPHVDPTKPYNHRTRRPADHYRLLKSNVDSLNLIQVGLTLSDSAGNLPGDDRNRFIWEFNFCDFDVARDAYAPDSIALLRRQGIDFERNATNGVDSTRFAELMMSSGLVCNDAVSWVTFHSAYDFGYLVKILTRQDLPTRLEEFLNVVKVFFGDNVYDVKHMMRFCDTLYGGLDRVARTLNVDRAVGKCHQAGSDSLLTWHAFQKIVDLYFVKDEHQKHAGVLFGLEVLC

SEQ ID NO: 3295 - protein, 279 aa, Phaseolus coccineus
MGVFSEDQNPIVIREVWASNIDSEFEFIRELIDDYPFISMDTEFPGVIFRPHVDSNKPYNHRTRRPADHYRLLKSNVDALNLIQVGLTLTDSAGNLPSDAGNRFIWEFNFCDFDVARDAYAPDSIALLRRQGIDFERNAADGVDSTRFAELLMSSGLVCNDAVSWVTFHSAYDFGYLVKILTRQDLPTRLEDFLNIVKVLFGDNVYDVKHVMRFCDTLYGGLDRVARTLNVDRAVGKCHQAGSDSLLTWHAFQKIVDIYFVKGEHQKHAGVLFGLEVLC

SEQ ID NO: 3296 - protein, 279 aa, Cajanus cajan
MGVSTEEPNPVAIREVWGSNLESEFQLIGELIDRFPFISMDTEFPGVIFRPHVDPTKPYSHRSKRPSDHYRLLKSNVDALNLIQVGLTLSDAAGNLPDVAGTRCIWEFNFRDFDAARDRYAPDSVALLRRQGIDFERNAAEGVDSSRFAELVMSSGLVCNDGVSWVTFHSAYDFGYLVKILTRRDLPTRLEEFLEAVRIFFGENVYDVKHMMRFCDTLYGGLDRVARTLNVDRAVGKCHQAGSDSLLTWHAFQKIVDTYFVKDEHQKHAGVLYGLEVFC

SEQ ID NO: 3297 - protein, 286 aa, Glycine max
MGVIVENPNSSKPIVIREVWASNLESEFEVIREVIDDYPFISMDTEFPGVVFRPHVVDPTKPYLFRLRPSDHYRFLKFNVDALNLIQVGITLSDADGNLPHLETGNRFIWEFNFRDFDIDRDDYASDSIDLLRRQGIDFRRNTAEGIDSNLFAELVMSSGLVCNDSVSWVTFHSAYDFGYLVKILTRRNLPNGLEEFLKMLRAFFGNNVYDIKHMMQFCDTLYGGLDRLARTLNVDRAVGKCHQAGSDSLLTWHVFQKMRDIYFVKDGPHKHVGVLFGLELTCSAP

SEQ ID NO: 3298 - protein, 381 aa, Glycine max
MFISRSILFVFVFSACLLLFPANGIRSFATTNGYETEVEEVDPFVQFREAPEYRNQQKCTLIDTTNVQLVCDPSLVHVAMTIDWHYLRGSIAAVHSVVKHTSCPQNLFFHFIASDARLESKDVFERIVHTSFPSLGFKVYVFRESLVGNLISPSIREALDNPLNYARSYLADLLDQCIERVIYLDSDVVVVDDVQELWKVSLTGSRVIGAPEYCHTNFTRYFSYEFWSSAEFSEVFQGKRPCYFNTGVMVMDLVRWREGGYTRKIEKWMEIQKERRIYKLGSLPPFLLAFGGDVEAIEHRWNQHGLGGDNVRNSCRTLHPGPVSLLHWSGKGKPWTRLDAKMPCSVDFLWAPYDLYIPHHHTHHQHHHHQRIAIGSTHSSF

SEQ ID NO: 3299 - protein, 372 aa, Phaseolus coccineus
MFLSRSFVLVFSACFLLCQAKGIRSFARENGYETEVEVASFVQFREAPEYRNQKKCSLLDTSNVAMASCDPSLVHIAMTIDWHYLRGSIAALHSVVKHTSCPQNLFFHFIASDARLESRDEFERIVHTSFPSLRFEVHVFEESLVGNLISPSIRQALDNPLNYARSYLADLLDPCIERVIYLDSDVIVVDDVQELWKVPLSGSRVIGAPEYCHANFTRYFSYEFWSSAEFSEVFQGKRPCYFNTGVMVVDLLRWREGDYTRKIEKWMEIQKERRIYMLGSLPPFLLVFGGDVEAIEHRWNQHGLGGDNLRNSCRTLHPGSVSLLHWSGKGKPWTRLDAKKPCSVDFLWAPYDLYIPPQQKRIAATGTINSSF

SEQ ID NO: 3300 - protein, 375 aa, Cajanus cajan
MFLCRSISKSILFVFGFVLLLSGANGIRSIATEKGYDESEVQVDPFVQFREAPEYRNQRKCSLVDTNNVKMVCDPSLVHIALTIDWQYLRGSIAAVHSVVKHTSCPQNLFFHFIASDARLESRDEFVRILHSSFPSMRFKVHEFKESLVENLISPSIREALDNPLNYARTYLADLLDHCIERVIYLDSDVIVVDDVQELWKVSLTGSRVIGAPEYCHANFTRYFSYEFWSSEEFSEVFAGKRPCYFNTGVMVMDLVRWREGDYTRRIEKWMEIQKERRIYTLGSLPPFLLVFGGDVEAIEHRWNQHGLGGDNVRNSCRTLHPGPVSLLHWSGKGKPWDRLDAKRPCSVDFLWAPYDLYIPHHHKRIAIGTTHSSF

SEQ ID NO: 3301 - protein, 307 aa, Phaseolus coccineus
  misc_feature (48)..(48): Xaa can be any naturally occurring amino acid
MASCDPSLVHIAMTIDWHYLRGSIAALHSVVKHTSCPQNLFFHFIASXARLESRDEFERIVHTSFPSLRFEVHVFEESLVGNLISPSIRQALDNPLNYARSYLADLLDPCIERVIYLDSDVIVVDDVQELWKVPLSGSRVIGAPEYCHANFTRYFSYEFWSSAEFSEVFQGKRPCYFNTGVMVVDLLRWREGDYTRKIEKWMEIQKERRIYMLGSLPPFLLVFGGDVEAIEHRWNQHGLGGDNLRNSCRTLHPGSVSLLHWSGKGKPWTRLDAKKPCSVDFLWAPYDLYIPPQQKRIAATGTINSSF

SEQ ID NO: 3302 - protein, 370 aa, Vigna unguiculata
MFLCRVFVLVFSACFLLFPANGIRSFAGYETEVEVGSFLQFREAPEYRNQKKCTTLLDSSNVPMASSCDPSLVHIAMTIDWHYLRGSIAAVHSVLKHTSCPQNLFFHFIASDARLESRDEFERIVQTSFPSLRFEVHVFEESLVSNLISPSIREALDNPLNYARSYLADLLHPCIERVIYLDSDVIVVGDVLELWKVPLAGSRVIGAPEYCHANFTRYFSYEFWSSAEFSEVFEGKRPCYFNTGVMVMDLWRWREGDYTRKIEKWMEIQKERRIYKLGSLPPFLLVFGGDVEAIDHRWNQHGLGGDNVRNSCRTLHSGSVSLLHWSGKGKPWTRLDAMKPCSVDFLWEPYDLYIPSQHKRIASATMHSTF

SEQ ID NO: 3303 - protein, 370 aa, Vigna unguiculata
  misc_feature (224)..(224): Xaa can be any naturally occurring amino acid
  misc_feature (297)..(297): Xaa can be any naturally occurring amino acid
MFLCRVFVLVFSACFLLFPANGIRSFAGYETEVEVGSFLQFREAPEYRNQKKCTTLLDSSNVPMASSCDPSLVHIAMTIDWHYLRGSIAAVHSVLKHTSCPQNLFFHFIASDARLESRDEFERIVQTSFPSLRFEVHVFEESLVSNLISPSIREALDNPLNYARSYLADLLHPCIERVIYLDSDVIVVGDVLELWKVPLAGSRVIGAPEYCHANFTRYFSYEFXSSAEFSEVFEGKRPCYFNTGVMVMDLWRWREGDYTRKIEKWMEIQKERRIYKLGSLPPFLLVFGGDVEAIDHXWNQHGLGGDNVRNSCRTLHSGSVSLLHWSGKGKPWTRLDAMKPCSVDFLWEPYDLYIPSQHKRIASATMHSTF

SEQ ID NO: 3304 - protein, 360 aa, Phaseolus coccineus
MALWMEKGSEPLTESEKADLEAIAALKESAAFEFKEKGNQYVKMGKKHYTDAIDCYTRAIDQKALSDSETSILFSNRAHVNLLLGNLRRALIDSQDALKLCPSNIKAIYRAAKASLSLNMLAEAREYCLKGLQFDPNNEDLKKLDRQIGLKISEKEKHEAQVSKAAAETKELVSAIEYRGLKIGKAMYRELTGLRKPVLDKSNILHWPVVLLYAEVMSSDFIEDFCETDMFSVHLDMIFAEDQPLSWDVENNYKREFIELYYEAGSGLCLSKEKLLGCLLEGTAAFHSDGVGDEEKDADEDYKQQKGSPKWIKVNERRTLHDVLKEPNFIIPGIPVFYVLSKRSSFYSKFKAGKWAPPSA

SEQ ID NO: 3305 - protein, 367 aa, Glycine max
MALWMEKGSEPLTESEKADLEAIAALKESAAFEFKEKGNQYVKMGKKHYSDAIDCYTRAIDQKALSDSETSILFANRAHVNLLLGNLRRALTDSNEALKLCPSNIKAIYRASKASLSLDMLAEAREYCLKGLQFDPNNEDLKKLDRLIGLKISEKEKHEAEFSKAVAETKELASVIEHRGLKIGKAMYRELIGLRKPVLDKSNILHWPVVLLYAEVMSSDFIEDFCETDMFSVHLDMISFSLSNVFAEDQPLSWDVETNYKREFVELYYEAGSGVSLSKEKLIHCLLEGTAAAHREGVGDEEKDTIEDYKQHTGPPKWIKVNERRTLHDVLKEPNFIIPGIPVFYVVSKQSSFYGKFKAGKWAPPSI

SEQ ID NO: 3306 - protein, 362 aa, Cajanus cajan
MALWMEKGSEPLTESEKADLEAIAAIKESAAFEFKEKGNQYVKMGKKHYSDAIDCYTKAINQKALSDSETSILFSNRAHVNLLLGNLRRALTDAQEALKLCPSNLKAIYRAAKASLSLNMLVEAREYCLKGLQLDLDPNNEELKKLEQQIGIKISEKEKHEAEVSKAVAEAKELVSAIEYRGLKIGKAVYRELTGLRKPVLDKSNILHWPVILLYAEVMSSDFIEDFCETDMFSVHLDMIFAEDQPLSWDVENNYKREFVELYYEACSGICLSKEKLLHCLLEGTAASDREGVGDEEKDVVEDFKQHGGSPKWIKVNERRTLHDVLKEPNFIIPGIPVFYVVSKRSSFYSKFKAGKWAPPVM

SEQ ID NO: 3307 - protein, 358 aa, Cajanus cajan
MDERFGALTESEKADLEAIAAIKESAAFEFKEKGNQYVKMGKKHYSDAIDCYTKAINQKALSDSETSILFSNRAHVNLLLGNLRRALTDAQEALKLCPSNLKAIYRAAKASLSLNMLVEAREYCLKGLQLDLDPNNEELKKLEQQIGIKISEKEKHEAEVSKAVAEAKELVSAIEYRGLKIGKAVYRELTGLRKPVLDKSNILHWPVILLYAEVMSSDFIEDFCETDMFSVHLDMIFAEDQPLSWDVENNYKREFVELYYEACSGICLSKEKLLHCLLEGTAASDREGVGDEEKDVVEDFKQHGGSPKWIKVNERRTLHDVLKEPNFIIPGIPVFYVVSKRSSFYSKFKAGKWAPPVM

SEQ ID NO: 3308 - protein, 358 aa, Cicer arietinum
MALLMEKGSEPLTENEKADLEAIAALKQSSALEFKEKGNQYVKMGKKHYSDAIDCYTRAINQKALSDSETSILFSNRAHVNLLLGNLRRALIDANDAIKLLPSNIKAIYRAAKASLSLNLLDEAQDYCQKGLQLDPDNEELKKLHKQIGLKIFEIKKHEAEVSKAISEAKEIVSAMENRGLKIGKAMYRELTGLRKPVLDKSNILHWPVLLLYAEVMSSDFIEDFCETDMFSVHLDMVFAEDQPLPWDDKNNYKREFIELYYEAGSGPRLSKEKLLHYLLEGTAAASNGEDEEKNAVEDLKQNTSSPKWIKVNERRTLHDVLKEPNFIIPEIPVFYVVSKKSSFYGKFKAGKWAPPSV

SEQ ID NO: 3309 - protein, 361 aa, Medicago truncatula
MALWMEKGSEPLTENEKADLEAIAAIKESSALELKEKGNQYVKMGKKHYSDAIDCYTRAIDQKALTDSETSVLFSNRAHVNLLLGNFRRALNDANDSIKLSPSNIKAIYRAAKASFSLNLLDEAQDYCQMGLHLDPKNEELKRLDKQIETKILENEKHEAEVSNAIAEAKELASAIENRGLKIGKAMYRELTGLRKPVFDKSNILHWPVLLLYAEVMSSDFIEDFCETDMFTVHLDMVFSEDQPLPWDVKNNYKREFIELYYEAGSGPRLSKQKLLHYLLEGTPAASSGEVIGDEVKDAVEDFKQNKSSPKWIKVNERRTLHDVLKEPNFIIPEIPVFYVVFKQSSFYSKFKDGKWAPPSV

SEQ ID NO: 3310 - protein, 276 aa, Glycine max
MDSQVAVALALSLVGGVSTSIGALFVIVNKTPSLKMLGLLQGFAAGLMLSISFFDLAHNALNSLGFLKGNLWFFAGVIFFAVVASFIPEPTLTPTSDVKGRKKNGDEGDKDIMKKHRRQVLFSGIVTAVGISLHNFPEGMAVFLGSLKGLRVGLNLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSASLYFLSISLPEDLSL

SEQ ID NO: 3311 - protein, 276 aa, Vigna unguiculata
MDSQVAVALALSLVGGVSTSLGALFVIVNQTPNLKMLGLLQGFAAGLMLSISFFDLAHNALNSLGFLKGNLWFFAGVIFFGVVASFIPEPTLAPTSDVKGRKKNGDEGGKDTMKKHRRQVLFSGIVTAVGISLHNFPEGMAVFLGSMKGLRVGINLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSASLYFLSISLPEDLSL

SEQ ID NO: 3312 - protein, 276 aa, Cajanus cajan
MDSQVAVALALSLVGGASTSIGALFVIINQAPNLKMLGLLQGFAAGLMLSISFFDLAHNALNSLGFLKGNLWFFAGVIFFAVVASFIPEPTLTPISDVKGRKENGDDGGKDIMKKHRRQVLFSGIITAVGISLHNFPEGMAVFLGSMKGLRVGINLALAIALHNIPEGVAVALPVYFATQSKWQAFKLASLSGFAEPLGVIIVAYLFPSSLSPEILEGLLGSVGGVMAFLTLHEMLPLAFDYAGQKQSVKAVFLGMAFMSASLYFLSISLPEELSL

SEQ ID NO: 3313 - protein, 276 aa, Phaseolus coccineus
MDSQVAVALALSLVGGVSTSIGALVVIVNQAPNLKMLGLLQGFAAGLMLSISFFDLAHNALNSLGFLKGNLWFFAGVIFFGIVASFIPEPTLAPTSDVKGKKKKGDEGGKDTLKKHRRQVLFSGIVTAVGISLHNFPEGMAVFLGSMKGLRVGINLALAIALHNIPEGVAVALPVYFATQSKWQAFKLATLSGFAEPLGVIIVAYLFPSSLSPEILEGLLGSVGGVMAFLTLHEMLPLAFDYAGQKQSVKAVFLGMAFMSASLYFLSISLPEDLSL

SEQ ID NO: 3314 - protein, 276 aa, Cicer arietinum
MDSQVMVALALSLVGGLSTSLGALFVIINPAPNLKMLGLLQGFAAGLMLSISFFDLAHNALNSLGFLKGNLWFFAGVIFFAVIANFIPEPTLTPTSDVKNRKKKGDEGGKDIMKKHRQQVLFSGIITAVGISLHNFPEGMAVFLGSMKGLRVGINLALAIALHNIPEGVAVALPVYFATQSKWQAFKLASLSGFAEPLGVIIVAYLFPSSLNPEILEGLLGSVGGVMAFLTLHEMLPLAFDYAGQKQSVKAVFFGMAFMSASLYFLSISLPEEISL

SEQ ID NO: 3315 - protein, 276 aa, Trigonella foenum-graecum
MDSQVMVALALSLVGGLSTSIGALLVIIKPAPNLKMLGLLQGFAAGLMLSISFFDLAHNAINSLGFLKGNLWFFAGVIFFAAVVSFIPEPTLTPTADVKTKKNKGDEGGKDIMKKHRQQVLFSGIITAVGISLHNFPEGMAVFLGSMKGLRVGINLALAIALHNIPEGVAVALPVYFATQSKWQAFKLATLSGFAEPLGVIIVAYLFPSSLNPEILEGLLGSVGGVMAFLTLHEMLPLAFDYAGQKQSVKAVFFGMAFMSASLYFLSISLPEEISL

SEQ ID NO: 3316 - protein, 276 aa, Medicago truncatula
MDSQVMVALALSLVGGLSTSIGALLVIIKPAPNLKMLGLLQGFAAGLMLSISFFDLAHNAINSLGFLKGNLWFFAGVIFFAAVVSFIPEPTLTPTADVKTKKNKGDEGGKDIMKKHRQQVLFSGIITAVGISLHNFPEGMAVFLGSMKGLRVGINLALAIALHNIPEGVAVALPVYFATQSKWQAFKLATLSGFAEPLGVIIVAYLFPSRLNPEILEGLLGSVGGVMAFLTLHEMLPLAFDYAGQKQSVKAVFFGMAFMSASLYFLSISLPEEISL

SEQ ID NO: 3317 - protein, 276 aa, Ricinus communis
MDSQVVVALALSLVGGLSTSIGALFVILNQAPNLKMLGLLQGFAAGLMLSISFLDLAHNAMNSIGFLKGNLWFFGGVLFFAIVARFIPEPTLIPGSDVKSKKKNGDEGGKDIMKKHRRQVMFSGIVTAIGISLHNFPEGMAVFLGSIKGLRVGLNLALAIALHNIPEGVAVALPVYFATESKWQAFKLATLSGLAEPLGVVLVAYLFPSSLSPEILEGLLGSVGGVMAFLTLHEMLPLAFDYAGQKQAVKAVFLGMAFMSASLYFLEISLPEDISL

SEQ ID NO: 3318 - protein, 276 aa, Mimulus guttatus
MDSQVLVALALSLVGGLSTSVGALFVVMNKAPDLKMLGLLQGFAAGLMLSISFFDLAHNAINSIGFLKGNLWFFAGVIFFAIIANFIPEPTLAPVSDGKKDKKNGDEGGKDIMKKHRRQVLFSGIITAVGISLHNFPEGMAVFLGSMKGLRVGLNLALAIALHNIPEGVAVALPVYFATQSKWQAFKLATLSGFAEPLGVIIVAYLFPSSLNPEILEGLLGAVGGVMAFLTLHEMLPLAFDYAGQKQAVKAVFFGMAFMSASLYFLEISLPAEISL

SEQ ID NO: 3319 - protein, 112 aa, Fagus grandifolia
MGSQVLVALALSLLGGLSTSIGALFVVLNPAPNLKMLGLLQGFAAGLMLSISFLDLAHNAINSIGFLKGNLWFFAGVIFFAFVANFIPEPTLAPVPDVKRKRKMEMKGARTL

SEQ ID NO: 3320 - protein, 276 aa, Orobanche aegyptiaca
MDSQVLVALALSLVGGLSTSIGALFVVINPAPNLKMLGLLQGFAAGLMLSISFLDLAHNSINSIGFLKGNLWFFAGVIFFAIVANFIPEPNLAPISDTKKDKKNGDDGGKDIMKKHRRQVLFSGIITAVGISLHNFPEGMAVFLGSIKGLRVGVNLALAIALHNIPEGVAVALPVYFATQSKWQAFKLATLSGLAEPLGVIIVAYLFPSSLNPEILEGLLGSVGGVMAFLTLHEMLPLAFDYAGQKQAVKAVFVGMAFMSASLYFLEISLPADMSL

SEQ ID NO: 3321 - protein, 276 aa, Theobroma cacao
MDSQVMVALALSLVGGFSTSLGALFVILNQAPNLKMLGLLQGFAAGLMLSISFLDLAHNAMNSIGFLKGNLWFFAGVIFFAVVANFIPEPILSQSSEVKSKKKNSDEGGKDMMKKHRRQVLFSGIITAIGISLHNFPEGMAVFLGSMKGLRVGFNLALAIALHNIPEGVAVALPVYFATQSKWQAFKLATLSGFAEPLGVVIVAYLFPSNLSPEILEGLLGSVGGVMAFLTLHEMLPLAFDYAGQKQAVKAVFLGMAFMSASLYFLELSLPEEMSL

SEQ ID NO: 3322 - protein, 276 aa, Vitis vinifera
MDSQVMVALGLSLVGGASTSIGALFVILNETPNLKMLGLLQGFAAGLMLSISFLDLAHNALNSIGFLKGNLWFFAGVVFFAVVVGFIPEPTLAPSSDVKNKKKNGVEGPQDTMKKHRRQVLFSGIITAVGISLHNFPEGMAVFLGSMKGLRVGLNLALAIALHNIPEGVAVALPVYFATQSKWQAFKLATLSGFAEPLGVIIVAYLFPSSLNPEILEGLLGSVGGVMAFLTLHEMLPLAFDYAGPKQAVKAVFFGMAFMSASLYFLEISLPKDMSL

SEQ ID NO: 3323 - protein, 275 aa, Citrullus lanatus
MASQVLVALALSLVGGFSTSLGALLVILSGAPNLKMLGLLQGFAAGLMLSISFLDLAHNAINSIGFLKGNLWFFAGVIFFAFVAHFIPEPTLGPVSDTKRKKDKDEGGKDIMKKHRREVLFSGIITAIGISLHNFPEGMAVFLGSIKGLRVGLNLALAIALHNIPEGVAVALPVYFATQSKWQAFKLATLSGFAEPLGVIIVAYLFPSSLSPEILEGLLGAVGGVMAFLTLHEMLPLAFDYAGQKQAVKVVFLGMACMSASLYFLEISLPEDLSL

SEQ ID NO: 3324 - protein, 216 aa, Gossypium hirsutum
MNSIGFLKGNLWFFPGVIFFAVVANFIPEPTLSHSSKVKGKKNKGDEGGKDMMKKHRRQVFFSGIITAIGISLHNFPEGMAVFLGSMKGLRVGLNLALAIALHNIPEGVAVALPVYFATQSKWQAFKLATLSGFAEPLGVVIVAYLFPSSLSPEILEGLLGSVGGVMAFLTLHEMLPLAFDYAGQKQAVKAVFFGMAFMSASLYFLELSLPKDMSL

SEQ ID NO: 3325 - protein, 97 aa, Gossypium hirsutum
MDSQVLVALALSLVGGLSTSLGALFVILNQAPNLKMLGLLQGFAAGLMLSISFLDLAHNAMNSIGFLKGNLWFFLVLSSLLWLPILYLSLPYLTVLR

SEQ ID NO: 3326 - protein, 113 aa, Fagopyrum esculentum
MESQVLVALALSLVGGLSTSLGALFVILNPTPNLKMLGLLQGFAAGLMLSISFLDLAHNALNSIGFLKGNLWFFAGVIFFAAISSFIPEPSLAPGSDVKSKRRGMWKKRARTQ

SEQ ID NO: 3327 - protein, 276 aa, Gossypium hirsutum
MDSQVLVALALSLVGGLSTSLGALFVILNQAPNLKMLGLLQGFAAGLMLSISFLDLAHNAMNSIGFLKGNLWFFSGVIFFAVVANFIPEPTLSHSSEVKGKKNKGDEGGKDMMKKHRRQVFFSGIITAIGISLHNFPEGMAVFLGSMKGLRVGLNLALAIALHNIPEGVAVALPVYFATQSKWQAFKLATLSGFAEPLGVVIVAYLFPSSLSPEILEGLLGSVGGVMAFLTLHEMLPLAFDYAGQKQAVKAVFFGMAFMSASLYFLELSLPKDMSL

SEQ ID NO: 3328 - protein, 276 aa, Gossypium hirsutum
MDSQVLVALALSLVGGLSTSLGALFVILNQAPNLKMLGLLQGFAAGLMLSISFLDLAHNAMNSIGFLKGNLWFFSGVIFFAVVANFIPEPTLSHSSKVKGKKNKGDEGGKDMMKKHRRQVFFSGIITAIGISLHNFPEGMAVFLGSMKGLRVGLNLALAIALHNIPEGVAVALPVYFATQSKWQAFKLATLSGFAEPLGVVIVAYLFPSSLSPEILEGLLGSVGGVMAFLTLHEMLPLAFDYAGQKQAVKAVFFGMAFMSASLYFLELSLPKDMSL

SEQ ID NO: 3329 - protein, 276 aa, Manihot esculenta
MDSQVLVALALSLVGGLSTSIGAFFVILNQAPNLKMLGLLQGFAAGLMLSISFLDLAHNAMNSIGFLKGNLWFFGGVVFFAIVARFIPEPTVIPGSDSKSKKTNGDDGGKDIMKKHRRQVFFSGIITAIGISLHNFPEGMAVFLGSMKGLRVGLNLALAIALHNIPEGVAVALPIYFATQSKWQAFKLATLSGFAEPLGVILVAYLFPSSLSPEILEGLLGSVGGVMAFLTLHEMLPLAFDYAGQKQAVKAVFLGMAFMSASLYFLEISLPEEMSL

SEQ ID NO: 3330 - protein, 274 aa, Quercus alba
MGSQVLVALGLSLIGGLSTSIGALFVVLNQAPNLKMLGILQGFAAGLMLSISFLDLAHNAINSIGFLKGNLWFFAGVLFFAIVANFIPEPTLAPVSDSKKKTRDEGGKDIMKKHRRQVLFSGIVTAVGISLHNFPEGMAVFLGSMKGLRVGVNLALAIALHNIPEGVAVALPVYFATQSKWQAFKLATLSGLAEPLGVIIVAYLFPSSLSPEILEGLLGAVGGVMAFLTLHEMLPLAFDYAGQKQAVKAVFFGMAFMSASLYFLEISLPEEMSL

SEQ ID NO: 3331 - protein, 275 aa, Cucumis sativus
MASQVLVALALSLVGGFSTSLGALFVVLSGAPNLKMLGLLQGFAAGLMLSISFLDLAHNAINSIGFLKGNLWFFAGVIFFAFIAHFIPEPSLGPVSDTKRRKDKDEGGKDIMKKHRRQVLYSGIITAIGISLHNFPEGMAVFLGSVKGLRVGLNLALAIALHNIPEGVAVALPVYFATQSKWQAFKLATLSGFAEPLGVVIVAYLFPSSLSPEILEGLLGSVGGVMAFLTLHEMLPLAFDYAGQKQAVKVVFLGMACMSASLYFLEISLPEDLSL

SEQ ID NO: 3332 - protein, 276 aa, Flaveria ramosissima
MDSEVLVALSLSLVGGLSTSLGALFVILTKAPNLKMLGLLQGFAAGLMLSISFFDLAHNAINSIGFLKGNIWFFGGVIFFAIIANFIPEPSLAPTIDTKNKKKQVDEGGKDIMKKHRRQVLFSGIITAVGISLHNFPEGMAVFLGSLKGLRVGLNLALAIALHNIPEGVAVALPVYFATQSKWQAFKLATVSGFAEPLGVIIVAYLFPSSLDPEILEGLLGSVGGVMAFLTLHEMLPLAFDYAGQKQAVKAVFFGMAFMSASLYFLEISLPSDVGL

SEQ ID NO: 3333 - protein, 154 aa, Fagopyrum esculentum
MESQVLVALALSLVGGLSTSLGALFVILNPTPNLKMLGLLQGFAAGLMLSISFLDLAHNALNSIGFLKGNLWFFAGVIFFAAISSFIPEPNLTPGSDLKVKEEECGRKGQGHNGKTSPPSYVQWNCHCYRHQLAQFSRGYGSFSWVHEGSSSWS

SEQ ID NO: 3334 - protein, 276 aa, Lactuca sativa
MDSQVLVALSLSMVGGLSTSLGALFVILAKAPNLKMLGLLQGFAAGLMLSISFFDLAHNAINSIGFLKGNLWFFGGVIFFAIIANFIPEPSLAPTADSKSKKKYGDEGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGAVGGVMAFLTLHEMLPLAFDYAGQKQAVKAVFFGMAFMSASLYFLEISLPADVGL

SEQ ID NO: 3335 - protein, 276 aa, Artemisia annua
MDSEVLVALSLSLVGGLSTSLGALLVILTKAPNLKMLGLLQGFAAGLMLSISFFDLAHNAINSIGFLKGNLWFFGGVIFFAIIANFIPEPSLAPTSDPKSKKKHGDEGGKDIMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGAVGGVMAFLTLHEMLPLAFDYAGQKHAVKAVFFGMAFMSASLYFLEISLPADIGL

SEQ ID NO: 3336 - protein, 276 aa, Unknown
  Sequence found in Organisms: Citrus sinensis, Citrus sinensis
MVSQVLVALGLSLVGGLSTSIGALFVVLNEAPNLKVLGLLQGFAAGLMLSISFLDLAHNAINSIGFLKGNLWFFSGVIFFAIVANFIPEPSLAQGSDLTSKKKNKDEGGKDIMKKHRRQVLFSGIITAVGISLHNFPEGMAVFLGSMKGLRVGLNLAVAIALHNIPEGVAVALPVYFATQSKWQAFKLATLSGFAEPLGVIIVAYLFPSSLSPEILEGLLGSVGGVMAFLTLHEMLPLAFDYAGQKQAVKAVFVGMAFMSASLYFLEISLPAEMSL

SEQ ID NO: 3337 - protein, 276 aa, Fragaria vesca
MDSQVLVALALSLVGGLSTSLGALFVILNEAPNLKMLGLLQGFAAGLMLSISFLDLAHNAINSIGFLKANLWFFGGVIFFAIIANFIPEPSLAPSSDVKSKKKGGDEGGKDTLKKHRRQVLYSGIVTAIGISLHNFPEGMAVFLGSMKGLRVGVNLALAIALHNIPEGVAVALPVYFATQSKWQAFKLATLSGFAEPLGVIIVAYLFPSSLNPEILEGLLGAVGGVMAFLTLHEMLPLAFDYAGQKQAIKAVFLGMAFMSASLYFLEISLPAEMSL

SEQ ID NO: 3338 - protein, 276 aa, Valeriana officinalis
MDSQVLVALALSLVGGFSTSLGALFVILNETPNIKMLGLLQGFAAGLMLSISFFDLAHNAINSIGFLKGNLWFFAGVIFFAIIANFIPEPTLSPVSDTKNRKRKGDQGGQDTMKKHRRQVLYSGIVTAIGISLHNFPEGMAVFLGSIKGLRVGLNLALAIALHNIPEGVAVALPVYFATQSKWQAFKLATLSGLAEPLGVVIVAYLFPSSLNPEILEGLLGAVGGVMAFLTLHEMLPLAFDYAGQKHAVKAVFFGMAFMSASLYFLEISLPEDLSL

SEQ ID NO: 3339 - protein, 276 aa, Tropaeolum majus
MDSQVVVALALSLVGGLSTSLGALFVILSKTPNMKMLGLLQGFAAGLMLSISFLDLAHNAINSIGFLKGNIWFFGGVVFFAFIAKFIPEPTLVPGSDVKRKKKNGDETGKDIMKKRRRQVMFSGIVTAIGISLHNFPEGMAVFLGSIKGLRVGVNLALAIALHNIPEGVAVALPVYFATESKWQAFKLATLSGLAEPLGVIIVAYLFPSSLSPEILEGLLGAVGGVMAFLTLHEMLPLAFDYAGQKQAVKAVFLGMAFMSASLYFLEISLPSEMSL

SEQ ID NO: 3340 - protein, 275 aa, Aquilegia formosa
MDSQVMVALALSMVGGLSTSLGALFVILNDAPNLKMLGLLQGFAAGLMLSISFLDLAHNAMNSIGFLKGNLWFFAGVIFFGIIASFIPEPTLAPSVDVKSKKKKDDGGKDQLKKHRRQVLFSGIITAIGISLHNFPEGMAVFLGSMKGLRVGLNLALAIALHNIPEGVAVALPVYFATQSKWQAFKLATLSGFAEPLGVVIVAYLFPSSLNPEILEGLLAAVGGVMAFLTLHEMLPLAFDYAGQKQAVKAVFLGMAFMSASLYFLEISLPKDMSL

SEQ ID NO: 3341 - protein, 276 aa, Cannabis sativa
MDSQVLVALALSLVGGLSTSIGAILVILNPTPNLKMLGLLQGFAAGLMLSISFLDLAHNAINSIGFLKGNLWFFSGVIFFAVIANFIPEPSLAPVPNKKDKKKNGDEGGKDIMKKHRRQVLYSGIVTAIGISLHNFPEGMAVFLGSMKGLRVGVNLALAIALHNIPEGVAVALPVYFATQSKWQAFKLATLSGFAEPLGVIIVAYLFPSNLNPEILEGLLGAVGGVMAFLTLHEMLPLAFEYAGQKQSIKAVFLGMAFMSASLYFLEISLPKEMSL

SEQ ID NO: 3342 - protein, 276 aa, Citrus clementina
MDSQVLVALGLSLVGGLSTSIGALFVVLNEAPNLKVLGLLQGFAAGLMLSISFLDLAHNAINSIGFLKGNLWFFSGVIFFAIIANFIPEPSLAQGSDLTSKKKNKDEGGKDMMKKHRRQVLFSGIITAVGISLHNFPEGMAVFLGSMKGLRVGLNLAVAIALHNIPEGVAVALPVYFATQSKWQAFKLATLSGFAEPLGVIIVAYLFPSSLSPEILEGLLGSVGGVMAFLTLHEMLPLAFDYAGQKQAVKAVFFGMAFMSASLYFLEISLPAEMSL

SEQ ID NO: 3343 - protein, 276 aa, Flaveria ramosissima
MNSEVLVALSLSLVGGLSTSLGALFVILTKAPNLKMLGLLQGFAAGLMLSISFFDLAHNAINSIGFLKGNIWFFGGVIFFAIIANFIPEPSIAPTIDAKNKKKQVDEGGKDIMKKHRRQVLFSGIITAVGISLHNFPEGMAVFLGSLKGLRVGLNLALAIALHNIPEGVAVALPVYFATQSKWQAFKLATVSGFAEPLGVIIVAYLFPSSLDPEILEGLLGSVGGVMAFLTLHEMLPLAFDYAGQKQAVKAVFFGMAFMSASLYFLEISLPSDVGL

SEQ ID NO: 3344 - protein, 276 aa, Populus trichocarpa
MDSQVMVALALSLVGGLSTSIGALFVILFQAPNLKMLGLLQGFAAGLMLSISFLDLAHNAINSIGFLKGNLWFFGGVVFFGIIANFIPEPTFAPSSDVKSKKKNGDQGGKDIMKKHRRQVLFSGIITAIGISLHNFPEGMAVFLGSIKGLRVGLNLALAIALHNIPEGVAVALPIYFATQSKWQAFKLATVSGFAEPLGVVLVAYLFPSSLSPEILEGLLASVGGVMAFLTLHEMLPLAFDYAGQKQAVKAVFFGMAFMSASLYFLEISLPEEMSL

SEQ ID NO: 3345 - protein, 276 aa, Unknown
  Sequence found in Organisms: Solanum tuberosum, Solanum phureja
MDSQVLVALGLSLLGGLSTSLGALFVVISQAPNLKMLGLLQGFAAGLMLSISFFDLAHNAINSIGFLKGNLWFFAGVIFFALVSNFIPEPTLAPISSAKGKKKDGDDRGKDIMKKHRRQVLFSGIITAVGISLHNFPEGMAVFLGSMKGLRVGLNLALAIALHNIPEGVAVALPVYFATQSKWQAFKLATLSGLAEPLGVIIVAYLFPSSLNPEILEGLLGAVGGVMAFLTLHEMLPLAFDYAGQKRAVKAVFLGMAFMSASLYFLERSLPADMSL

SEQ ID NO: 3346 - protein, 276 aa, Primula obconica
MNSQVLVALALSLVGGLSTSLGALFVILNPAPNLKVLGLLQGFAAGLMLSISFFDLAHNAMNAIGFLKGNLWFFAGVIFFAIIANFIPEPTLAPIADEKNKKKKGDDGNKDTMKKHRRQVLFSGIITAVGISLHNFPEGMAVFLGSLKGLRVGLNLAFAIALHNIPEGVAVALPVYFATQSKWQAFKLATLSGFAEPLGVIIVAYLFPSGLSPEILEGLLGAVGGVMAFLTLHEMLPLAFDYAGQKQAVKAVFFGMAFMSASLYFLEISLPADMTL

SEQ ID NO: 3347 - protein, 276 aa, Tragopogon dubius
MDSEVLVALSLSLVGGLSTSLGALFVILTKAPNLKMLGLLQGFAAGLMLSISFFDLAHNAINSIGFLKGNLWFFGGVIFFAIIANFIPEPSLAPAVDTKNKKKHGDDGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGAVGGVMAFLTLHEMLPLAFDYAGQKQAVKAVFLGMAFMSASLYFLEISLPKDMGL

SEQ ID NO: 3348 - protein, 276 aa, Cirsium arvense
MNSEVLVALSLSMVGGLSTSLGALFVVMSKAPNLKMLGLLQGFAAGLMLSISFFDLAHNAINSIGFLKGNLWFFGGVIFFAIIANFIPEPSLGPTSDTKNKKKHGDEGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGAVGGVMAFLTLHEMLPLAFDYAGQKQAVKAVFFGMAFMSASLYFLEISLPKDMGL

SEQ ID NO: 3349 - protein, 276 aa, Helianthus annuus
MDSEVLVALSLSLVGGLSTSLGALFVILTKAPNLKMLGLLQGFAAGLMLSISFFDLAHNAINSIGFLKGNIWFFGGVIFFAIVANFIPEPSLAPTIEAKNKKKQVDDGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGSVGGVMAFLTLHEMLPLAFDYAGQKQAVKAVFFGMAFMSASLYFLEISLPSDVGL

SEQ ID NO: 3350 - protein, 276 aa, Eucalyptus grandis
MDSQVLVALGLSLVGGLSTSVGALFVILNQAPNLKMLGLLQGFAAGLMLSISFLDLAHNAINSIGFLKGNLWFFAGVIFFAIVVKFIPEPPIAPSSESKKKKHTGDEGGKDMIKKQRRQVLFSGIVTAVGISLHNFPEGMAVFLGSMKGLRVGLNLAVAIALHNIPEGVAVALPVYFATQSKWKAFKIASLSGFAEPLGVIIVAYLFPSNLSPEILEGLLGAVGGVMAFLTLHEMLPLAFDYAGQKQAVKAVFLGMAFMSASLYFLEISLPKEMSL

SEQ ID NO: 3351 - protein, 274 aa, Euphorbia peplus
MDSQLLVALALSLVGGLSTSIGALIVIINQAPNLKMLGLLQGFAAGLMLSISFLDLAHNAINSIGFLKGNLWFFGGVVFFAIIAKFIPEPTVVPGSDVKNKKKGDGGKDIMKKHRRQVFFSGIITAIGISLHNFPEGMAVFLGSMKGLRVGVNLALAIALHNIPEGVAVALPVYFATESKWQAFKLATLSGFAEPLGVVIVAFLFPSSLNPEILEGLLAAVGGVMAFLTLHEMLPLAFDYAGQKQAVKAVFLGMAFMSASLYFLEISLPKDMSL

SEQ ID NO: 3352 - protein, 276 aa, Solanum lycopersicum
MDSQVLVALGLSLLGGLSTSLGALFVVISQTPNLKMLGLLQGFAAGLMLSISFFDLAHNAINSIGFLKGNLWFFAGVIFFALVSNFIPEPTLAPISSAKGKKKDGDDRGKDIMKKHRRQVLFSGIITAVGISLHNFPEGMAVFLGSMKGLRVGLNLALAIALHNIPEGVAVALPVYFATQSKWQAFKLATLSGLAEPLGVIIVAYLFPSSLNPEILEGLLGAVGGVMAFLTLHEMLPLAFDYAGQKRAVKAVFFGMAFMSASLYFLERSLPADMSL

SEQ ID NO: 3353 - protein, 276 aa, Helianthus annuus
MDSEVLVALSLSLVGGLSTSLGALFVILTKAPNLKMLGLLQGFAAGLMLSISFFDLAHNAINSIGFLKGNIWFFGGVIFFAIVANFIPEPSLAPTIEAKNKKKQVDDGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGSVGGVMAFLTLHEMLPLAFDYAGQTRAVKAVFFGMAFMSASLYFLEISLPSDVGL

SEQ ID NO: 3354 - protein, 269 aa, Malus domestica
MVSQVLVALALSLVGGLSTSFGALLVIVNETPNLKMLGLLQGFAAGLMLSISFLDLAHNAINSIGFLKGNLWFFGGVIFFAFIANFIPEPTLAPISKKDEGGKDTLKKQRRQVLFSGIVTAIGISLHNLPEGMAVFLGSMKGLRVGVNLALAIALHNIPEGVAVALPVYFATQSKWQAFKLATLSGLAEPLGVVIVAYLFPSSLSPEILEGLLGSVGGVMAFLTLHEMLPLAFDYAGQKQAIKAVFLGMAFMSASLYFLEISLPQDMSL

SEQ ID NO: 3355 - protein, 276 aa, Unknown
  Sequence found in Organisms: Centaurea maculosa, Cirsium arvense
MDSEVLVALSLSMVGGLSTSLGALFVVLSKAPNLKMLGLLQGFAAGLMLSISFFDLAHNAINSIGFLKGNLWFFGGVIFFAIIANFIPEPSLGPTADTKNKKKHGDEGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPKSLDPEILEGLLGAVGGVMAFLTLHEMLPLAFDYAGQKQAVKAVFFGMAFMSASLYFLELSLPKDMGL

SEQ ID NO: 3356 - protein, 271 aa, Prunus persica
MDSQVLMALALSLVGGLSTSIGALFVVLNEAPNLKILGLLQGFAAGLMLSISFLDLAHNAINSIGFLKGNLWFFGGVIFFGIIANFIPEPTLAPSSDKSGDEGGKDTLKKHRRQVLYSGIITAIGISLHNFPEGMAVFLGSMKGLRVGVNLALAIALHNIPEGVAVALPVYFATQSKWQAFKLATLSGFAEPLGVIIVAYLFPSSLSPDILEGLLGAVGGVMAFLTLHEMLPLAFDYAGQKQAVKAVFLGMAFMSASLYFLEISLPQEMSL

SEQ ID NO: 3357 - protein, 276 aa, Silene vulgaris
MDSQVLVALGLSLVGGLSTSLGALLVVLSNAPNLKMLGLLQGFAAGLMLSISFFDLAHNAINSIGFLKGNIWFFSGVIFFAFIANFIPEPTLAPTPDVKSKKTNGHAKGKDTMKKHRRQVMYSGIITAIGISLHNFPEGMAVFLGSIKGLRVGLNLALAIALHNIPEGVAVALPVYFATQSKWQAFKLASLSGLAEPLGVIIVAYLFPSSLNPEILEGLLGAVGGVMAFLTLHEMLPLAFDYAGQKQAVKAVFLGMAFMSASLYFLEISLPADMSL

SEQ ID NO: 3358 - protein, 241 aa, Ambrosia trifida
MLGLLQGFAAGLMLSISFFDLAHNAINSIGFLKGNIWFFGGVVFFAIVANFIPEPSLAPTIEAKNKKKQVDEGGKDIMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGAVGGVMAFLTLHEMLPLAFDYAGQKQAVKAVFFGMAFMSASLYFLEISLPSDVGL

SEQ ID NO: 3359 - protein, 277 aa, Aristolochia fimbriata
MDSQLMVALLLSLVGGLSTSIGAFFVIINPAPNLKMLGLLQGFAAGLMLSISFFDLAHNALNAIGFLKGNLWFFAGVIVFALIAHFIPEPTLAPSNKAVKKKQKNDDGTGKDLMKKHRRQVLFSGIITAIGISLHNFPEGMAVFLGSIKGLRVGLNLAFAIALHNIPEGVAVALPVYFATESKWQAFKLATLSGFAEPLGVIIVAYLFPSSLSTQILEGLLASVGGVMAFLTLHEMLPLAFDYAGQKQAVKAVFLGMAFMSASLYFLEISLPEEMSL

SEQ ID NO: 3360 - protein, 276 aa, Elaeis guineensis
MDPQVLVALALSLVGGLSTSIGALFVILNHAPNLKMLGLLQGFAAGLMLSISFLDLAHNALNSIGFLKGNLWFFAGVLFFAFVVSFIPEPTVVARTDENNRQKDDDGSGKDLMRKHRRQVLFSGIITAIGISLHNFPEGMAVFLGSIKGLRVGLNLALAIALHNIPEGVAVALPIYFATESKWQAFKLATLSGFAEPLGVIIVAYLFPSSLDPEILEGLLGAVGGVMAFLTLHEMLPLAFDYAGQKQAVKAVFLGMAFMSASLYFLEISLPKEMSL

SEQ ID NO: 3361 - protein, 164 aa, Ambrosia trifida
MKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGSVGGVMAFLTLHEMLPLAFDYAGQKQAVKAVSLEWPSCLQACIFLEISLPSDVGL

SEQ ID NO: 3362 - protein, 97 aa, Flaveria ramosissima
MDSEVLVALSLSLVGGLSTSLGALFVILTKAPNLKMLGLLQGFAAGLMLSISFFDLAHNAINSIGFLKGNIWFFGGVIFFAIIAILFRNHHSSYNRH

SEQ ID NO: 3363 - protein, 276 aa, Papaver somniferum
MDQQVLIALALSMLGGLSTSLGALVVILNDAPNLKMLGLLQGFAAGLMLSISFLDLAHNAINSIGFLKGNVWFFGGVIFFAIVSSFIPEPTLAPAVDSKSKKKGGDAGGKDTLKKHRRQVLFSGIITAIGISLHNFPEGMAVFLGSMKGLRVGINLAFAIALHNIPEGVAVALPVYFATQSKWQAFKLATLSGLAEPLGVIIVAYLFPSSLNPEILEGLLGGVGGVMAFLTLHEMLPLAFDYAGPKQAVKAVFLGMAFMSASLYFLEISLPKDISL

SEQ ID NO: 3364 - protein, 273 aa, Amborella trichopoda
MDPQVMVALALSLVGGLSTSIGAFFVILNPAPNLKMLGLLQGFAAGLMLSISFLDLAHNAMNSIGFLKGNLWFYAGVILFGLVANFIPEPTLVPKKDAAKPDDGAGKDMMKKHRRQVLYSGIVTAIGISLHNFPEGMAVFLGSIKGLRVGLNLALAIALHNIPEGVAVALPVYFATESKWQAFKLATLSGFAEPLGVILVAYLFPSKLSPEILEGLLGSVGGVMAFLTLHEMLPLAFDYAGQKQAVKAVFLGMAAMSASLYFLEISLPKEMSL

SEQ ID NO: 3365 - protein, 276 aa, Populus trichocarpa
MDSQVMVALALSLVGGLSTSIGALFVILCQTPNLKMLGLLQGFAAGLMLCISFLDLAHNAINSIGFLKGNLWFFGGVVFFGIIANFIPEPTLTSSLDVKSKKKNGDQGGKEILKKQRRQVLFSGIITAIGISLHNFPEGMAVFLGSMKGLRVGINLAVAIALHNIPEGVAVALPIYFATQSKWQAFKLATLCGLAEPLGVVLVAYLFPSSLSPEILEGLLGSVGGVMAFLTLHEMLPLAFDYAGQKQAVKAVFFGMAFMSASLYFLEISLPDEMSL

SEQ ID NO: 3366 - protein, 276 aa, Oryza sativa
MESQVLVALALSLVGGLSTSIGALFVILNPTPNLKMLGLLQGFAAGLMLSISFLDLAHNALNSIGFLKGNLWFFAGVLFFGLVVKFIPEPTVVPTADAGKKQTDDDGSGKDMMKKHRRQVLFSGIITAVGISLHNFPEGMAVFLGSMKGLRVGLNLAIAIALHNIPEGVAVALPLYFATNSKWQAFKVATLSGFAEPLGVIIVAYLFPSSLNPEVLEGLLGSVGGVMAFLTLHEMLPLAFDYAGQKQAVKAVFVGMAFMSASLYFLEISLPKEVSL

SEQ ID NO: 3367 - protein, 276 aa, Eutrema parvulum
MDSQMLVALGLSLVGGLSTSLGALFVVLSDTPNMKMLGLLQGFAAGLMLSISFLDLAHNAINSIGFLKGNLWFFGGVIFFACIAKFIPEPTLGPSTDVKRRKKNGDEGGKDMVKKHRRQVLYSGIVTAIGISLHNFPEGMAVFLGSIKGMRVGVNLALAIALHNIPEGVAVALPIYFATESKWQAFKLATLSGLAEPLGVIIVAYLFPSSLSPEILEGLLGAVGGIMAFLTLHEMLPLAFDYAGQKQAVKAVFVGMACMSASLYFLEISLPETMSL

SEQ ID NO: 3368 - protein, 197 aa, Allium cepa
MDSQVLVALALSLVGGLSTSIGALIVVLNPAPNLKMLGLLQGFAAGLMLSISFLDLAHNALNSIGFLKGNIWFYAGVICFGIIVKFIPEPTPVPDTDVDKRKNKDDESGKDLMKKHRRQVLYSGIITAVGISLHNFPEGMAVFLGSIKGLRVGINLALAIALHNIPEGVAVALPVYFATQSNGRRSNLLPYLVLRNH

SEQ ID NO: 3369 - protein, 277 aa, Mimulus guttatus
MGFTDSPVLVALALSLLGGVSTSIGALFVVMNETPNLKMLGLLQGFAAGLMLSISFFDLAHNAINSIGFLKGNLWFFAGVLFFAIIAYFIPEPTIAPINDSKKKTGDDGGKDMMKKHRKQVLYSGIITAIGISLHNFPEGMAVFLGSMKGLRVGLNLALAIALHNVPEGVAVALPVYFATQSKWQAFKLATLSGLAEPLGVIIVAYLFPSSVSPEILEGLLGAVGGVMAFLTLHEMLPLAFDYAGQKQAVKAVFFGMAFMSASLYFLEISLPADLSL

SEQ ID NO: 3370 - protein, 277 aa, Beta vulgaris
MDSQVLVALALSLVGGLSTSLGALFVVLSDAPNLKMLGLLQGFAAGLMLSISFLDLAHNAINAIGFLKGNIWFFAGVIFFALISNFIPEPTLAPSPNVKSKKRTNGENKQKDLMKKHRRQVLYSGIITAVGISLHNFPEGMAVFLGSIKGLRVGLNLALAIALHNIPEGVAVALPVYFATQSKWQAFKIASLSGLAEPLGVIIVAYLFPSSLNPEILEGLLGAVGGVMAFLTLHEMLPLAFDYAGQKQAVKAVFLGMAFMSASLYFLEISLPAEMSL

SEQ ID NO: 3371 - protein, 112 aa, Papaver somniferum
MDQQVLIALALSMLGGLSTSLGALVVILNDAPNLKMLGLLQGFAAGLMLSISFLDLAHNAINSIGFLKGNVGFSEVLSSLRLFLVLFLNLLLLRLWMVRAKRRVVMQGVKIC

SEQ ID NO: 3372 - protein, 284 aa, Cirsium arvense
LVALSLSMVGGLSTSLGALFVVLSKAPNLKMLGLLQGFAAGLMLSISFFDLAHNAINSIGFLKGNLWFFGGVIFFAIIANFIPEPSLGPTADTKNKKKHGDEGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPKSLDPEILEGLLGAVGGVMAFLTLHEMLPLAFDYAGQKQAVKAVFFGMAFMSASLLFSGAQFTEGHGVVDASFFDIWKVLL

SEQ ID NO: 3373 - protein, 275 aa, Tripterygium wilfordii
MASPVMLALALSLVGGVSTSIGALLVVANPTPNLKMLGLLQGFAAGLMLSISFLDLAHNAINSIGFLKGNLWFFAGVVFFALIAYFIPEPMVSQGWDLKSKKDKDDGDKDVMKKHRRQVLFSGIITAVGISLHNFPEGMAVFLGSMKGLRVGVNLAIAIALHNVPEGVAVALPVYFATQSKWQAFKLATLSGFAEPLGVIVVAYIFPSSLSPEILEGLLGSVGGVMAFLTLHEMLPLAFDYAGPKQAVKAVFLGMAFMSASLYFLEISLPEDMSL

SEQ ID NO: 3374 - protein, 275 aa, Phaseolus coccineus
MDSQVLLGVALSSVGGFSTSIGALFVILSKAPSLKVLGLLQGFAAGLMLSISFFDLTHNALNSLGFLKGNLWFFAGVIFFAVVAKFIPEPTPVPPISNEKSRKKVGNEGNKDIMKRRRRQVLLSGVITAIGISLHNFPEGMAVYLGSMKGVRVGLNLALAIALHNIPEGVAVALPVYFATESKWEAFKLASLSGFAEPLGVIIVACLFPTSLNPEILEGILGSVGGVMAFLTLHEMLPLAFEYAGQKQSVKAVFCGMAFMSASLYFLRRSLPEDM

SEQ ID NO: 3375 - protein, 276 aa, Papaver somniferum
MDQQVLIALALSMLGGLSTSLGALVVILNDAPNLKMLGLLQGFAAGLMLSISFLDLAHNAINSIGFLKGNVWFFGGVIFFAIVSSFIPEPTLAPAVDSKSKKRVVMQGGKDMLKKHRRQVLFSGIITAIGISLHNFPEGMAVFLGSMKGLRVGINLAFAIALHNIPEGVAVALPVYFATQSKWQAFKLATLSGLAEPLGVIIVAYLFPSSLNPEILEGLLGGVGGVMAFLTLHEMLPLAFDYAGPKQAVKAVFLGMAFMSASLYFLEISLPKDISL

SEQ ID NO: 3376 - protein, 272 aa, Glycine max
MDSQVLLGVALSSVGGFSTSIGALFVILSKAPSLKVLGLLQGFAAGLMLSISFFDLTHNALNSLGFLRGNLWFFAGVIFFAVVAKFIPEPTVAPPTSDEKKVGKQGNKDIMKRRRRQVLISGVVTAIGISLHNFPEGMAVYLGSMKGIRVGLNLALAIALHNIPEGVAVALPVYFATQSKWEAFKLASLSGFAEPLGVVIVACLFPTSLNPEILEGILGSVGGVMAFLTLHEMLPLAFEYAGQKQSVKAVFCGMAFMSASLYFLRISLPEDM

SEQ ID NO: 3377 - protein, 66 aa, Cucurbita pepo
MASQVLVALALSLVGGFSTSLGALLVILSGAPNLKMLGLLQGFAAGLMLSISFLDLAHNAINSLGS

SEQ ID NO: 3378 - protein, 275 aa, Unknown
  Sequence found in Organisms: Brassica napus, Brassica juncea
MDSQMLVALGLSLVGGLSTSLGALFVVLSETPNMKMLGLLQGFAAGLMLSISFLDLAHNAINSIGFLKGNLWFFGGVIFFACIAKFIPEPTLGPSTDVKRRKKNGDEGGKDMAKKHRRQVLYSGIVTAIGISLHNFPEGMAVFLGSIKGMRVGVNLALAIALHNIPEGVAVALPIYFATESKWQAFKLATLSGLAEPLGVIIVAYLFPSSLSPEILEGLLGAVGGIMAFLTLHEMLPLAFDYAGQKQAVKAVFVGMACMSASLYFLELSLPESMG

SEQ ID NO: 3379 - protein, 274 aa, Phalaenopsis aphrodite
MDSQILVALSLSLVGGLSTSAGALLVILNPAPNLKMLGLLQGFAAGLMLSISFFDLAHNALNSIGFLRANLWFFAGVVFFASIVSFIPEPTITIEANNIQKDDDGSGKDLMKKHRRNVLFSGIITAVGISLHNFPEGMAVFLGSIKGLRVGLNLALAIALHNIPEGVAVALPVYFATQSKWKAFKLASLSGLAEPLGVIIVAYLFPSSLDPDILEGLLGSVGGVMAFLTLHEMLPLAFDYAGQKKAVKAVFVGMAFMSASLYFLEISLPKELSL

SEQ ID NO: 3380 - protein, 229 aa, Brassica rapa
MDSQMLVALGLSLVGGLSTSLGALFVVLSETPNMKMLGLLQGFAAGLMLSISFLDLAHNAINSIGFLKGNLWFFGGVIFFACIAKFIPEPTLGPSTDVKRRKKNGDEGGKDMAKKHRRQVLYSGIVTAIGISLHNFPEGMAVFLGSIKGMRVGVNLALAIALHNIPEGVAVALPIYFATESKWQAFKLATLSGLAEPLGVIIVAYLFPSSLSPESLKACWEQLVESWHS

SEQ ID NO: 3381 - protein, 275 aa, Raphanus sativus
MDSQMLVALGLSLVGGLSTSLGALFVVLSETPNMKMLGLLQGFAAGLMLSISFLDLAHNAINSIGFLKGNLWFFGGVIFFACIAKFIPEPTLAPSTDVKRRKKNGDEGGKDMAKKHRRQVLYSGIVTAIGISLHNFPEGMAVFLGSIKGMRVGVNLALAIALHNIPEGVAVALPIYFATESKWQAFKLATLSGLAEPLGVIIVAYLFPSSLSPEILEGLLGAVGGIMAFLTLHEMLPLAFDYAGQKQAVKAVFVGMACMSASLYFLELSLPDSMT

SEQ ID NO: 3382 - protein, 278 aa, Brassica rapa
MDSQMLVALGLSLVGGLSTSLGALFVVLSETPNMKMLGLLQGFAAGLMLSISFLDLAHNAINSIGFLKGNLWFFGGVIFFACIAKFIPEPTLGPSTDVKRRKKNGDEGGKDMAKKHRRQVLYSGIVTAIGISLHNFPEGMAVFLGSIKGMRVGVNLALAIALHNIPEGVAVALPIYFATESKWQAFKLATLSGLAEPLGVIIVAYLFPSSLSPEILEGLLGAVGGIMAFLTLHEMLPLAFDYAGQKQAVKAVFVGMACMSASLYFLELSLPESMGWSV

SEQ ID NO: 3383 - protein, 260 aa, Gossypium raimondii
LVFGTGALFVILNQAPNLKMLGLLQGFAAGLMLSISFLDLAHNAMNSIGFLKGNLWFFSGVIFFAVVANFIPEPTLSHSSEVKGKKNKGDEGGKDMMKKHRRQVFFSGIITAIGISLHNFPEGMAVFLGSMKGLRVGLNLALAIALHNIPEGVAVALPVYFATQSKWQAFKLATLSGFAEPLGVVIVAYLFPSSLSPEILEGLLGSVGGVMAFLTLHEMLPLAFDYAGQKQAVKAVFFGMAFMSASLYFLELSLPKDMSL

SEQ ID NO: 3384 - protein, 277 aa, Eutrema halophilum
MVDSQMLVALGLSLVGGLSTSLGALFVVLSDTPNMKMLGLLQGFAAGLMLSISFLDLAHNAINSIGFLKGNLWFFGGVIFFACIAKFIPEPTIGPSTDVKRRKKNGDEGGKDMVKKHRRQVLYSGIITAIGISLHNFPEGMAVFLGSIKGMRVGVNLALAIALHNIPEGVAVALPIYFATESKWQAFKLATLSGLAEPLGVVIVAYLFPSSLSPEILEGLLGAVGGIMAFLTLHEMLPLAFDYAGQKQAVKAVFVGMACMSASLYFLELSLPETMSL

SEQ ID NO: 3385 - protein, 137 aa, Amorphophallus konjac
MAVFLGSMKGIRVGVNLALAIALHNIPEGVAVALPIYFATQSKWQAFKVATFSGFAEPLGVVIVAYLFPSSLSPEILEGLLGSVGGVMAFLTLHEMLPLAFDYAGQKQAVKAVFLGMAFMAASLYFLQISLPDEISL

SEQ ID NO: 3386 - protein, 225 aa, Lippia dulcis
MDSQVLVALALSLLGGLSTSIGALFVVLSETPNLKTLGLLQGFAAGLMLSISFLDLAHNAINSIGFLKGNLWFFAGVIFFAVIANFIPEPKLAPVPHLEKNKKNGDERNKDIMKKHRRQVLFSGIITAVGISLHNFPEGMAVFLGSMKGLRVGLNLALAISLHNIPEGVAVALPIYFATKSKWQAFKLATLSGFAEPLGVIVVAYLFPSSLNPEILRAFLHQSVE

SEQ ID NO: 3387 - protein, 109 aa, Cicer arietinum
MDSQFLLGIALSSIGGFSTSIGALFVIMSQAPSLKMLGLLQGFAAGLMLSISFFDLAHNALNSLGFLRGNLWFFLVSYSLLLLLTLYQNQQFLLQIRRVKRLEMKKTRT

SEQ ID NO: 3388 - protein, 276 aa, Ambrosia trifida
MNSEVLVALSLSLVGGLSTSLGALFVILTKAPNLKMLGTFTGFRCRPYAKHIFFDLAHNAINSIGFLKGNIWFFGGVVFFAIVANFIPEPSLAPTIEAKNKKKQVDEGGKDIMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGSVGGVMAFLTLHEMLPLAFDYAGQKQAVKAVFFGMAFMSASLYFLEISLPSDVGL

SEQ ID NO: 3389 - protein, 276 aa, Arabidopsis lyrata
MDSQMLVALGLSLVGGLSTSLGALFVVLSETPNMKMLGLLQGFAAGLMLSISFLDLAHNAINSIGFLKANLWFFGGVIFFACIAKFIPEPTVGPSTDVKRRKKNGDEGGKDMMKKHRKQVLYSGLITAIGISLHNFPEGMAVFLGSIKGMRVGVNLALAIALHNIPEGVAVALPIYFATESKWQAFKLATLSGLAEPLGVIIVAYLFPRSLSPEILEGLLGAVGGIMAFLTLHEMLPLAFDYAGQKQAVKAVFFGMACMSASLYFLELSLPDTMSL

SEQ ID NO: 3390 - protein, 272 aa, Triphysaria pusilla
MDSQVLVALALSLVGGLSTSIGALLVVINPTPNLKKLGLLQGFAAGLMLSISFFDLAHNSINSIGFLKGNLWFFAGVIFFGIIANFIPEPTLAPVSNKGNKKHGDEGGKDIMKKHRRQVLFSGIITAVGISLHNFPEGMAVFLGSIKGLRVGVNLALAIALHNIPEGVAVAFPVYFATQSKWQAFKLATLSGLAEPLGVIIVAYLFPSSLNPEILEGLLGSVGGVMAFLTLHEMLPLAFDYAGQKQAVKAVFVGMLSCLPAYIFLRSACQQI

SEQ ID NO: 3391 - protein, 267 aa, Brassica juncea
LGLSLVGGLSTSLGALFVVLSETPNMKMLGLLQGFAAGLMLSISFLDLAHNAINSIGFLKGNLWFFGGVIFFACIAKFIPEPTLAPSTDVKRRKKNGDEGGKDMAKKHRRQVLYSGIVTAIGISLHNFPEGMAVFLGSIKGMRVGVNLALAIALHNIPEGVAVALPIYFATESKWQAFKLATLSGLAEPLGVIIVAYLFPSSLSPEILEGLLGAVGGIMAFLTLHEMLPLAFDYAGQKQAVKAVFVGMACMSASLYFLELSLPDSMS

SEQ ID NO: 3392 - protein, 274 aa, Medicago truncatula
MDSQFLLGIALSSIGGLSTSIGALFVIMSQAPSLKMLGLLQGFAAGLMLSISFFDLAHNAINTLGFLRGNLWFFSGVIFFAIVANFIPEPTAPPPDKKSKQVGREENKNTMKKRRRQVLFSGIITAIGISLHNFPEGMAVYLGSMKGLRVGLNLALAIALHNIPEGVAVALPVYFATESKWQAFKLASLSGLAEPLGVIIVACLFPTSLNPEILEGLLASVGGVMAFLTLHEMLPLAFEYAGEKKSVKAVFCGMAFMSASLYFLRLSLPEDTGL

SEQ ID NO: 3393 - protein, 276 aa, Arabidopsis thaliana
MDSQMLVALGLSLVGGLSTSLGALFVVLSETPNMKMLGLLQGFASGLMLSISFLDLAHNAINSIGFFKANLWFFGGVIFFACITKFIPEPTLGPSTDGKRRKKNGDEGGKDMMKKHRKQVLYSGLITAIGISLHNFPEGMAVFLGSIKGMRVGVNLALAIALHNIPEGVAVALPIYFATESKWQAFKLATLSGLAEPLGVIIVAYLFPRSLSPEILEGLLGAVGGIMAFLTLHEMLPLAFDYAGQKQAVKAVFFGMACMSASLYFLELSLPETMSL

SEQ ID NO: 3394 - protein, 241 aa, Lotus japonicus
MLGLLQGFAAGLMLSISFFDLAHNALNSLGFLKGNLWFFAGVLFFGVIASFIPEPSLAPTSNTKSRKKNGDEESKDGMKKHRRQVLFSGIVTAVGISLHNFPEGMAVFLGSMKGLRVGLNLALAIALHNIPEGVAVALPVYFATESKWQAFKLASLSGFAEPLGVIIVAYLFPSSLNPEILEGLLGSVGGVMAFLTLHEMLPLAFDYAGQKQSVKAVFLGMAFMSASLYFLSICLPEDLSL

SEQ ID NO: 3395 - protein, 232 aa, Podocarpus macrophillus
MLCLRMDNSQVIVALMLSLVGGASTSLGAVLVVVNPTPNLKVLGLLQGFASGLMLSISFMDLAHNAINSIGFLKANLWFFGGVILFAMIVNFIPEPNLVPSQSQKGKREKNHDDGGKDLMKKHRKQVFFSGIITAIGISLHNFPEGMAVFLGSIKGLRIGLNLALAIALHNIPEGVAVALPVYFATQSKWQAFKLASLSGLAEPLGVIIVAYLFPSNLSPEILEGLLGSVGG

SEQ ID NO: 3396 - protein, 263 aa, Cajanus cajan
MDSQVLLGVALSSIGGFSTSIGALFVIMSQAPSLKVLGLLQGFAAGLMLSISFFDLAHNALNTLGFLRGNLWFFAGVIFFAVVAKFIPEPTVTPPTSDDKITKKVGKEGKKDIMKKRRRQVLLSGVITAIGISLHNFPEGMAVYLGSMKGIRVGLNLALAIALHNIPEGVAVALPVYFATQSKWEAFKLASLSGFAEPLGVIIVACLFPTSLNPEILEGILGSVGGVMAFLTLHEMLPLAFEYAGQKQSVKAVFCGMAFMSAR

SEQ ID NO: 3397 - protein, 265 aa, Taraxacum officinale
MDSEVLVALSLSLVGGLSTSLGALFVILTKAPNLKMLGLLQGFAAGLMLSISFFDLAHNAINSIGFLKGNLWFFGGVIFFAIIANFIPEPSLAPTADVKNKKRNEDEGGKDVMKKHRRQVLFSGIITAVGISLHNFPEGMAVFLGSLKGLRVGLNLALAIALHNIPEGVAVALPVYFATQSKWQAFKLATVSGLAEPLGVIIVAYLFPSSLDPEILEGLLGAVGGVMAFLTLHEMLPLAFDYAGQKQAVKAVFFGWPSCLQVCIF

SEQ ID NO: 3398 - protein, 275 aa, Picea glauca
MDSQVMVALMLSLVGGASTSLGALFVVINPAPKLKVLGLLQGFAAGLMLSISFLDLAHNAINSIGFLKANLWFFGGVVVFAFIVNFIPEPTLVPSQNQADTSEKYDGGKDLMKKHRRQVFFSGIITAIGISLHNFPEGMAVFLGSIKGLRVGLNLALAIALHNIPEGIAVALPVYFATESKWQAFKLASLSGLAEPLGVVLVAYLFPSSLSPEILEGLLGSVGGVMAFLTLHEMLPLAFDYAGQKQAIKAVFIGMAVMSTSLYFLEISLPKEMSL

SEQ ID NO: 3399 - protein, 276 aa, Brachypodium distachyon
MESHVWVALALSFVGGLSTSLGALLVILNPTPDLKRLGLLQGFAAGLMLSISFLDLAHNALNSIGFLKANLWFFAGVLFFGFIVKFIPEPTFVPTDDVIRKKTDDDGSGKDMMKKHRRQVLFSGIITAVGISLHNFPEGIAVFLGSVKGLRVGINLAIAIALHNIPEGVAVALPLYFATKSKWQAFKYATLSGFAEPLGVVFVAVFFPSNLNPEILEGLLASVGGVMAFLTLHELLPLAFDYAGQKQAVKAVFVGMAIMSASLYFLEISLPEEIGL

SEQ ID NO: 3400 - protein, 237 aa, Arachis hypogaea
LQGFAAGLMLSISFFDLAHNALNSLGFLKGNLWFFAGVVFFGVVANFIPEPTLAPTSSDKSRKKNGDGGGKDIMKKHRRQVLFSGIITAVGISLHNFPEGMAVFLGSIKGLRVGLNLALAIALHNIPEGVAVALPVYFATESKWQAFKLASLSGFAEPLGVIIVAYLFPSSLDPEILEGLLGSVGGVMAFLTLHEMLPLAFDYAGQKQSVKAVFFGMAFMSASLYFLSISLPEDMSL

SEQ ID NO: 3401 - protein, 276 aa, Secale cereale
MEQHVLVALALSFVGGLSTSLGALLVIVNPSPDLKRLGLLQGFAAGLMLSISFLDLAHNALNSIGFLKANLWFFAGVLFFGFVVKFIPEPTFVPTADASKKKTDDDGSGKDMMKKHRRQVLFSGIITAVGISLHNFPEGMAVFLGSVKGLRVGVNLAIAIALHNIPEGVAVALPLYFATKSKWQAFKYATLSGLAEPLGVFFVAVLFPSNLNPEILEGLLASVGGVMAFLTLHELLPLAFDYAGQKQAVKAVFVGMAVMSASLYFLEISLPKEISL

SEQ ID NO: 3402 - protein, 276 aa, Hordeum vulgare
MEQHVLVALALSFVGGLSTSLGALLVIVNPSPDLKRLGLLQGFAAGLMLSISFLDLAHNALNSIGFLKANLWFFAGVLFFGFVVKFIPEPTFVPTTDASKKKTDDDGAGKDMMKKHRRQVLFSGIITAVGISLHNFPEGMAVFLGSVKGLRVGVNLAIAIALHNIPEGVAVALPLYFATKSKWQAFKYATLSGLAEPLGVFFVAVLFPSNLNPEILEGLLASVGGVMAFLTLHELLPLAFDYAGQKQAVKAVFVGMAVMSASLYFLEISLPKEISL

SEQ ID NO: 3403 - protein, 276 aa, Triticum aestivum
MEQHVLVALALSFVGGLSTSLGALLVIVNPSPDLKRLGLLQGFAAGLMLSISFLDLAHNALNSIGFLKANLWFFAGVLFFGFVVKFIPEPTFVPTTDASKKKTDDDGSGKDMMKKHRRQVLFSGIITAVGISLHNFPEGMAVFLGSVKGLRVGVNLAIAIALHNIPEGVAVALPLYFATKSKWQAFKYATLSGLAEPLGVFFVAVLFPSNLNPEILEGLLASVGGVMAFLTLHELLPLAFDYAGQKQAVKAVFVGMAVMSASLYFLEISLPKEISL

SEQ ID NO: 3404 - protein, 377 aa, Glycine max
MKTPKRQSSPANAARPVESDSGEIVTRFKNGGRRRIKIKRMKYTCQTKIRVRNDAGAGGVSQPPAVDSEGEKREIDEHVEISLSLASSSSEEEERLSSKQSDGVLSYGSASVIGSRTEMEDAVSSEIGFAAKCDFFAVYDGHGGAQVAEACKERLHRLVAEEVVGSSESHVEWDWRGVMEGCFRKMDSEVAGNAAVRMVGSTAVVAVVAVEEVIVANCGDSRAVLGRGGEAVDLSSDHKPHRPDELMRIEEAGGRVINWNGQRVLGVLATSRSIGDQYLRPYVISKPEVTVTQRSSKDEFLILASDGLWDVMSSEVACQVVRKCFQGQIRRVCDGVGNHQNRATEAADLLAEIALAKGSRDNTSVIVVELRGTVTTD

SEQ ID NO: 3405 - protein, 378 aa, Cajanus cajan
MKTPKRHSPPPNAVRRVEPDSVEIIAGFKNSRRRRLKIRRMKYTCQTKIRVGKDADGVPPMAAEDSEGERREIHEHVEISLSLASSSSEEEERSSSKQKDGALSHGSVSLIGSRKEMEDAVSVEIGFVAKERGKCDFFAVYDGHGGAQVAEACRERLHRLVAEEVERSGSHMELDWDGVMQGCFRKMDTEVAGNAAVRTVGSTALVAVVAEAQIVVANCGDCRAVMGRGGEAVDLSTDHKPDRPDELMRIEEAGGRVINWNGQRVLGVLATSRSIGDQYLRPYVISKPEVTMTKRSSKDEFLILASDGLWDVMSSEVACQVVRKCLNGQIRRVCNGVENHQSRSAEAAGLLAEIALAKGSRDNISVIVVELRGTVTSD

SEQ ID NO: 3406 - protein, 372 aa, Vigna unguiculata
MKKPKRHSPTANADRRVDPDSGEFVAKMKNGRQRRLKIRQMKIRIRNGTAGVSPPPAEDLEGGSREIHEHVEISLSLAAASSSSEEEERSSSERNDGVLSYGSTSVIGSRKEMEDAVSAEIGFAAKERGKYDFFAVYDGHGGAQVAEACRERLHRLVAEEVERSESHVEWDWQGVMEGCFRKMDSEVAGNAAVRTVGSTAVVAVIAAEELVVANCGDCRAVLGRGGEAVDLSSDHKPDRPDELMRIEEAGGRVINWNGQRVLGVLATSRSIGDEYLRPYVISEPEVTVTKRSNKDEFVILASDGLWDVMSSEVACQVVRKCLNGQIRRMCNGVGKHENRAAEAASLLAEIALAKGSRDNTSVIVVELRGTVT

SEQ ID NO: 3407 - protein, 396 aa, Vigna unguiculata
  misc_feature (136)..(136): Xaa can be any naturally occurring amino acid
  misc_feature (270)..(270): Xaa can be any naturally occurring amino acid
YFHLIVYSLLLSCVVFSSLHAKTTMKKPKRHSPTANADRRVDPDSGEFVAKMKNGRQRRLKIRQMKIRIRNGTAGVSPPPAEDLEGGSREIHEHVEISLSLAAASSSSEEEERSSSERNDGVLSYGSTSVIGSRKXMEDAVSAEIGFAAKERGKYDFFAVYDGHGGAQVAEACRERLHRLVAEEVERSESHVEWDWQGVMEGCFRKMDSEVAGNAAVRTVGSTAVVAVIAAEELVVANCGDCRAVLGRGGEAVDLSSDHKPDRPDELMRXEEAGGRVINWNGQRVLGVLATSRSIGDEYLRPYVISEPEVTVTKRSNKDEFVILASDGLWDVMSSEVACQVVRKCLNGQIRRMCNGVGKHENRAAEAASLLAEIALAKGSRDNTSVIVVELRGTVT

SEQ ID NO: 3408 - protein, 405 aa, Glycine max
MGDFTVALNPPKTFRADILLSTTNNRTSPAARGFQTVLAFKPPRAFRGIRASVMPREGQQASLGDALVNTPRRSDFVEAIRRTAALSSCLSETSLHATVPGLESKTRGKVRDIYDAGDYLVLVTTDRQSAFDRILASIPFKGQVLNQTSLWWFERTKHIVSNAVVLAPDNNVTIARKCSVFPVEFVARGFVTGSTDTSLWTVYNKGVRNYCGNVIPDGMVKNQKLPKNILTPTTKAADHDVPITPDEIIDRGLMTRADYVEVSEKALSLFEYGQQVALEHGLILVDTKYEFGKANDGSIMLIDEVHTPDSSRYWIANSYLERFQNGLEPENIDKEFLRLWFISHCNPYEDEVLPDAPEDLVCELAWRYIFLYETITKSKFEVPSTEEPIHDRITRNVASALSSLK

SEQ ID NO: 3409 - protein, 402 aa, Cajanus cajan
MGDFTVALNPAKTFRSEILPINRTSPAALRPATAISFKSHRLRGPAIRASVMPREGQQQQQQPALLSSPRKSELADVIRRSALSNCLSETNLHATVPGLQSKTRGKVRDIYDAGDHLVLVTTDRQSAFDRILASIPFKGQVLNETSLWWFQRTKHIVSNAVVSAPDKNVTIAKKCSVFPVEFVARGFVTGSTDTSLWTVYNNGVRNYCGNVLPDGMVKNQKLPENILTPTTKAADHDVPVTPDEIIERGLMTRADYVEASEKALCLFEYGQQVALEHGLILVDTKYEFGKANDGSIMLIDEVHTPDSSRYWIAGSYLERFQNGLEPENIDKEFLRLWFKSHCNPYEDEVLPDAPEDLVCELAWRYIFLYETITKSKFEVPLTEEPIHDRISRNVASALSSLK

SEQ ID NO: 3410 - protein, 358 aa, Vigna unguiculata
MGDFTVALNPPKTFGAEILSPINRTSAAARGRVTKIAFKPHGFRAIRASVMPREGQQQPSLGDSLVNSPHRNDVVDVIRRSGLSNCLSETNLHNTVPGLVSKTRGKVRDIYDAGDYLVLVTTDRQSAFDRILASIPFKGQVLNETSLWWFERTKQIVPNAVVSAPDKNVTIAKKCSVFPVEFVARGFVTGSTDTSLWTVYNKGSRNYCGNVLPDGMVKNQKLSENILTPTTKAADHDVPVTPDEIIERGLMTRSDYEAVSEKALSLFEYGQQVASEHGLILVDTKYEFGKANDGSIMLIDEVHTPDSSRYWIANSYLERFQNGLEPENIDKEFLRLWFKSHCNPYEDEVLPDAPEDLL

SEQ ID NO: 3411 - protein, 402 aa, Phaseolus coccineus
MGDFTVALNPSQTLGAEILPPVNRTYAAARGPVTKIAFKPHGFRAIRASVMPREGQQQPSLGDSLVNSPHRNDVVDVIRRSGLSNCLSETNLHNTVPGLVSKTRGKVRDIYDAGDYLVLVTTDRQSAFDRILASIPFKGQVLNETSLWWFERTKQIVSNAVVSAPDKNVTIAKKCSVFPVEFVARGFVTGSTDTSLWTVYNKGARNYCGNVLPDGMVKNQKLSENILTPTTKAADHDVPVTPDEIIERGLMTRADYEEVSEKALSLFEYGQQVASEHGLILVDTKYEFGKANDGSIMLIDEVHTPDSSRYWIANSYLERFQNGLEPENIDKEFLRLWFKSHCNPYEDEVLPDAPEDLVCELSWRYIFLYETITKSKFEIPSTEEPIHDRISRNVASALSSLK

SEQ ID NO: 3412 - protein, 297 aa, Phaseolus coccineus
MGDFTVALNPSQTLGAEILPPVNRTYAAARGPVTKIAFKPHGFRAIRASVMPREGQQQPSLGDSLVNSPHRNDVVDVIRRSGLSNCLSETNLHNTVPGLVSKTRGKVRDIYDAGDYLVLVTTDRQSAFDRILASIPFKGQVLNETSLWWFERTKQIVSNAVVSAPDKNVTIAKKCSVFPVEFVARGFVTGSTDTSLWTVYNKGARNYCGNVLPDGMVKNQKLSENILTPTTKAADHDVPVTPDEIIERGLMTRADYEEVSEKALSLFEYGQQVASEHGLILVDTKYEFGKQMMVQLC

SEQ ID NO: 3413 - protein, 90 aa, Cajanus cajan
MAGCEKEDYFTAPNAETTSAGKYGRLAPKKKPLISKDNERAFFDSADWALCKQGAGVNQQSTTAVETLQPKLQRTPHQQLPPRRPTCTPG

SEQ ID NO: 3414 - protein, 90 aa, Phaseolus coccineus
MSGCDKEDYFTAPDAETTSGGKYGSLVPKKKPLISKDNERAFFDSADWALGKQGAGVNQQSTAAVETLRPKLQRTPHQQLPPRRPACTSG

SEQ ID NO: 3415 - protein, 90 aa, Vigna unguiculata
MSGCDKEDYFTAQDAETTSGGKYGTLVPKKKPLISKDNERAFFDSADWALCKQGAGVNQQSTAAVETLRPKLQRTPHQQLPPRRPACTSG

SEQ ID NO: 3416 - protein, 93 aa, Glycine max
MAGYDKEDYFSAPNAETTCAGKYGRLAPKKKPLISKNNERAFFDSADWALCKSQQQGAGVNQQSTTAVETLRPKLQRTPHQQLPPRRPACTSG

SEQ ID NO: 3417 - protein, 90 aa, Phaseolus coccineus
MSGCDKEDYFTAPDAETTAGGKYGSLVPKKKPLISKDNERAFFDSADWALCKQGAGVNQQSTAAVETLQPKLQRTPHQQLPPRRPACTSG

SEQ ID NO: 3418 - protein, 91 aa, Lotus japonicus
MAECNREDYFTAPNVETTSTAKKYGGLVPKKKPLISKDNERAFFDSADWALCKQGAGVNQQSTAAVETLRPKLQRTPHQQLPPRRPACTSG

SEQ ID NO: 3419 - protein, 92 aa, Glycyrrhiza uralensis
MAECNREDYFAAPDNAESTSAGKKYGGLVPKKKPLISKDNERAFFDSADWALCKQGAGVNQQSTAAVETLRPKLQRTPHQQLPPRRPAYTSG

SEQ ID NO: 3420 - protein, 103 aa, Medicago truncatula
MAEFNREEYFAANNIESTSVGKKYGGLVPKKKPLISKDNERAFFDSADWALCKQGAGMNQQSTAAVETLRPKLQRTPHQQLPPRRPACTSGRLDSTIGTRICS

SEQ ID NO: 3421 - protein, 91 aa, Medicago truncatula
MAEFNREEYFAANNIESTSVGKKYGGLVPKKKPLISKDNERAFFDSADWALCKQGAGMNQQSTAAVETLRPKLQRTPHQQLPPRRPACTSG

SEQ ID NO: 3422 - protein, 91 aa, Cicer arietinum
MAECNREDYFAANDVESTSAEKKYGGLVPKKKPLISKDTERAFFDSADWALCKQGAGVNKQSTAAVETLRPKLQKTPHQRLPPRRPACTSG

SEQ ID NO: 3423 - protein, 95 aa, Prunus persica
MADCNRGEDYFSAQDHEASTVVQKYGGLAPKKKPLISKDHERAFFDSADWALCKQGAGVNPKSTAAVETLRPKLQRTPHQQLPPRRPACTSDHDI

SEQ ID NO: 3424 - protein, 214 aa, Glycine max
MQMAILLRGGALGDSSFRLCSLTSTSSLHVSQNVAIPTSSSSSSSLVLPLIASKFKTVSRIRITCSAVQESSPSTAATAETKEEVKEAPKAEPAKKPPAKAPAKPLPQMMEEDVIPSLKSIFEAQEDFSNIELVFKDNKLEGSFLKKGNPYSFWAFFPTGNLIGPKGFSLSSYNSGASTVEPFLIDEKKITARHIIFWVKKRLAAQGIIPVWED

SEQ ID NO: 3425 - protein, 215 aa, Cajanus cajan
MQMAILLRGGALGDSTFRLCSLPSTSSLHVSQNVAIPTSSSSPILPLIASKFKTASRNRITCSAVQESSPSTAATTTETKEEVKEATEAPKAAPAKKPPAKAPVKPLPQMMEEDVIPALKEIFEAQEDFSNIELIFKDNKLEGSFLKKGNPYTFWAFFPTGNVTGPKGFSLSSYNAGASTVEPFLIDEKKITAKHIIFWVEKRLAAQGIIPVWKD

SEQ ID NO: 3426 - protein, 212 aa, Vigna unguiculata
MQMATLLRGGALADSSFRLCSLPSTSSLHVSQNVAIPTSSSSSSPILPLIASKHKTVSRSRITCSAVQESSPSTAATAETKEEVKEAPKAAPEKKAPAKAPVKPLPQMMEEDVIPSLKAIFEAQEDLSNIELVFKDNRLEGSLLKKGNPYSFWAFFPTGLIGPKGFSLSSYNGGASTVEPFLVDEKKVTAKHIIFWVEKRLAAQGILPIWKD

SEQ ID NO: 3427 - protein, 210 aa, Phaseolus coccineus
MQMAILLRGGALADSSFRLCSLPSTSSLHVSQNVVIPTSSSSSSPILPLIASKYKTASRNRITCSAVQESSPSTAATAETKEEVKEEAPKAAPAKKPPAKAPVKPLPQMMEEDVIPSLKAIFEAQEDLSNIELVFNDNRLEGSLLKKGNPYSFWAFFPTGITGPKGFSLSSYNGGASTVEPFLVDEKKITAKHIIFWVEKRLAAQGILPI

SEQ ID NO: 3428 - protein, 210 aa, Phaseolus coccineus
MQMAILLRGGALADSSFRLCSLPSTSSLHVSQNVVIPTSSSSSSPILPLIASKYKTASRNRITCSAVQESSPSTAATAETKEEVKEEAPKAAPAKKPPAKAPVKPLPQMMEEDVIPSLKAIFEAQEDLSNIELVFNDNRLEGSLLKKGNPYSFWAFFPTGITGPKGFSLSSYNGGASTVEPFLVDEKKITAKHIILWVEKRLAAQGILPI

SEQ ID NO: 3429 - protein, 209 aa, Vigna unguiculata
ATLLRGGALADSSFRLCSLPSTSSLHVSQNVAIPTSSSSSSPILPLIASKHKTVSRSRITCSAVQESSPSTAATAETKEEVKEAPKAAPEKKAPAKAPVKPLPQMMEEDVIPSLKAIFEAQEDLSNIELVFKDNRLEGSLLKKGNPYSFWAFFPTGLIGPKGFSLSSYNGGASTVEPFLVDEKKVTAKHIIFWVEKRLAAQGILPIWKD

SEQ ID NO: 3430 - protein, 212 aa, Medicago truncatula
MQMALLLRGGALGDSSFRLCSLTSTSSSLHVSQNVVIPNSTSSPILPLIASRFKAVSRNKITCSAVQESSTSTSATAETKEEVKEEAPKAAAVKKTPAKAPVKPLPQMMEEDVIPSLKAILEAQQDLSDIELVFQDNKLEGSFLKKGNPYSFWAFFPTGLTGPKGFSLSSYNSGASTVEPFLVDEKKVNSKLIVFWVEKRLAAQGIIPVWKD

SEQ ID NO: 3431 - protein, 212 aa, Lotus japonicus
MQMAISLRGGALGDPSFRLCSLNSTSSLHVSQNVVVPTSSSSSPVLPLIACKIKTASRSKIICSAVQESSPSTSATTETKEEEVKAAPKAAAEKKPPAKAPVKPLPQMMEEDVIPSLKEIFEAQEDLSDIELVFQDNKLEGSFLKKGNPYLFWAFFPTGNLTGPKGFSVSSYNSRASTVEPFLVDEKKITAKHIVFWVENVWQHRDHSCLER

SEQ ID NO: 3432 - protein, 211 aa, Cicer arietinum
MQMALLLRGGTLGDSSFRLCSLTSSSSASHVSQNVVIPTSSSSPILPLIASRFKTFSRNKITCSAVQESSTSTSTSAETKEEVKTVPKAATEKKAPAKAPVKPLPQMMEEDVIPSLKTILEAQQDLSDIDLVFQDNKLEGSFLKKGNPYSFWAFFPTGITGPKGFALSSYNSGASTVEPFLIDEKKITSKHIVFWVEKRLAAQGIIPVWKD

SEQ ID NO: 3433 - protein, 212 aa, Trifolium pratense
  misc_feature (96)..(96): Xaa can be any naturally occurring amino acid
MQMALLLRGGTLGESSFRLCSFTSTSSLHVSQNVVIPNSSSSPILPLIASRFKTISRNKIICSAVQESSTSTSATAETKEEVKAAAPKAATEKKAXAAKAPVKPLPQMMEEDVIPSLKAILEAQQDLSDLQLVFQDNKLEGSFSKKGNPYSFWAFFPTGLTGPKGFSLSSYNSGASTVEPFLVDEKKVTAKLIVFWVEKRLAAQGIIPVWKD

SEQ ID NO: 3434 - protein, 777 aa, Glycine max
MATLSDIGVAAGLNILSAFIFFVAFAILRLQPFNDRVYFPKWYLKGLRTDPVHGGAFVRKFVNLDWRSYLRFLNWMPAALRMPEPELIDHAGLDSVVYLRIYLIGLKIFVPIAFLAWAVLVPVNATSTGLESAGRDNITSSDIDKLSISNVHSRSERFWAHILVAYAFTFWTCYILLKEYEKVASMRLQFLAAEKRRPDQFTVLVRNIPPDPDESVSELVEHFFLVNHPDNYLTHQVVYNANKLAKLVKKKKKLQNWLVYYQNKVERTSERPQIKTGFLGLCGNKVDAIDHHNTEIDKLSKEIALERDNVSNDPKSIMPAAFVSFKTRWGAAVCAQTQQTRNPTMWLTEWAPEPRDIYWSNLAIPYVSLTVRRLIMAVAFFFLTFFFMIPIAIVQGLASIEGIRKRAPWLNPLIDIPFIKSFIQGFLPGIALKLFLIFLPTILMIMSKFEGFGSISSLERRAASRYYLFNFVNIFLGNILTGTAFEQLDSFIHQPANEYPITIGTAIPLKASFFITYIMVDGWAGIAAEVLMLKPLIIYHLKNFFLVKTEKDREEAMDPGSIGFNTGEPRIQLYFLLGLVYASVTPTVLPFIIVFFGLAYVVFRHQIINVYNQEYESGAAFWPDVHFRVIIALIVSQIVLMGLLTTKEAASSTPFLIVLPVLTIWFHIYCKGRFEPAFVRYPLQEAMMKDTLERATDPNFNLKAYLQNAYVHPVFKASLFDEDEEDEEVMSLKLETESVTVPTKRQSRRNTPLASRISGASSPSLPDHGIRNHNPEP

SEQ ID NO: 3435 - protein, 774 aa, Phaseolus coccineus
MATLEDIGVAAGLNILSAFIFFVAFAILRLQPFNDRVYFPKWYLKGLRTDPVHGGAFVRKFVNLDWRSYIRFLNWMPAALRMPEPELIDHAGLDSAVYLRIYLIGLKIFVPIAFLAWAVLVPVNSTSTGLEGAKLDNITSSDIDKLSISNVHSESQRFWAHIVVAYAFTFWTCYILKREYEKVAAMRLQFLAAEKRRPDQFTVLIKNIPPDPDESVSELVEHFFLVNHPDNYLTHQVVYNANKLSKLVKKKKKLQNWLVYYQNKLERTSERPQVKTGFLGLCGMKVDAIDHHNTEIDRLSKEIALERDTVTNDSNSVIPAAFVSFKSRWGAAVCAQTQQTRNPTLWLSEWAPEPRDVYWSNLSIPYVSLSIRRLIIAVAFFFLTFFFMIPIAIVQSLASIDGIQKRAPWLDPIINVPFIKSFIQGFLPGIALKLFLIFLPTILMIMSKFEGFGSISSLERRSASRYYLFNLVNIFLGNILTGTAFEQLDTFIHQPANEYPITIGTAIPLKASFFITYIMVDGWSGIAAEVLMLKPLIIYHLKNFFLVKTEKDREEAMDPGSIGFNTGEPRIQLYFLLGLVYAAVTPTVLPFIIVFFGLAYVVFRHQIINVYNQEYESGAAFWPDVHFRIILALIVSQIVLMGLLTTKKAASSTPFLIVLPILTIWFHRYCKGRFESAFVKYPLQEAMMKDTLERATEPNLNLKAYLQNAYVHPVFKASLGEDDDEDEEAISLKWETESIVPTKRQSRKNTPLPSRISGASSPSLPDGSRNRPEP

SEQ ID NO: 3436 - protein, 774 aa, Trigonella foenum-graecum
MATLEDISLAAGINILSAFIFFVAFAILRLQPLNDRVYFPKWYLKGLRTDPVHGGAFVRKIVNLDWRSYIRFLNWMPAALRMPEPELIDHAGLDSVVYLRIYLLGLKIFVPIAFLAWAVLVPVNWTSTGLEKPGIKNITSSDIDKISISNVQRGSERFWSHIVVAYAFTFWTCYTLMKEYGKVAAMRLQFLAAERRRPDQFSVLVRNIPPDPDESVGELVEHFFLVNHPDNYLTHQVVYNANNLAKLVKKKSKMQNWLVYYQNKLERTSKRPEMKTGFLGLSGKKVDAIDYYTTEIDKLSKEIALERDKVTNDPKSTMPAAFVSFKSRWGAAVCAQTQQTRNPTIWLTEWAPEPRDVYWPNLAIPYVSLTVRRLIIAVAFFFLTFFFMIPIAIVQGLASLDGIQKAAPWLKPLVSVPVIKSFIQGFLPGIALKLFLIFLPTILMMMSKFEGFGSISSLERRSASRYYLFSFVNIFLGNLLTGSAFQQLDTFIHQPANEYPITIGTAIPLKASFFITYIMVDGWSGIAAEVLMLKPLIMYHLKNFFLVKTEKDREEAMDPGSIGFNTGEPRIQLYFLLGLVYAAVTPTVLPFIIIFFGLAYVVFRHQIINVYNQEYESGAAFWPDVHFRVIIALLVSQIVLMGLLTTKKAASSTPFLIVLPILTIWFHRYCKGRFESAFVKYPLQEAMMKDTLERATEPNLNIKGYLQYAYIHPVFKASLDDDADEEDVTSLKWETESAIVPTKRHSRRNTPLPSKISGASSHSMLDGVKNDPES

SEQ ID NO: 3437 - protein, 774 aa, Medicago truncatula
MAKLADISLAAGINILSAFIFFVAFAILRLQPLNDRVYFPKWYLKGLRTDPVHGGAFMRKIVNLDWRSYIRFLNWMPAALRMPEPELIDHAGLDSAVYLRIYLLGLKIFVPIAFLAWAVLVPVNWTSSGLENAGIKNITSSDIDKISISNVQRGSERFWSHIVVAYAFTFWTCYTLMKEYGKVTAMRLQFLATEKRRPDQFTVLVRNIPPDTDESVGELVEHFFLVNHPDNYLTHQVVYNANKLEKFVKKKSKLQNWLVYYQNKLERTSKRPEMKTGFLGLHGKKVDAIDYYTTEIDKLSKEIALERDKVTNDPKSTMPAAFVSFKSRWGAAVCAQTQQTRNPTIWLTEWAPEPRDVYWQNLAIPYVSLTVRRLIIAVAFFFLTFFFMIPIAIVQGLASLDGIQKAAPWLNPLVRVPVVMSFIQGFLPGIVLKLFLIFLPTILMMMSKFEGFGSISSLERRSASRYYLFCFVNIFLGNLLAGSAFQQLDTFIHQPANEYPITIGTAIPLKASFFITYIMVDGWSGIAAEVLMLKPLIMYHLKNFFLVKTEKDREEAMNPGSIGFNTGEPRIQLYFLLGLVYAAVTPTVLPFIIIFFGLAYVVFRHQIINVYNQEYESGAAFWPDVHFRVIIALLVSQIVLMGLLTTKKAASSTPFLIVLPILTIWFHRYCKGRFESAFVKFPLQEAMMKDTLERATEPNLNVKGYLQHAYVHPVFKASHDDDADEEDAMSLKWETESATVATKRQSRRSTPLPSRFSGASSPSMLDSIKNDPES

SEQ ID NO: 3438 - protein, 774 aa, Glycine max
MTTLSDIGVAAAINISSALLFFVAFAILRLQPWNDRVYFPKWYLKGLRTDPVHGRPLVSKFINLDWRAYLGSLNWMPEALRMPEPELIDHAGLDSAVYLRIYLIGLKIFVPIAFLAWIVLVPVNCTSTGLEGAQMKNITSSDIDKLSISNVHRGSERFWGHIVMAYTFTFWTCYVLLKEYEKVATMRLGFLAAEKRRPDQFTVLVRNIPPDPDESVSELVEHFFLVNHPGHYLTHQVVYDANKLAKLVKKKKKLKNWLVYYQNKLERTSKRPEIKTGFLGLWGKKVDAIDHHITEIDKLSKEIVEERENVTNDPKAIMPAAFVSFKTRWAAAVCAQTQQTRNPTLWLTEWAPEPRDVYWRNLPIPYVSLTVRRLITAVAFFFLTFFFMIPIAFVQTLASLDGIQKAAPWLKPLVDIPFIKSFIQGFLPGIVLKLFLIFLPTILMIMSKFEGYGSISSLERRSASRYYLFNFVNIFLGNILTGTAFQQLSSFIHQPANQYPVTIGTAIPLKASFFITYIMIDGWASIAAEVLMLKPLIVYHLKNFFLVKTEKDREEAMDPGSIGFNTGEPRIQLYFLLGLVYAAVTPAVLPFIIVFFGLAYLVFRHQIINVYNQEYESGAAFWPDVHFRIVMALLVSQIVLMGLLTTKKAASSTPFLVVLPILTIWFHRYCKGRFESAFVKFPLQEAMMKDTLERTTEPNLNLKGYLQNAYVHPVFKDSMDDDDDEEDILSMDLETESVTVRTKRQSRRNTPLPSKNNDASSPSLSDGIGNHPEP

SEQ ID NO: 3439 - protein, 774 aa, Glycine max
MTTLSDIGVAAAINISTALLFFVAFAILRLQPWNDRVYFPKWYLKGLRTDPVHGRALVSKFINLDWRAYLSFLNWMPEALRMPEPELIDHAGLDSVVYLRIYLIGLKIFIPIAFLAWIVLVPVNWTSTGLEGSQIKNITSSNIDKLSVSNVHRGSERFWGHIVMAYAFTFWTCYVLLKEYGKVATMRLGFLAAEKRRPDQFTVLVRNIPPDPDESVSELVEHFFLVNHPDHYLTHQVVYDANKLAKLVEKKKKFKNWLVYYQNKLERTSKRPEIKTGFLGLWGKKVDAIDHHITEIDKLSKEIVEERENVTNDPKAIMPAAFVSFKTRWAAAVCAQTQQTRNPTLWLTEWAPEPRDVYWRNLPIPYVSLTVRRLIIAVTFFFLTFFFMIPIAFVQTLASLDGIQKAAPWLKPLVDIPFIKSFIQGFLPGIVLKLFLIFLPTILMIMSKFEGFGSISSLERRSASRYYLFNFVNIFLGNILTGTAFQQLSSFIHQPADQYPVTIGTAIPLKASFFITYIMVDGWASIAAEVLMLKPLIVYHLKNFFLVKTEKDREEAMDPGSIGFNTGEPRIQLYFLLGLVYAAVTPAVLPFITVFFGLAYLVFRHQIINVYNQEYESGAAFWPDVHFRIVMALIVSQIVLMGLLTTKKAASSTPFLIVLPILTIWFHRYCKGRFESAFVKFPLQEAMMKDTLERATEPNLNLKGYLQNAYVHPVFKDSMDDDDDEEDRLSIDLETESVTVRTKRQSRRNTPLPSKNNDASSPSLSDGIGNHPEP

SEQ ID NO: 3440 - protein, 764 aa, Cajanus cajan
MTTLSDIGVAAAINISSALLFFLAFAILRLQPWNDRVYFPKWYLKGLRTDPVHGRAFASKFINLDWRAYCGFFNWMPEALRMPEPELIDHAGLDSVVYLRIYLIGLKIFVPIAFLAWTVLVPVNWTSSGLEGAQIKNITSSDIDKLSVSNVHSRSERFWGHIIMAYAFTFWTCYVLLKDYEKVASMRLGFLAAERRRPDQFTVLVRNIPPDPDESVSDLVEHFFLVNHPGHYLTHQVVYDANKLAKFVKKKKKLTNWLVYYQNKLERTSKRPEIKTGFLGLWGKKVDAIDYHITEIDKLSNEIVVEREKVINDPKSIMPAAFVSFKSRWAAAVCAQTQQSRNPTLWLTEWAPEPRDVYWRNLPIPYVSLTVRRLIIAVAFFFLTFFFMIPIAFVQTLASLDGIQKAAPWLKPLVKIPFIKSFIQGFLPGIVLKLFLIFLPTILMIMSKFEGFESISSLERRSASRHYLFNFVNIFLGNILTGTAFQQLSSFIHQPANQYPVTIGTAIPLKASFFITYIMVDGWASIAAEVLMLKPLIFYHLKNFFLVKTEKDREEAMDPGSIGFNTGEPRIQLYFLLGLVYAAVTPAVLPFIIVFFGLAYVVFRHQIINVYNQEYESGAAFWPDVHFRIVLALIVSQIVLMGLLTTKKAASSTPFLIVLPILTIWFHRYCKGRFEPAFVKFPLQEAMMKDTLERATEPNLNLKGYLQNAYVHPVFKDSMDVDDDDEEILSMDLETESATVRTKRQSRRNTPLPSKNNDASSLSV

SEQ ID NO: 3441 - protein, 773 aa, Phaseolus coccineus
MTTLSDIGVAAAINISSALLFFLAFAILRLQPWNDRVYFPKWYLKGLRTDPIQGRAFVSKFINLDWRSYLGFLNWMPEAIRMPEPELIDHAGLDSVVYLRIYLIGLKIFVPIAFLAWTVLVPVNWTSTGLEGSQIRNITSSDIDKLSVSNVHSRSERFWGHIVMAYAFTFWTCYILLKEYGKVASMRLSFLAAQKRRPDQFTVLVRNIPSDPDESVGELVEHFFLVNHPDHYLTHQVVYDANRLAKLVNKKKKLKNWLVYYQNKLERTSKRPEIKTGFLGLWGRKVDAIDHYTDEIDKLSKEIVVEREKVINDPNSIMPVAFVSFKTRWGAAVCAQTQQTRDPTLWLTEWAPEPRDVYWRNLPIPYVSLTVRRLIIAVAFFFLTFFFMIPIAFVQTLASIEGIQKAAPWLKPFVSMSFVKSFIQGFLPGIVLKLFLIFLPTILMIMSKFEGFESISSLERRSASRYYLFNFVNIFLGNILTGSAFQQLSSFIHQPANQYPVTIGTAIPLKASFFITYIMVDGWASIAAEVLMLKPLIFYHLKNFFLVKTEKDREEAMDPGSIGFNTGEPRIQLYFLLGLVYAAVTPAVLPFIIVFFGLAYLVFRHQIINVYNQEYESGAAFWPDVHFRIILALIVSQIVLMGLLTTKKAASSTPFLIVLPILTIWFHRYCKGRFESAFVKFPLQEAMMKDTLERAIEPNLNLKGYLQNAYVHPIFKDSMEEETDEEEILGMEFETESAIVRTKRQSRKNTPLPSTNNASSLSFSDGTQTHLEP

SEQ ID NO: 3442 - protein, 344 aa, Glycine max
MAGESGGSATNLNFDLPEEVVQVLPSDPFQQLDVARKITSIALSTRVNTLESDLSSLRAQIADKDNLIADLQSQLDSLDASLSQIAATLFQTEQDKESLLQENASLSDTVKKLNRDVSKLEVFRKTLMQSLQEDDDNSGGTPDTVAKIQSQASLTSTSQIGDNEASLPPAISSSTGNSFADDQESDAIRPRVSQNLLLASQGSTPRITPPGSPPILSASVSPTRTSKPVSPRRHSISFSTTRGMHDDRSSVFSSMSLTHGSISSSDAGTGSQTGRTRVDGKEFFRQVRNRLSYEQFGAFLANVKELNSHKQTKEETLRKADKIFGPENKDLYTIFEGLINRNVH

SEQ ID NO: 3443 - protein, 341 aa, Phaseolus coccineus
MAAESGGSANFDLPEEMMQVLPSDPFHQLDVARKITSIALSTRVNALESELSTLLTQIADKDNLIADLQIQLDSLDASLSETADKLLLAEQDKESLLKENASLSNTVKKLNRDVSKLEVFRKTLMQSLQEEDDNSGGAPDIVAKIQNQSNLTSTSQFRDNDASLAPSISSSTGNSLVEEPEPDAPRPRVPQNLLLASQGSTPRITPPGSPPSLSASVSPTRTSKPVSPRRHSVSFSTTRGMYDDRSSVFSSMSLTQGSISTSDAGTGSQTGRTRVDGKEFFRQVRNRLSYEQFGAFLGNVKELNSHKQTKEETLRKADEIFGPENNDLYNIFEGLINRNVH

SEQ ID NO: 3444 - protein, 342 aa, Vigna unguiculata
MAAESGGSANFDLPEEMMQVLPSDPFHQLDVARKITSIALSTRVNALESELSTLRTQIADKDNLIADLQSQIDSLDASLSETADKLLLAEQDKESLLQENASLSNTVKKLNRDVSKLEVFRKTLMQSLQEEDDNSGGAPDIVAKIQNQSNFTSTSQFGDNDAPLAPSISSSTGNSLVEEPESDAAPRPRVPQNLLLASQGSTPRITPPGSPPSLSASVSPTRTSKPVSPRRHSVSFSTTRGMFDDRSSVFSSTSLTQASISTSDAGTGSQTGRTRVDGKEFFRQVRNRLSYEQFGAFLANVKELNAHKQTKEETLRKADEIFGPENNDLYNVFEGLINRNVH

SEQ ID NO: 3445 - protein, 334 aa, Cajanus cajan
MAAESGGSTNFDLPEEVVQVLPSDPFQQLDVARKITSIALSTRVNALESDLSTLRAQISEKDDLIADLQSQLHSLHASLSETADKLLRAQQDKESLLKENDSLSNTVKKLNRDVSKLEVFRKTLMQSLKEDDDNSGGTADIVAKIQSQSSLTSTSQFGDNDASLPPSISSSTGNYFAEDQESDAIRPRVPQNLILASQTSTPRITPPGSPPSLSASVSPTRTSKPVSPRRHSISFSTTRGMYDDRSSVFASISTNDPGTGSQTGRTRVDGKEFFRQVRNRLSYEQFGAFLANVKELNSHNQTKEETLRKADEIFGPENKDLYTIFEGLINRNVH

SEQ ID NO: 3446 - protein, 339 aa, Lotus japonicus
MAAESGDLNFDLPDDLVQVLPSDPFEQLDLARKITSIALSARVNALESESSELRARIAEKDHLIAELQSQLDSLDATLSATADNLHRAEQDKESLINENASLSNTVRKLNRDVSKLEVFRKTLMRSLQEEDDNSGGAPDMVAKVQSQSSLTSTSQFGDNEASLPPSVSSSVPSISDTGNSFAEDHESDAIRPRVPYSLLLASQSTTPRLTPPGSPPSLSASVSPTRTSKPVSPRRHSISFATSRGMHDDRTSVFSSMSSSDSGAGSQTGRTRVDGKEFFRQVRNRLSYEQFGAFLANVKELNSHKQTREVTLQKADEIFGPENKDLYNIFEGLITRNVH

SEQ ID NO: 3447 - protein, 183 aa, Glycine max
MEESVLTKRPREEEPLENKDSTYELLESLSKRHRSYNHILSLLESEEDDSTQDLSSLITSLQQEITNCASDSDTLLNQHSLTNTTTTTTTNSNLEDCSSSTTKYSSDMMEEHDDKEGVMRHLLEASDDELGIPNKEDESLDLGEDGFKFNGGDMFSSICDGLLWELEDEAANYYDLLQSQLFL

SEQ ID NO: 3448 - protein, 368 aa, Solanum tuberosum
MAGEFSSLFHKIKPYLAMVSLQFGYAGMYIVTMMCFKRGMSHWILVVYRHAFATIAVAPFAIVLERKIRPKMTLRIFIKIVALGFLEPVIDQNLYYLGLKSTTATYASAFVNLLPAVTFILAVIFRIEKVNLKKKSSMAKVIGTAITVVGAMVMTLYKGPMFNLVPRHGGAHHEASTATPENWVAGTIELIACIVGWSGFFIVQSMTLKEYPAELSLAAWVCVMGVVEGGIVALIMERDWNAWVIGFDSRLLAAAYSGIVCSGIAYYVQSVVNKVKGPVFVTAFSPLSMVITSVLAAIILAESVHLGSLIGAVIIVVGLYSVVWGKSKEGKGNQITSKDQELPVVDIKERSTIVDDIIEKKTPIFQEH

SEQ ID NO: 3449 - protein, 368 aa, Solanum phureja
MAGEFSSLFHKIKPYLAMVSLQFGYAGMYIVTMMCFKRGMSHWILVVYRHAFATIAVAPFAIVLERKIRPKMTLRIFIKIVALGFLEPVIDQNLYYLGLKSTTATYSSAFVNLLPAVTFILAVIFRIEKVNLKKKSSMAKVIGTAVTVVGAMVMTLYKGPMFNLVPRHGGAHHEASTATPENWVAGTIELIACIVGWSGFFIVQSMTLKEYPAELSLAAWVCVMGVVEGGIVALIMERDWNAWVIGFDSRLLAAAYSGIVCSGIAYYVQSVVNKVKGPVFVTAFSPLSMVITSVLAAIILAESVHLGSLIGAIIIVMGLYSVVWGKSKEGKGNEITSKDQELPVVDIKERSTIVDDIIEKKTPIFQEN

SEQ ID NO: 3450 - protein, 370 aa, Capsicum annuum
MAGAFSSFLNKVKPYLAMVSLQFGYAGMYIVTMMCFKRGMSHWILVVYRHAFATIAVAPFAIVLERKIRPKMTVRVFIKIVALGFLEPVIDQNLYYLGLKSTTATYASAFVNLLPAVTFILAVIFRIEKVNLKKKSSMAKVIGTTITVAGAMVMTLYKGPMFNLVPHAHSGVHHEAAGATAENWVAGTIELISCIVGWSGFFIVQSMTLKEYPAELSLAAWVCVMGVVEGGIVALIMERDWNAWVIGFDSRLLAAAYSGIVCSGIAYYVQSVVNKVKGPVFVTAFSPLSMVITSVLAAIILAESVHLGSAIGAIIIVIGLYSVVWGKSKEGNGNEITGNDQELPVVDIKERSTIVDDNNTEKKASIFQEL

SEQ ID NO: 3451 - protein, 369 aa, Solanum melongena
MAGAFSSFLNKVKPYLAMVSLQFGYAGMYIVTMMCFKRGMSHWILVVYRHAFATIAVAPFAIVLERKIRPKMTLRVFIKILALGFLEPVIDQNLYYLGLKNTTATYASAFVNLLPAVTFVLAVIFRLEKVNLKKKSSMAKVIGTTITVAGAMVMTLYKGPMFNLVPHGHREVNHEAAAATAENWVAGTIQLIACIVGWSGFFIVQSMTLKEYPAELSLAAWVCVMGVVEGGIVALIMERDWNAWVIGFDSRLLAAAYSGIVCSGIAYYVQSVVNKVKGPVFVTAFSPLSMVITSVLAAIILAESVHLGSVIGAIIIVMGLYSVVWGKSKEGKGNEITSKDQELPVVDIKERSTIVDDNIEKKAPIFQEH

SEQ ID NO: 3452 - protein, 385 aa, Nicotiana tabacum
MADQMFCGAFGPFLNKVKPYLAMVSLQFGYAGMYIVTMMCFKRGMSHWILVVYRHAFATLAVAPFAIVLERKIRPKMTLRVFIKILALGFLEPVIDQNLYYVGLKSTTATYASAFVNLLPAVTFILAVIFRIEKVNLKKKSSMAKVIGTAITVAGAMVMTLYKGPMFNLVPHSRGGSHTAAAASTPENWVAGTIELISCIVGWSGFFIVQSMTLKEYPAELSLAAWVCVMGIVEGGIVALIMERDWNAWKIGFDARLLAAAYSGIVCSGIAYYVQSIVNKVKGPVFVTAFSPLSMVITSVLAAIILAESVHLGSCIGAVIIVMGLYSVVWGKSKEGKGNETGKDQELPVVDIKERSTIVDDISDDVTTVKSKVPAEKKASILQEL

SEQ ID NO: 3453 - protein, 385 aa, Nicotiana benthamiana
MADQMFCGAFGPFLNKVKPYLAMVSLQFGYAGMYIVTMMCFKRGMSHWILVVYRHAFATLAVAPFAIVLERKTRPKMTLRIFIKILALGFLEPVIDQNLYYVGLKSTTATYASAFVNLLPAVTFILAVILRIEKVNLKKKSSMAKVIGTAITVAGAMVMTLYKGPMFNLVPHSRGGSHTLVAAATPENWVAGTIELISCIVGWSGFFIVQSMTLKEYPAELSLAAWVCVMGIVEGGIVALIMERDWNAWKIGFDARLLAAAYSGIVCSGIAYYVQSIVNKVKGPVFVTAFSPLSMVITSVLAAVILAESVHLGSCIGAIIIVMGLYSVVWGKSKEGKGNETGKDQELPVVDIKERSTIVDDISDDVTTVKSKVPAEKKASILQEL

SEQ ID NO: 3454 - protein, 386 aa, Nicotiana benthamiana
  misc_feature (311)..(311): Xaa can be any naturally occurring amino acid
MADQMFCGAIGPFLNKVKPYLAMVSLQFGYAGMYIVTMMCFKKGMSHWILVVYRHAFATLAVAPFAIVLERKIRPKMTLRVFIKILALGFLEPVIDQNLYYVGLKSTTATYASAFVNLLPAVTFILAVIFRIEKVNLKKKSSMAKVIGTTITVAGAMVMTLYKGPMFNLVPHSRGGSHTAAAAATPENWVAGTIELISCIVGWSGFFIVQSMTLKEYPAELSLAAWVCVMGIVEGGIVALIIERDWNAWKIGFDARLLAAAYSGIVCSGIAYYVQSIVNKVKGPVFVTAFSPLSMVITSLLAAIILAESVXLGSCIGAIIIVMGLYFVVWGKSKEGKGNETGKDQELPVVDIKERSIIVDDISDDVTTVKSKVPADQKKASMLREL

SEQ ID NO: 3455 - protein, 179 aa, Solanum phureja
MSRHPTIKWAQRSDKLFITVELPDAKNVKLKLEPEGKFLFSATAGDDNVPYEVDLDLFDKINVDESKSSTTSRSIVYLVKKAEEKWWSRLIKQEGLRPVFLKVDWDKWVDEDEEDGKPEPDMDFGDMDFSKLNMGEGPSDFDADVPEDDDDSDTEEIEEEENSEPKAAVPLSTEPKVKA

SEQ ID NO: 3456 - protein, 59 aa, Solanum tuberosum
MDFGDMDFSKLNMGEDPSDFDADVTEGDDDDSDTEEVEEEENSEPKAVVPPSTEPEVKA

SEQ ID NO: 3457 - protein, 181 aa, Solanum melongena
MSRHPTVKWAQRSDKLFITVELPDAENVKVKLEPEGKFFFSATAGADHVPYEVDLDLFDKINVDESKSSHTSRHIVYLIKKAEEKWWSRLIKQERLRPVFLKVDWDKWVDEDEENAGPDMDFGDMDFSKLNMGEGPSDFDADVPEGDDDDSDTEEVEGEENSAHSEPKAAAPPSTEPEAKA

SEQ ID NO: 3458 - protein, 186 aa, Capsicum annuum
MSRHPTVKWAQRSDKLFITVELPDAKNVKLKLEPEGKFFFSATAGADNLPYEVDLDLFDKINVEESKSSSTSRSIVYLVKKAEDKWWSRLIKQEGLRPVFLKVDWDKWVDEDEEDGKPGPDMDFNDIDFSKFNMEEGPSDFDADVPEGDDDDDSDAEGVVEEEDSAHSEPKAAVPPSNEPEAKASI

SEQ ID NO: 3459 - protein, 353 aa, Nicotiana tabacum
MILSKKHIFLLFVSISLLLIPASAIRGFIEKPKANFDGYLRYVESPEYRNSEECPILESDLSVCDPNLIHIAMTLDSHYFRGSIAAVHSVLKHTSCPENIYFHFVTSKDFDFQQLTQTVMSIFPSLSFKVYSFDELRVKNLISSSIRQALDNPLNYARTYLAEIIEHCVERVIYLDSDVILVDDIQKLWSISLTGSRIIGAPEYCHANFRTYFNDNFWSDTKFSKVFQGKKPCYFNTGVMVMDLGKWRKGDYTEKIENWMEIQKKKRIYELGSLPPFMLVFGGEIEGIDHKWNQHGLGGDNLVNSCRTLHPGPVSLLHWSGKGKPWVRLDQGNPCPVDLLWAPYDLYRLSLHL

SEQ ID NO: 3460 - protein, 439 aa, Solanum lycopersicum
MGKETLSTTDTTGATFKLVGFNNFIRANPRSDFFSVKRFHHIEFWCGDATNTSRRFSWSLGMPITAKSDLSTGNSVHASYLLRSVSGELQFVFTAPYSPSISVPSTAGIPSFSTPTYRDFTAKHGLGVRAVALEVENAYLAFSASVARGAKPRFEPVTIDEHVAVAEVHLYGDVVLRFVSLVKDADTLIFLPGFEAMDETSSFKELDYGIHRLDHAVGNVPELGPVVDYIKAFTGFHEFAEFTAEDVGTAESGLNSVVLANNDETVLLPLNEPVYGTKRKSQIQTYLEHNEGAGVQHLALVTEDIFRTLREMWKRSGVGGFEFMPAPPPTYYKNLRSRAGDVLSDEQIQACEELGILVDRDDQGTLLQIFTKPVGDRPTIFIEIIQRIGCMLKDEKGQVYQKGGCGGFGKGNFSELFRSIEEYEKMLEAKHVNQVAAVE

SEQ ID NO: 3461 - protein, 62 aa, Petunia hybrida
RPTIFIEIIQRIGCMLKDEEGRVYQKGGCGGFGKGNFSELFRSIEEYEKMLEAKHVNQVAAA

SEQ ID NO: 3462 - protein, 439 aa, Solanum tuberosum
MGKETLSTTTTDETGATFKLGFNNFIRANPRSDFFSVKRFHHIEFWCGDATNTSRRFSWSLGMPITAKSDLSTGNSVHASYLLRSVSGELQFVFTAPYSPSISVPSTAGIPSFSTSTHRDFTAKHGLGVRAVALEVENAYLAFSASVSRGAKPRFEPVTIDEHVAVAEVHLYGDVVLRFVSFVKDEDSLIFLPGFEAMDETSSFKELDYGIRRLDHAVGNVPELGPVVDYIKEFTGFHEFAEFTAEDVGTAESGLNSVVLANNDETVLLPMNEPVYGTKRKSQIQTYLEHNEGAGVQHLALVTEDIFRTLREMRKRSGVGGFEFMPSPPPTYYKNLKSRAGDVLSDEQIQACEDLGILVDRDDQGTLLQIFTKPVGDRPTIFIEIIQRIGCMLKDENGQVYQKGGCGGFGKGNFSELFRSIEEYEKMLEAKHVNQVAAA

SEQ ID NO: 3463 - protein, 440 aa, Solanum phureja
MGKETLSTTTTDATGATFKLVGFNNFIRANPRSDFFSVKRFHHIEFWCGDATNTSRRFSWSLGMPITAKSDLSTGNSVHASYLLRSVSGELQFVFTAPYSPSISVPSTAGIPSFSTSTHRDFTAKHGLGVCAVALEVENAYLAFSASVSRGAKPRFEPVTIDEHVAVAEVHLYGDVVLRFVSFVKDADCLIFLPGFEAMDETSSFTELDYGIRRLDHAVGNVPELGPVVDYIKAFTGFHEFAEFTAEDVGTAESGLNSVVLANNDETVLLPMNEPVYGTKRKSQIQTYLEHNEGAGVQHLALVTEDIFRTLREMRKRSGVGGFEFMPSPPPTYYKNLKSRAGDVLSDEQIQACEDLGILVDRDDQGTLLQIFTKPVGDRPTIFIEIIQRIGCMLKDENGQVYQKGGCGGFGKGNFSELFRSIEEYEKMLEAKHVNQVAAA

SEQ ID NO: 3464 - protein, 697 aa, Solanum phureja
MSRPLHRGVSGGGRLSVNGPDFWDDSQMKDKIEKEDLERNRSPGDQTYSPTKFLCRILFPDNSPSKHNLGENGLLSDPFSPGTGRNRLKYALGLIRLSLVGIVLLALTGSFWWTISITSSSRGHIYHGYRQLQEQVVSDLKDIGQLSLGAANVKDIEYCPPESENFIPCFNVSENLDLGLSKGEEVDRHCGPGSRQNCLVLPPVNYKIPLRWPTGRDVIWHANVNITAQEVLSSGSMTKRLMMLEEEQISFRSDSAMFDSIEDYSHQIAEMIGLRNESNFVRAGVRTILDIGCGYGSFGAHLFSSQLLTMCVANYEASGSQVQLTLERGLPAMIGSFNSKQLPYPSLSFDMIHCAECHVDWDQKDGIFLVEVDRLLRPGGYFVWTSTVTNTQRSVRNKVSLKKWNFVRNFAESMCWELLPQQDETVVWKKTSLKKCYFARRPGVGPSICSKGQDIESPYYRPLQACIAGTQSRRWIPIEERTKWPSRAKLNSSELKIHGLLAEALAEDSLNWNSAVNNYWSLLSPLIFSDHPKRPGDDDPSPPYNMLRNVLDMNAHFGGLNAALLDARKSVWVMNVIPTSGPNYLPLIIDRGFVGVLHDWCEAFPTYPRTYDLVHANGLLSMEFGQHSRCPMFDLFIEMDRVLRPEGWVILRDTVPLIELARSHAARLKWDARVIEVESSDEKLLICQKPFSRRQAS

SEQ ID NO: 3465 - protein, 697 aa, Capsicum annuum
MSRPLHRGVSVGGRLSVNGPDFWDDSQMKDKVEKEDLERNRSPGDQTYLSTKFLCRVLFPDNSPSKHSLGENGLISDPFSPGAGRNRLKYALLLIRLSLVFIIILALTGSFWWTISITSSSRGQIYHGYRKLQEQVVSDLRDIGQLSLGAANVKDVEYCPPESENFIPCFNVSENLDLGLSKGEEVDRYCGPGSRQNCLVLPPVNYKIPLRWPTGRDVIWHANVNITAQEVLSSGSLTKRLMMLEEEQISFRSDSAMFDSIEDYSHQIAEMIGLRNESNFVQAGVRTILDIGCGYGSFGAHLFSSQLLTMCVANYEASGSQVQLTLERGLPAMIGSFNSKQLPYPSLSFDMIHCAECHVDWDQKDGILLVEVDRLLRPGGYFVWTSTVTNTQRSVRNKVSLKKWNFVRNFAESMCWKLSAQQDATVVWKKTSLKKCYVARRPGVGPSLCSKGQDIESPYYRPLQACIAGTQCRRWIPIEERTKWPSRAKLNSSELKIHGLSSEALAEDSLNWNSAVNNYWSLLSPLIFSDHPKRPGDDDPSPPYNMLRNVLDMNAHFGGLNAALLDARKSVWVMNVIPTSGPNYLPLILDRGFVGVLHDWCEAFPTYPRTYDLIHANGLLSLEFGQHSRCPMFDLFIEMDRVLRPEGWVIIRDTVPLIELARAHAARLKWDARVVEVESSDEKLLICQKPFSRRQAS

SEQ ID NO: 3466 - protein, 321 aa, Solanum phureja
MLMIQSTISPPLQKSVLVPAKTATSWSKHGCFRFLDLNGGCGSKSASYHFPRRPIKGNSIQLKIYARKSESFPILLSEKVDELPEKLLNGGDITISSGQVLSLSAISCGSIFWLTSGQVASASEGVRVNMVYEVGELFELGIQLTYLLLLLALLGVGSFFVIRQVLVRRELDLSAKELQEQVRSGDASATELFELGAVMLRRKFYPAATKFLLQAVEKWDGDDQDLAQVYNALGVSYVLDGKIDKGIAQFENAVKVQPGYVTAWNNLGDAYEKTKDLTSALNAFEEVLLFDPNNKIARPRRDALKDKVTMYKGVSVKSKKS

SEQ ID NO: 3467 - protein, 318 aa, Capsicum annuum
MLMIQSTISPPVQKAVLVPAKIAVSGKHACYLALNCGFGSQSAYFPFPRRPIKRNSIQLQMLARKTDSFPLLFSEKVDESPEKLLNGGDITISIGQVLSLSAFSCGSIFWLTSGQVASASEGFRVNMIFEVGELFELGIQLTYLLLLLSLLGVGSFFVIRQVLVRRELDLSAKELQEQVRSGDASATELFELGAVMLRRKFYPAAIKYLLQAVEKWDGDDQDLAQVYNALGVSYVLDGKIDKGIAQFENAVKVQPGYVTAWNNLGDAYEKTKDLTSALKAFEEVLLFDPNNKIARPRRDALKDKVTMYKGVSVKSKKS

SEQ ID NO: 3468 - protein, 286 aa, Solanum tuberosum
MLMIQSTISPPLQKSVLVPAKIATSGSKHGCFLDLNGGCGSKSASYHFPRRPIKGNSIQLKIYARKSESFPILLSEKVDELPEKLLNGGDITISSGQVLSLSAISCGSIFWLTSGQVASASEGVRVNMVYEVGELFELGIQLTYLLLLLALLGVGSFFVIRQVLVRRELDLSAKELQEQVRSGDASATELFELGAVMLRRKFYPAATKFLLQAVEKWDGDDQDLAQVYNGLGVSYVLDGKIDKGIAQFENAVKVQPGYVTAWNNLGDAYEKTKELTSALNAFEEVL

SEQ ID NO: 3469 - protein, 192 aa, Nicotiana tabacum
  misc_feature (180)..(180): Xaa can be any naturally occurring amino acid
MVYEVGELFELGIQLTYLLILLALLGAGSFFVIRQVLVRRELDLSAKELQEQVRSGDASATELFELGAVMLRRKFYPAATKYLLQAVQKWDGDDQDLAQVYNALGVSYVLDEKIDKGIAQFENAVKLQPGYVTAWNNLGDAYEKTKDLTSALRAFEEVLLFDPNNKIARPRRDALKDKVXMYKGVPVKSKKS

SEQ ID NO: 3470 - protein, 307 aa, Petunia hybrida
MVMIHSTISLPPLQKTLLLPSGFLALHGRFGSSLASSHFPRRPIINRNSIQIFARKLESFSHFVPEKVDELSEKLLNGGDITISRGQVLSLSAFSCGSICWLTSGQVASASEGVRVNMVYEVGELFELGIQLTYLLLLLALLGVGSFYVIRQVLVRRELDLSAKELQEQVRSGDASATELFELGAVMLRRKFYPAAIKYLLQAVEKWDGDDQDLAQVYNALGVSYVLEGKMTKECSVENAVKLQPGYVTAWNNLVTYEKTKELTSALKAFEEVLLFDPNNKIARPRRDALKDKVKMYKGVAVKSKKS

SEQ ID NO: 3471 - protein, 1021 aa, Solanum phureja
MEEENKQSPLIPPLPRDPRGSLEVFNPSTYSSRSTNPVFRSQSSWKNWTGGESITGSTIPEIEEKPEQIAIPKSSNENEEIVTSWMAIAPASAKLTSPITQKSITGGEKVNSKAAVDEVGAAAQRAAEWGLVLKTDDETGKLQGVKVRTSGDDANGKTETSRRDSGNSGRSSGEFSDDGAGKERGIPRVSEDLRDALSTFQQTFVVSDATKPDYPILYASAGFFKMTGYTSKEVIGRNCRFMQGSGTDPEDVAKIREALQTGSTYCGRLLNYKKDGTPFWNLLTIAPIKDDAGKVLKFIGMQVEVSKHTEGSKEKTVRPNGLPESLIRYDVRQKEMANNSVNELLKEIKHPRRARALSESTNNRPTFMRKSEGDQVEQDKQDVGITTHKLNLVNKAPARRHSHAGTRTTAMKMEKINEDPEKKPKKSARLSFMGIMKKKRSSTTMTTDDDDFEARMTMDNDDDDDDESDNDGRPVSVDDKVRKKEMRKGIDLATTLERIEKNFVITDPRLPDNPIIFASDSFLELTEYSREEILGRNCRFLQGPETDPATVKKIRQAIDNQTDVTVQLINYTKTGKKFWNLFHLQPMRDQKGEVQYFIGVQLDGSQHVEPLHNSIPEDKATESAKLIKETAGNVDEAVRELPDANSKPEDLWRNHSKVVQPKPHRKDSPSWKAIQKIMESGEPISLKHFKPIKPLGSGDTGSVHLVELCGTDQHFAMKAMDKSIMLNRNKVHRACAEREILDMLDHPFLPALYASFQTKTHICLITDYYPGGELFMLLDRQQTKVLKEDAARFYAAEVVIALEYLHCQGIIYRDLKPENVLLQSGGHVSLTDFDLSCLTSCKPQLLVPEINEKKKHQKGQQNPIFMAEPMRASNSFVGTEEYIAPEIITGAGHTSAVDWWALGILLFEMLYGYTPFRGKTRQKTFSNILHKDLKFPGSIQSSLHAKQLMYRLLHRDPKNRLGSREGANEIKQHPFFRGVNWALIRCMNPPKLDSAPFLGTEAEKEGNDINPEMEDLQTNVF

SEQ ID NO: 3472 - protein, 385 aa, Solanum phureja
MGYFGFDFSSFQSITAFCLLLMLGFSFSPIGCLGIRSFPEERRFTEAPEYRNGVQCPVTAETQNMVHVAMTLDSEYLRGSMAAIHSVLRHSSCPEHIFFHFIAAEFDPSSPRVLTQLVRSIFPSLNFKVYIFREDTVLNLISSSIRHALENPLNYARNYLGDMLDPSVTRVIYLDSDIILVDDIEKLWKTPLSGSRIIGAPEYCHANFTKYFTDSFWSDPDLPRVFGSRNPCYFNTGVMVMDLQKWREGDYRKKIEKWMELQRQRRIYELGSLPPFLLVFGGLVEPINHRWNQHGLGGDNVMGSCRSLHPGPVSLLHWSGKGKPWARLDEKRPCPLDYLWEPYDLYKPKPKSRPNYQRSKMRLYQHHNLDYSSSNILFGYSNYFI

SEQ ID NO: 3473 - protein, 354 aa, Solanum tuberosum
MKMGCLGFDFSNFQSITAFCLLLMLGFSFSPIGCLGIRSFPEERRFTEAPEYRNGVQCPVTAETQNMVHVAMTLDSEYLRGSMAAIHSVLRHSSCPEHIFFHFIAAEFDPSSPRVLTQLVRSIFPSLNFKVYIFREDTVLNLISSSIRHALENPLNYARNYLGDMLDPSVTRVIYLDSDIILVDDIEKLWKTPLSGSRIIGAPEYCHANFTKYFTDSFWSDPDLPRVFGSRNPCYFNTGVMVMDLQKWREGDYRKKIEKWMELQRQRRIYELGSLPPFLLVFGGLVEPINHRWNQHGLGGDNVMGSCRSLHPGPVSLLHWSGKGKHGPGLMKKGLVHWIIFGSPMICISPSPNQ

SEQ ID NO: 3474 - protein, 374 aa, Nicotiana benthamiana
MGRFGFFDIKVVCFLLALSFSRCYGIRSFPEERRFAEAPEYRNGVECPATAEGKTLSSCYPSLVHVAMTLDSEYLRGSMAAVHSVLRHASCPEHVFFHFIAAEFDATSPRVLTQLVRSIFPSLNFKVYIFREDTVLNLISSSIRQALENPLNYARNYLGDMLDPCVTRVIYLDSDVVLVDDIQKLWKVNLTGSRIIGAPEYCHANFTIYFTDTFWSDPVLPRVFGSRNPCYFNTGVMVMDLKKWREGNYRQKIERWMELQRQKRIYELGSLPPFLLVFGGLVEPINHRWNQHGLGGDNVKGSCRSLHPGPVSLLHWSGKGKPWVRLDEKRPCPLDYLWEPYDLYKHRSKVRVIHHLNLGYSTSTNPFGYSNYFI

SEQ ID NO: 3475 - protein, 374 aa, Nicotiana benthamiana
MGRFGFFDITVVCFLLALSFSRCYGIRSFPEERRFAEAPEYRNGVGCPATAEGKTLSSCDPSLVHVAMTLDSEYLRGSMAAVHSVLRHASCPEHVFFHFIAAEFDATSPRVLTQLVRSIFPSLNFKVYIFREDTVLNLISSSIRQALENPLNYARNYLGDMLDPCVTRVIYLDSDVVLVDDIQKLWEVNLTGSRIIGAPEYCHANFTIYFTDSFWSDPVLPQVFGSRNPCYFNTGVMVMDLKKWREGNYRQKIERWMELQRQKRIYELGSLPPFLLVFGGLVEPIDHRWNQHGLGGDNVKGSCRSLHPGPVSLLHWSGKGKPWVRLDEKRPCPLDYLWEPYDLYKHRSKVRVNHHLNLGFSTSTNPFGYSNYFI

SEQ ID NO: 3476 - protein, 337 aa, Solanum phureja
MSVEERPSTLVVDPLLKDLSEKKQNFRRNVVSLAAELKEVRSRLAYQEQSFVRETLTRQDAESKAKKMEEEINKLQKNLEEKNGELQFSALNTEKYVKQLDDLKSQLSATQATADASAASAESAQLQCLVLLKELDEKNSSLKEHEVRVNKLGEQLDLLQKDLQARESSQRQLKDEVVRIEHDIMQALAKSGANTDCELRKVLDEVSPKNIEKMNKLLTNKDEELAKLRDEIRIMSAHWKLKTKELESQLEKHRRADQELKKRIMKLEFCLQETRTQTRKLQRMGERRDKAIKELRDQLSTKQVGTSNNNNQNFWDTSGFKVVVSMSMLMLVLFSKR

SEQ ID NO: 3477 - protein, 357 aa, Amsonia hubrichtii
MSSSLTERPSSSSSTSSTVSLSSLTAGREKDIDPLLKDLSEKKQSFRRNVVSLAAELKEVRNRLSSQEQSFARETLTRQEAETKARKMEEEINRLQRNLEERNSQLQASASTTHKYIKELDDLRSQLSATQATADASAASAQSAQLQCLALLKELDEKNSSLKEHETRVNKMGEQLDLLQKDLQAREFSQKQLKDEVLRVEHDIMQALAKAGADQDCELRKILAEVSPKNCEKMNKLLTAKDEEIAKLRDEIRIMSAHWKLKTKELESQLEKHRRADQELKKRVLKLEFCLQEARAQTRKLQRMGERRDKALKELRDQLATKQGAPANIEKQNFWETSGFKIVVSMSMLILVLFSKR

SEQ ID NO: 3478 - protein, 607 aa, Solanum phureja
MGIESEVPESGGGIRRRNCVCTKDDFLPEESFKSWGNYANALRQTPTRLIERALTRSSDEAELEAKSRSHHEMKKTLTWWDLIWFGMGAVIGAGIFVLTGLEASQDAGPAVVLSYAVSGVSALLSVFCYTEFAVEIPVAGGSFAYLRVELGDFVAFIAAGNILLEYVIGGAAVARSWTSYFATLLNFKSDKFLITAHGLAKGYNQLDPIAVAVCFIICIIAIRSTKGSSRLNYVASIIHIVVIVFIIICGLIKADTKNYTPFTPFGARGIFKASAVLFFAYVGFDAVSTMAEETKDPARDIPIGLVGSMVITTTVYCLLAITLCLMQPYQSIDPHAPFSVAFKAVGWSWAQYIVAAGALKGMTSVLLVGAVGQARYLTHIARTHMMPPWFSYVDEKTGTPVNATAVMMSATAIIAFFTKLEILSNLLSISTLFIFMLVALALLVRRYYVSGVTTDANRNKLIICLLLILGSSIATAAYWGLSEKGWIAYCFTLPIWFSATAGICIFIPQARNPKLWGVPLVPWLPSLSIAINIFLLGSIDKDSFIRFAGWTGFLLAYYFFFGLHASYDTAKEFEKSKGWKNNIEEGNGTSNVVVSKDVPIAPVASGN

SEQ ID NO: 3479 - protein, 694 aa, Solanum phureja
MAPRLNFSDWWGKDKQRGTPVIVKMENPNFSIVEIDGPDAAFKPIEKSRGKNAKQVTWVLLLKANQAVGCVAWLATILWSLIGTIKNRLILRKGVSLASEKLGKSNLLFRIIKVCLGVSLVMLAFEVIAYFKGWHYFQNPNLYVPHTSDVLGLFHIIYVVWLDFRADYIAPSVQKLSTFCTVLFLIQSLDRLVLCLGCFYIKCKKIKPRIEGDPFKSDDLEGSNNSYYPMVLVQIPMCNEKEVYEMSISAVCQLDWPKDRLLIQILDDSDNECIQDLIKSEVAKWNHKGVNIIYRHRLVRTGYKAGNLKSAMSCDYVKDYEFVAIFDADFQPTPDFLKQTVPHFKDNPELGLVQTRWAFVNKDENLLTRLQNINLCFHFEVEQQVNGVFLNFFGFNGTAGIWRIKALEESGGWLERTTVEDMDIAVRAHLNGWKFIYLNDVRVLCEVPESFEAYRKQQHRWHSGPMQLFRVCLPAIVSSKISIWKKANLILLFFLLRKLILPFYSFTLFCVVLPLTMFIPEAELPFWVVCYIPILMTLLNILPAPKSIPFIAPYLLFENTMSVTKFNAMVSGLFQLGSSYEWVVTKKAGRSSESDLLAAAEKDLKAFGAPQISRGASESELSELNRLNKQKDETSTPVKKSNKIYRKELALAFLLLTASARSLLSAHGLHFYFLLFQGVTFLLVGLDLIGEQIS

SEQ ID NO: 3480 - protein, 693 aa, Theobroma cacao
MAPRLDFSNWWAKDTRKGTPVVVKMENPNYSVVEIDGPDAAFRPVEKSRGKNAKQVTWVLLLKAHRAVGCVAWIATLFWALLGTIKRRLIFRQDVALASEKLGKGKLLFTVIKVFLATSLTILAFEVAAYFKGWHYFQNPGLHIPRTSDIQGLLHLVYVTWLSFRAEYIAPLIQALSKFCVALFLIQSADRMILCLGCFWIKYKKIKPRIVGDPFKSDDVEGSGYEYPMVLVQIPMCNEREVYEQSISAVCQLDWPKDRLLIQVLDDSDDKSTQCLIKAEVATWNQRGINIIYRHRLVRTGYKAGNLKSAMSCEYVQAYEFVAIFDADFQPNPDFLKQTVPHFKDNPELGLVQARWAFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSGPMHLFRLCLPAIITSKIPIWKKANLILLFFLLRKLILPFYSFTLFCIILPLTMFVPEAELPVWVICYVPVFMSFLNILPAPKSFPFIAPYLLFENTMSVTKFNAMVSGLFQLGSSYEWVVTKKAGRSSESDLLAAVERESKTTNQLQIQRGASESELTELNRLKEQKEVAPTPVKRVNKIYRKELTLAFLLLTASIRSLLAAQGVHFYFLLFQGVTFLLVGLDLIGEQMS

SEQ ID NO: 3481 - protein, 693 aa, Manihot esculenta
MAPRLDFSERWTKDSKKGTPVVVKMENPNYSIVEINGPDAAFQPVEKSRGKNAKQVRWVLLLKAHRAVGCVAWLATFFWSLLGAIKKRLIFRQGVTVASEKLGKGKLVLRVIRVFLVTSLAILAFEVVAYLKGWHYFDNANLHIPRTLDLQGLLHLVYVSWLTFRADYIAPPIQALSKFCVVLFLIQSADRLILSLGCFWIKYKKIKPRISGDPFKSDDAEAPGYEYPMVLVQIPMCNEREVYEQSISAVCQLDWPKDRLLIQVLDDSDEENTQRLINAEVSKWSQKGINIIYRHRVVRTGYKAGNLKSAMSCDYVKDYEFVAIFDADFQPNPDFLKLTVPHFNGNPELGLVQARWAFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSGPMQLFRLCLPAIITSKIAIWKKANLILLFFLLRKLILPFYSFTLFCIILPLTMFVPEAELPMWVICYVPVLMSFLNILPAPKSFPFIVPYLLFENTMSVTKFNAMVSGLFQLGSSYEWVVTKKSGRSSESDLLAAAEKDLKATNQPQMQRVVSESELGELNRLKEQKESASKPVKKVNKIYRKELALAFLLLTAAVRSLLSAQGVHFYFLLFQGVTFLLVGLDLIGEQMS

SEQ ID NO: 3482 - protein, 693 aa, Populus trichocarpa
MAPRLDFSDWWGKDSKEGTPVVVKMENPNYSVVEINGPDSAFRPVEKSRGKNAKQVTWVLLLKAHRAVGCVAWLATVFWALLGTIKKRLIFRQGVAVATEKLGKGKMVLKIIRVFLVASLAILAFEVVAYLKGWRYFESANLHIPRTLDLQGWLHVVYVAWLTFRADYIAPLIQALSQFCVVLFLIQSVDRLILCLGCFWIKYKKIKPRIEVDPFKSDDVEASGYEYPMVLVQIPMCNEREVYEQSISAVCQMDWPKDRILIQVLDDSNDESIQWLIKAEVAKWNQKGVNIIYRHRLIRTGYKAGNLKSAMGCDYVKDYEFVTIFDADFQPNPDFLKLTVPHFKGNPELGLVQARWAFVNKDENLLTRLQNINLCFHFEVEQQVNGTFLNFFGFNGTAGVWRIKALEESGGWLERTTVEDMDIAVRAHLNGWKFIFLNDVKVLCEVPESYEAYRKQQHRWHSGPMQLFRLCLPAIITSKMAFWKKANLIFLFFLLRKLILPFYSFTLFCIILPLTMFVPEAELPMWVICYVPVLMSFLNILPTPKSIPFIVPYLLFENTMSVTKFNAMVSGLFQLGSSYEWVVTKKAGRSSESDLLAAAERDSKTMNQAQICRGASETELELLNQLKEQKEANPTPVKKVNKIYRKELALAFLLLTASVRSLLSAQGVHFYFLLFQGVTFLVVGLDLIGEQIS

SEQ ID NO: 3483 - protein, 694 aa, Eucalyptus grandis
MAPRLDFSDWWAKENRKGTPVVVKMENPSYSVVEIDGPDAAFRPVEKSRGKNAKQVTWVLLLKANRAVGCVAWLATVLWALLGTIKKRLIFRQGVAMESDKMGKGRLLFRVIRAFLVTSLVILGFEVVTYFKGWHYFERPNLHIPRTTDVHGLLHTIYVAWLTFRADYIAPPIQALSKFCVALFLIQSVDRMILCLGCLWIKYKKVKPRIERDPFKSDDAEGIGCEYPMVLVQIPMCNEREVYEQSISAVCQIDWPKDRLLIQVLDDSDNESIQCLINAEVAKWSQRGINIIYRHRLVRTGYKAGNLKSAMSCDYVKGYEFVAIFDADFQPTPDFLKQTVPHFKDNPELGLVQARWAFVNKDENLLTRLQNINLCFHFEVEQQVNGVFLNFFGFNGTAGVWRIKALEESGGWLERTTVEDMDIAVRAHLNGWKFIFLDDVKVLCELPESYEAYKKQQHRWHSGPMQLFRLCLPAIVTSKISAWKKANLILLFFLLRKLILPFYSFTLFCIILPLTMFVPEAELPMWVICYVPVFMSFLNIFPAPKSFPFIVPYLLFENTMSVTKFNAMISGLFQLGSSYEWVVTKKAGRSSESDLLAAAERETKSTNQQQLTRGSSESELQELTKLKEQQNEVTITPVKKTNKIYRKELVLAFLLLTAAVRSLLAAQGVHFYFLLFQGVTFLLVGLDLIGEQMS

SEQ ID NO: 3484 - protein, 694 aa, Vitis vinifera
MAPRLDFSDLWGKDTRKGTPVVVTMENPNYSVVEIDGPDSAFRPVEKSRGKNAKQVTWVLLLKAHRAVGCVAWLATVLWALLGTIKKRLIFRQGVAMESEKTGKGKLLFRIIKVFLVTSLAILSFEVVAYLKGWHYFRNPNLHIPRTSDFQGLLHMVYVAWLTLRADYIAPLIQALSKFCVALFLIQSADRMVLCLGCLWIKYKKIKPRIDGDPFKLEDVEGSGYEYPMVLVQIPMCNEREVYEQSISAVCQIDWPKDRLLIQVLDDSDDESIQCLIKAEVYNWSQQGINIVYRHRLVRTGYKAGNLKSAMSCDYVKNYEFVAIFDADFQPNPDFLKQTVPHFQGNPDLGLVQARWAFVNKDENLLTRLQNINLCFHFEVEQQVNGVFLNFFGFNGTAGVWRIKALEDSGGWLERTTVEDMDIAVRAHLNGWKFIFLNDVKVLCEVPESYEAYRKQQHRWHSGPMQLFRLCLPAVITSKISIWKKANMLLLFFLLRKLILPFYSFTLFCIILPLTMFVPEAELPVWVICYVPVFMSFLNILPAPKSFPFIVPYLLFENTMSVTKFNAMVSGLFQLGSSYEWIVTKKAGRASESDLLAAAERDSKTVNQPLIHRGASESELSELNRLKEQKESTPPAVKKINKIYRKELTLAFLLLTASVRSLLASQGVHFYFLLFQGVTFLLVGLDLIGEQMSQ

SEQ ID NO: 3485 - protein, 693 aa, Gossypium hirsutum
MAPSLDFSNWWPKDARKGTPVVVKMENPNYSVVEIDGPDAAFRPVEKSRGKNAKQVTWVLLLKAHRAVGCLAWIASFFWALLGTIKKRLIFRQDVAMASEKLGKGKLLFTVIKAFLVTSLTILAFEVVAYLKGWHYFRNPSLHIPRSTDIQGLLHLVYVTWLSVRADYIAPPIQALSKFCVALFLIQSVDRMILSLGCFWIKYKKIKPRIEGDPFKSDDVEGSAYEYPMVLVQIPMCNEREVYEQSISAVCQLDWPKDRLLVQVLDDSNDESIQYLIKAEVAKWNQKGVNIIYRHRLVRTGYKAGNLKSAMSCEYVQAYEFVAIFDADFQPNPDFLKQTVPHFKDNPDLGLVQARWTFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSGPMHLFRLCLPAIITSKIAIWKKANLILLFFLLRKLILPFYSFTLFCIILPLTMFVPEAELPVWVICYVPVFMSFLNILPSPKSFPFIVPYLLFENTMSVTKFNAMVSGLFQLGSSYEWVVTKKAGRSSESDLLASAERESKIMNQLQIQRGASESELSELNRLKEQKEAAPVPVKRVNKIYRKELTLAFLLLTASVRSLLSAQGVHFYFLLFQGVTFLLVGLDLIGEQMS

SEQ ID NO: 3486 - protein, 693 aa, Gossypium raimondii
MAPSLDFSNWWPKDARKGTPVVVKMENPNYSVVEIDGPDAAFRPVEKSRGKNAKQVTWVLLLKAHRAVGCLAWIASFFWALLGTIKKRLIFRQDVAMASEKLGKGKLLFTVIKAFLVTSLTILAFEVVAYLKGWHYFRNPSLHIPRSTDIQGLLHLVYVTWLSVRADYIAPPIQALSKFCVALFLIQSVDRMILSLGCFWIKYKKIKPRIEGDPFKSDDVEGSAYEYPMVLVQIPMCNEREVYEQSISAVCQLDWPKDRLLVQVLDDSDDESIQYLIKAEVAKWNQKGVNIIYRHRLVRTGYKAGNLKSAMSCEYVQAYEFVAIFDADFQPNPDFLKQTVPHFKDNPDLGLVQARWTFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSGPMHLFRLCLPAIITCKIAIWKKANLILLFFLLRKLILPFYSFTLFCIILPLTMFVPEAELPVWVICYVPVFMSFLNILPSPKSFPFIVPYLLFENTMSVTKFNAMVSGLFQLGSSYEWVVTKKAGRSSESDLLASAERESKIMNQLQIQRGASESELSELNRLKEQKEAAPVPVKRVNKIYRKELTLAFLLLTASVRSLLSAQGVHFYFLLFQGVTFLLVGLDLIGEQMS

SEQ ID NO: 3487 - protein, 693 aa, Ricinus communis
MAPRLDFSDWWAKDSKKGTPVVVKMENPNYSVVEINGPDAAFQPVEKSRGKNAKQVTWVLLLKAHRAVGCVAWIATFFWAFLGAIKKRLIYRQGVTVASEKLGKGKLVLRIIKMFLVTSLAILAFEVVAYFKGWHYFENANLHIPRTSDLQGLLHMVYVAWITCRADYIAPLIQLLSKFCVVLFLIQSLDRMILSLGCFWIKYKKIKPRIVGDPFKSDDAEAPGYQYPMVLVQMPMCNEREVYEQSISAVCQLDWPKDRLLVQVLDDSDDESIQCLIKAEVAMWSQKGINIIYRHRVVRTGYKAGNLKSAMNCDYVKDYEFVAIFDADFQPNPDFLKLTVPHFKDNPELGLVQARWSFVNKDENLLTRLQNINLCFHFEVEQQVNGIFLNFFGFNGTAGVWRIKALEESGGWLERTTVEDMDIAVRAHLNGWKFIFLNDVKVLCEVPESYEAYRKQQHRWHSGPMHLFRLCLPAILTAKMAIWKKANLILLFFLLRKLILPFYSFTLFCIILPLTMFVPEAELPIWVICYVPVFMSFLNILPAPKSFPFIVPYLLFENTMSVTKFNAMVSGLFQLGSSYEWIVTKKAGRSSESDLLAAAERDSKATNLSQIHRGVSESDLGELNRLKEQKEAAPKPVKKVNKIYRKELALAFLLLTAAVRSLLSAQGVHFYFLLFQGVTFLVVGLDLIGEQMN

SEQ ID NO: 3488 - protein, 693 aa, Gossypium hirsutum
MAPSLDFSNWWPKDARKGTPVVVKMENPNYSVVEIDGPDAAFRPVEKSRGKNAKQVTWVLLLKAHRAVGCLAWIASFFWALLGTIKKRLIFRQDVAMASEKLGKGKLLFTVIKAFLVTSLTILAFEVVAYLKGWHYFRNPSLHIPRSTDIQGLLHLVYVTWLSVRADYIAPPIQALSKFCVALFLIQSVDRMILSLGCFWIKYKKIKPRIEGDPFKSDDVEGSAYEYPMVLVQIPMCNEREVYEQSISAVCQLDWPKDRLLVQVLDDSNDESIQYLIKAEVAKWNQKGVNIIYRHRLVRTGYKAGNLKSAMSCEYVQAYEFVAIFDADFQPNPDFLKQTVPHFKDNPDLGLVQARWTFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSGPMHLFRLCLPAIITCKIAIWKKANLILLFFLLRKLILPFYSFTLFCIILPLTMFVPEAELPVWVICYVPVFMSFLNILPSPKSFPFIVPYLLFENTMSVTKFNAMVSGLFQLGSSYEWVVTKKAGRSSESDLLASAERESKIMNQLQIQRGASESELSELNRLKEQKEAAPVPVKRVNKIYRKELTLAFLLLTASVRSLLSAQGVHFYFLLFQGVTFLLVGLDLIGEQMS

SEQ ID NO: 3489 - protein, 116 aa, Gossypium hirsutum
MAPGLDFSDWGAKETRKGTPVVVKMENPNYSVVEIEDPDAAFRPVEKSRGKNAKQVTWVLLLKAHRAVGCVAWIATLFWALLGTIKKRLIFRHDVDMASEKLGKGNCSSLSLKPFW

SEQ ID NO: 3490 - protein, 521 aa, Gossypium hirsutum
MAPGLDFSDWGAMETRKGTPVVVKMDNPNYSVVEIEDPDAAFRPVEKSRGKNAKQVTWVLLLKAHRAVGCVAWMATLFWALLGTIKKRLIFRQDVGMASEKLGKGKLLFTVIKAFLVISLTILAFEIIAYFNGWHYFQNPSLHIPRTSDIQGLFHLVYVTWLWFRADYIAPLIQALSKFCVALFLIQSADRMVLCLGCFWIKYKKIKPRIEGNPFKSNDVEGSGYDYPMVLVQIPMCNEREVYEQSISAVCQLDWPKDRLLIQVLDDSDDESIQCLIKTEVATWNQRGINIIYRHRLIRTGYKAGNLKSAMSCEYIQAYEFVAIFDADFQPNPDFLKQTVPHFKDNPELGLVQARWTFVNKDENLLTRLQNINLCFHFEVEQQVNGVFLNFFGFNGTAGVWRIRALEESGGWLERTTVEDMDIAVRAHLNGWKFIFLNDVKVLCEVPESYEAYRKQQHRWHSGPMHLFRLCLPAIITSKIAIWKKANLILLFFLLRKLILPFLLLHIVLHNSSSHHVCTRG

SEQ ID NO: 3491 - protein, 693 aa, Gossypium hirsutum
MAPSLDFSNWWPKDARKGTPVVVKMENPNYSVVEIDGPDAAFRPVEKSRGKNAKQVTWVLLLKAHRAVGCLAWIASLFWALLGTIKKRLIFRQDVAMASEKLGKGKLLFTVIKAFLVTSLTILAFEVVAYLNGWHYFRNPSLHIPRSTDIQGLLHLVYVTWLSVRADYIAPPIQALSKFCVALFLIQSVDRMILSLGCFWIKYKKIKPRIEGDPFKSDDVEGSAYEYPMVLVQIPMCNEREVYEQSISAVCQLDWPKDRLLVQVLDDSDDESIQYLIKAEVAKWNQKGVNIIYRHRLVRTGYKAGNLKSAMSCEYVQAYEFVAIFDADFQPNPDFLKQTVPHFKDNPDLGLVQARWTFVNKDENLLTRLQNINLCFHFEVEQQVNGVFLNFFGFNGTAGVWRIKALEESGGWLERTTVEDMDIAVRAHLNGWKFIFLNDVKVLCEVPESYEAYRKQQHRWHSGPMHLFRLCLPAIITCKIAIWKKANLILLFFLLRKLILPFYSFTLFCIILPLTMFVPEAELPVWVICYVPVFMSFLNILPSPKSFPFIVPYLLFENTMSVTKFNAMVSGLFQLGSSYEWVVTKKAGRSSESDLLASAEMESKIMNQLQIQRGASESELTELNRLKEQKEAAPVPVKRVNKIYRKELTLAFLLLTASVRSLLSAQGVHFYFLLFQGVTFLLVGLDLIGEQMS

SEQ ID NO: 3492 - protein, 689 aa, Gossypium raimondii
MAPGLDFSDWGAMETRKGTPVVVKMDNPNYSVVEIEDPDAAFRPVEKSRGKNAKQVTWVLLLKAHRAVGCVAWIATLFWALLGTIKKRLIFRQDVGMASEKLGKGKLLFTVIKAFLVISLTILAFEIIAYFNGWHYFQNPSLHIPRTSDIQGLFHLVYVTWLWFRADYIAPLIQALSKFCVALFLIQSADRMVLCLGCFWIKYKKIKPRIEGNPFKSNDVEGSGYDYPMVLVQIPMCNEREVYEQSISAVCQLDWPKDRLLIQVLDDSDDESIQCLIKAEVATWNQRGINIIYRHRLIRTGYKAGNLKSAMSCEYIQAYEFVAIFDADFQPNPDFLKQTVPHFKDNPELGLVQARWTFVNKDENLLTRLQNINLCFHFEVEQQVNGVFLNFFGFNGTAGVWRIRALEESGGWLERTTVEDMDIAVRAHLNGWKFIFLNDVKVLCEVPESYEAYRKQQHRWHSGPMHLFRLCLPAIITSKIAIWKKANLILLFFLLRKLILPFYSFTLFCIILPLTMFVPEAELPVWVICYVPVFMSFLNILPAPKSFPFIVPYLLFENTMSVTKFNAMVSGLFKLGSSYEWVVTKKAGRSSESDLLAAAERESKTTNQLQIQRGASESELIELNRLKAAPVPVKRVNKIYRKELTLAFLLLTASVRSLLSAQGVHFYFLLFQGVTFLLVGLDLIGEQMS

SEQ ID NO: 3493 - protein, 689 aa, Gossypium hirsutum
MAPGLDFSDWGAMETRKGTPVVVKMDNPNYSVVEIEDPDAAFRPVEKSRGKNAKQVTWVLLLKAHRAVGCVAWMATLFWALLGTIKKRLIFRQDVGMASEKLGKGKLLFTVIKAFLVISLTILAFEIIAYFNGWHYFQNPSLHIPRTSEIQGLFHLVYVTWLWFRADYIAPLIQALSKFCVALFLIQSADRMVLCLGCFWIKYKKIKPRIEGNPFKSNDVEGSGYDYPMVLVQIPMCNEREVYEQSISAVCQLDWPKDRLLIQVLDDSDDESIQCLIKTEVATWNQRGINIIYRHRLIRTGYKAGNLKSAMSCEYIQAYEFVAIFDADFQPNPDFLKQTVPHFKDNPELGLVQARWTFVNKDENLLTRLQNINLCFHFEVEQQVNGVFLNFFGFNGTAGVWRIRALEESGGWLERTTVEDMDIAVRAHLNGWKFIFLNDVKVLCEVPESYEAYRKQQHRWHSGPMHLFRLCLPAIITSKIAIWKKANLILLFFLLRKLILPFYSFTLFCIILPLTMFVPEAELPVWVICYVPVFMSFLNILPAPKSFPFIVPYLLFENTMSVTKFNAMVSGLFKLGSSYEWVVTKKAGRSSESDLLAAAERESKTTNQLQIQRGASESELIELNRLKAAPVPVKRVNKIYRKELTLAFLLLTASVRSLLSAQGVHFYFLLFQGVTFLLVGLDLIGEQMS

SEQ ID NO: 3494 - protein, 318 aa, Solanum phureja
MATHSNLKNALIAFLAPLPSLLFYLSFLRHYHEDNPLYNWCYHHPLLFANVLFFFNVNILFYAIGYLQSSHWMIDLYWTVIPVMLVHFYANHPLAQYNVWRSKVVILLTWIWSIRLTHNYFRRENWQWGHRQDWRFTDMSHQFGKNWWWISFFVVYFSQQIFLIGICLPMYVVHSEDKPWNNWDFIAVFICLSAIIIAYYADTELYNFVSGNQKLKELGKPMVPNLDEGLWKYSRHPNYFGEQLWWWGLFLFAWNLGQTWTFVGALANSLCLAHVTVLVENRMLKQAYRAEAYKLYQRTTSVWIPWFKSSAKGKDKET

SEQ ID NO: 3495 - protein, 318 aa, Solanum melongena
MATHSNLKNAFIAFLAPLPSILFYLSFLNHYHEHHPIYNWCYQHPLLFANLLFFLNVNLLFWVIGLLQSSHWMIDLYWTVIPVMLVHFYANHPLAKYNMWRSKVVIVLTWIWSIRLTHNYFRRENWQWGHRQDWRFTDMSQQYSKYWWWLSFFVVYVSQQVFLIGICLPMYVVHSEDKPWNIWDFTAIFICLSAIIIAYYADTQLYNFVSRNQKLKELGEPVVPNLDEGLWRYSRHPNYFGEQLWWWGLVLFAWNLGQAWTFIGALVNSMCLAHVTVLVENRMLKQAYRAEAYKLYQKTTSVWIPWFKSSAIGKDKET

SEQ ID NO: 3496 - protein, 147 aa, Solanum phureja
MDFIILLIVILALSCKPIIIISGSVTNDRYSTTNSSTNVALSARKVVFPPPRQLGKYTRTDNSNDDDLICKTCKRLSEHRTCCFNYFCVDLFTNRFNCGSCGLVCIVGTRCCGGICVDIKKDNGNCGKCYNVCSPGQNCSFGLCVYA

SEQ ID NO: 3497 - protein, 60 aa, Solanum tuberosum
LIILLIVILALSCKSITIISGSVTNHRYSTTNSIHQRCSFCTKSCIISSSQTARKIHEDR

SEQ ID NO: 3498 - protein, 289 aa, Solanum phureja
MEDLPGFRFHPTEEELLEFYLKNKVLGKKSRCDVIGLLNIYRHDPWDLPELATIGEREWYFFVPRDRKHGSGGRPNRTTQKGFWKATGSDKKIIGLSNPKNIIGLKKTLVFYTGRAPRGSKTDWVMNEFRLPDTVSSPQDIVLCKIYRKATSLKVLEQRAAIEEEMNGTKHVHSSPCSTTLQPMDAMSFSNEHHEPTDQSPNFFMSINKDEVEDDILSITENNPFEVSAETKEKSNCFRPKLLNGQDNLAELQVPKFSMDFSQDPVWMQLRSPWLDNFILTPSAFVHNF

SEQ ID NO: 3499 - protein, 501 aa, Capsicum annuum
MANKVFGPKLFKNLGFHVRRLNSAPSPFSAVPPLNFTGDFNAVPNLVEPTPQINNTTTHHPHINNNIINFNDVKELFYGVPTTKLIRSSLTLQMAAIEPMVDLGMWVMNSKLMEMPVFRDVMLGFVKNTFYEHFCAGKDLTEVRRTVMNLSDSGLKAMLDYGVEHATENESCEQSTTAFIQTIESTKSLPQSSASFVVAKITAICTPRLLKRMSDLLRWEQKDPSLNLPWKRRTLPLFAESSPVYHTSEKPEPLTVEEERDLELAHERLKKICEKCLEHDVPLLIDAEDSTIQPAIDYFAYSAAIKYHKDDQPLIFGTIQAYLKDAKERMVMAKKAAEKMGVPMGFKLVRGAYMCSEKALASSLGFNSPIHDSIEQTHACFNSCAEFMIEEIANGSGAVVLATHNIESGKLAATKAIDLGIKIERQSLQFAQLYGMADGLSFGLRNAGFQVSKYLPFGPVEQIMHYLMRRAEENRGMLSTSAFDRQLMRKELSRRLEVATS

SEQ ID NO: 3500 - protein, 499 aa, Nicotiana tabacum
MANKVVCPKLLKNLGFHVRRLNSAPSPLSAVPPLSFTGDFNATTVTTPNLVDTVPQINTVPDKNNIINFDDVKELFYGVPTSKLIRSTLTLQMAAIDPMVDMGMWVMNSKLMEMPIFREVMLGFVKNTFYEHFCAGKDLTEVRRTVSKLSDGGLKAMLDYGVEHATNNESCEQSMKAFIQTIESTKSLPQSSTSFVVVKITAICTPRLLKRMSDLLRWEHKDPSFNLPWKQKTLPLFAESSPLYHTSKKPEPLTVEEERDLQLAHERLTKICEKCLEHDVPLLIDAEDTTIQPGIDYMAYSAAIKYHKDDGPLIFGTIQAYLKDAKERMAIAKKAAEKMGVPMGFKLVRGAYMCSERELASRLGFQSPIHDSIEQTHACFNSCAEFMIEEIANGSGAVVLATHNIESGKLAATKAIDMGIKDSQKLQFAQLYGMAEGLTFGLRNAGFQVSKYLPFGPVDQIMHYLMRRAEENRGMLSTSAFDRQLMRKELSRRLKVATS

SEQ ID NO: 3501 - protein, 551 aa, Solanum phureja
MKYQNLDLFDPRTAVMDPEYSPTHTGEPDFAFAFDDVNFSDRILRIEILGDSIAGGSNSSGGCSSLADWARNRKRRREDFRKENALDITACPEDQVICCNQIDSEDADNENQDEAVVAMIEEPNSGDEGANSDDSTWNCDSPRVMRVKTLNISSPILAAKSPFFYKLFSNGMRESEQRQVTLRINASEEAALMELLKFMYRNMLTTNTAPGLLDVLMAADKFEVASCMKYCSRLLCNLPMTPESALLYLELPSSVLMADAVRPLTDAAKQFLAARYKDITKFQEEVMKLPLAGIEAILSSDDLQVASEDAVYDFVLKWTRAHYPLIEERREILSSRLGRCIRFPFMSCRKLRKVLACNDFEHEFASKLVLEALFFKAEAPHRQRTQAAEESASTSRRFVERAYKYRPVKVVEFELPRQQCIVYLDLKRDECANLFPSGRVYSQAFHLGGQGFFLSAHCNMDQQSSFHCFGLFLGMQEKGSVSFTVDYEFAARTTLAEEYVSKYKGNYTFTGGKAVGYRNLFAIPWTSFMAEDSLYFIKGVLHLRAELTIRH

SEQ ID NO: 3502 - protein, 549 aa, Capsicum annuum
MKDQNLDLFDPRTAVMDPEYSPTRTRDPDFGFAFNDSNFSDRLLQIEIMADPHSDSDSFHSQSLADWARNRKRRREDIKKDMALDITACPEEQVISCNQIDTEDVENENQDESVVAMIEEPHSGDEANNADDSSWNFDSPRVVKVKTLHISSPILAAKSPFFYKLFSNGMRESEQRQVTLRINASEEAALMELLNFMYSNTLTTNTAPALLDVLMAADKFEVASCMRYCSRQLRNLPMTPESALLYLELPSSVLMAEAVQPLTDAAEQFLAARYKDITKFQEEVMKLPLAGVEAILSSDDLQVASEDAVYDFVLKWTRTHYPQLEERREILGSRLGRCIRFPFMSCRKLRKVLACNDFDHEFASKLVLEALFYKAEAPHRQRTQAAEESSSTSRRFVERAYKYRPVKVVDFEHPRQQCVVYLDLKREECANLFPSGRVYSQAFHLGGQGFFLSAHCNMDQQSSFHCFGLFLGMQEKGSVTFAVDYEFAARTKPGEEYVSKYKGNYTFTGGKAVGYRNLFAIPWTSFIAEDSPYFTNGTLHLRAELTIRS

SEQ ID NO: 3503 - protein, 552 aa, Unknown
  Sequence found in Organisms: Solanum tuberosum, Solanum phureja
MKDQNLDLFDPRTAVMDPEYSPSSTRDPDFGFAFNDVNFSDRLLQIEIMADSFDPQSDSDSFHSQSLADWARNRKRRREDIRKEMALDITACPEEQVISCNQIDTEDVENENQDESVVAMIEEPHSGDEATNADDSSWNFDSPRVVKVETLHISSPILAAKSPFFYKLFSNGMRESEQRQVTLRINASEEAALMELLNFMYSNKLTTNTAPALLDVLMAADKFEVASCMRHCSRQLRNLPMTSESALLYLELPSSILMAEAVKPLTDAAEQFLAARYKDITKFQEEVMKLPLAGVEAILFSDDLQIASEDAVYDFVLKWTRTHYPQIEERREILGSRLGRCIRFPFMSCRKLRKVLACNDFDHEFASKLVLEALFYKAEAPHRQRTQAAEDSSSTSHRFVERAYKYRPVKVVDFGLPRQQCVVYLDLKREECANLFPSGRVYSQAFHLGGQGFFLSAHCNMDQQSSFHCFGLFLGMQEKGSVTFAVDYEFAARTKPGEEYVSKYKGNYTFTGGKAVGYRNLFAIPWTSFIAEDSPYFTNGMLHLRAELTIKS

SEQ ID NO: 3504 - protein, 552 aa, Solanum lycopersicum
MKDQNLDLFDPRTAVMDPEYSPSSTRDPDFGFAFNDVNFSDRLLQIEIMADSFDPQSDSDSFHSQSLADWARNRKRRREDIRKEMALDITACPEEQVISCNQIDTEDVENENQDESVVAMIEEPHSGDEATNADDSSWNFDSPRIIKVETLHISSPILAAKSPFFYKLFSNGMRESEQRQVTLRINASEEAALMELLNFMYSNKLTTNTAPALLDVLMAADKFEVASCMRYCSRQLRNLPMTPESALLYLELPSSILMAEAVKPLTDAAEQFLAARYKDITKFQEEVMKLPLAGVEAILFSDDLQIASEDAVYDFVLKWTRTHYPQLEERREILSSRLGRCIRFPFMSCRKLRKVLACNDFDHEFASKLVLEALFYKAEAPHRQRSQAAEDSSSTSHRFVERAYKYRPVKVVDFGLPRQQCVVYLDLKREECANLFPSGRVYSQAFHLGGQGFFLSAHCNMDQQSSFHCFGLFLGMQEKGSVTFAVDYEFAARTKPGEEYVSKYKGNYTFTGGKAVGYRNLFAIPWTSFIAEDSPYFTNGMLHLRAELTIKS

SEQ ID NO: 3505 - protein, 446 aa, Solanum phureja
MSHQQEDDADYMANEYDMEAMDDDMDDEFHGRDVGGSDSDADDYDYTNNKMQDTSAAEARRGRDIQGIPWERLSITREKYRQTRLEQYKNYENIPQSGEASEKDCLATKKEVSFYDFRRNSRSVKSTILHFQLRNLVWATSKHDVYLMSHFSVIHWSSLTCSKSEVLNVSGHVAPCEKHPGSLLEGFTQTQVSTLTVKDNLLVAGGFQGELICKYVDRPGVCFCSRTTYDDNAITNAVEIYNTSSGALHFIASNNDSGVRDFDMEKFQLSKHFRFPWPVNHASLSPDGKLIAIVGDNPEGLLVDSRNAKVVSPLSGHIDYSFASAWHPDGLTFATGNQDKTCRVWDIRNLSKSVVALKGNLGAIRSIRYTSDGRFMAMAEPADFVHVFDVKNGYEQEQEIDFFGEISGLSFSPDTESLFVGVWDRTYGSLLEFGRRHNYSYLDTII

SEQ ID NO: 3506 - protein, 446 aa, Capsicum annuum
MSHQQEDDADYMENEYDMEVIDDDMDDEFHGRDNGGSDSDGEDYDYMNNKMQDTSAAEARRGRDIQGIPWERLSITREKYRQTRLEQYKNYENIPQSGEASEKECIATKKEVSYYDFRRNSRSVKSTILHFQLRNLVWATSKHDVYLMSHFSVIHWSSLTCGKNEVLNVSGHVAPCEKHPGSLLEGFTQTQVSTLTVKDKLLVAGGFQGELICKYLDRPGVCFCSRTTYDDNAITNAVEIYNTASGALHFIASNNDSGVRDFDMEKFQLSKHFRFPWPVNHASLSPDGKLIAIVGDNPEGLLVDSRNAKVVSPLSGHIDYSFASAWHPDGLTFATGNQDKTCRVWDIRNLSKSVVALKGNLGAIRSIRYTSDGRFMAMAEPADFVHVFDVKSGYEQEQEIDFFGEISGLSFSPDTESLFIGVWDRTYGSLLEFGRRHNYSYLDTII

SEQ ID NO: 3507 - protein, 446 aa, Catharanthus roseus
MSHHHGDDADYMADEYDMEDVDDDMDDEFRGRDMGGSDSDVDEYDYMSNKMQDTSAAQARKGKDIQGIPWERLSITREKYRQTRLEQYKNYENIPQSGEGSEKECKSTEKGALYYEFRRNSRSVKSTILHFQLRNLVWATSKHDVYFMSRFSVIHWSTLSCMKSEVLNVSGHVAPCEKHPGSLLEGFTQTQVSTLAVKDNLLVAGGFQGELICKFLDRPGVSFCSRTTYDDNAITNAVEIYNTPSGAVHFTASNNDCGVRDFDMEKFQLSKHFRFPWPVNHTSLSPDGKLLSIVGDNPEGILVDSRSGKAVANLSGHLDYSFASAWHPDGLTFATGNQDKTCRIWDMRNLSKSVAALKGNLGAIRSIRYTSDGRFMAMAEPADFVHVFDVKSGYEKEQEIDFFGEISGMSFSPDTESLFIGVWDRTYGSLLEFGRRRYYSYLDTII

SEQ ID NO: 3508 - protein, 400 aa, Vinca minor
MNNKMQDTSAAQARRGKDIQGIPWERLSITREKYRQTRLEQYKNYENIPQSGERSEKDCTSTEKGCSYYEFRRNSRSVKSTILHFQLRNLVWATSKHDVYFMSRFSVIHWSTLSCMKSEVLNVSGHVAPCEKHPGSLLEGFSQTQVSTLAVKDNLLIAGGFQGELICKFLDRPGVSFCSRTTYDDNAITNAVEIYNTPSGAVHFTASNNDSGVRDFDMEKFQLSKHFRFPWPVNHTSLSPDGKLLTIVGDNPEGILVDSKTGKTVANLCGHLDYSFASAWHPDGITFATGNQDKTCRIWDMRNLSKSVAVLKGNLGAVRSIRYTSDGRFMAMAEPADFVHVFDVKSGYEKEQEIDFFGEISGMSFSPDTESLFIGVWDRTYGSLLEFGRRRYYSYLDTIF

SEQ ID NO: 3509 - protein, 446 aa, Tabernaemontana elegans
MSHHQGDDADYMADEYDMEDLDDDMDGVFRGRDIGGSDSDVDEYDYMNNKMQDTSAAQARRGKDIQGIPWERLSITREKYRQTRLEQYKNYENIPQSGEGSEKECKSTEKGGSYYEFRRNSRSVKSTILHFQLRNLVWATSKHDVYFMSRFSVIHWSTLSCMKSEVLNVSGHVAPCEKHPGSLLEGFTQTQVSTLAVKDNLLVAGGFQGELICKFLDRSGVSFCSRTTYDDNAITNAVEIYTKPSGAVHFTASNNDCGVRDFDMEKFQLSKHFRFPWPVNHTSLSPDGKLLTIVGDNPEGILVDSRSGKAVANLCGHLDYSFASAWHPDGLTFATGNQDKTCRIWDMRNLSKSVTALKGNLGAIRSIRYTSDGRFMAMAEPADFVHVFDVKSGYEKEQEIDFFGEISGMSFSPDTESLFIGVWDRTYGSLLEFGRRRNYSYLDTII

SEQ ID NO: 3510 - protein, 446 aa, Amsonia hubrichtii
MSNHHEVDADYMADEYDMEDVDDDMDDEFRGRDMAGSDSDVDEYDYMSNKMQDTSAAQARRGKDIQGIPWERLSITREKYRQTRLEQYKNYENIPQSGEGSEKECKSTEKGGSYYEFRRNSRSVKSTILHFQLRNLVWATSKHDVYFMSRFSVIHWSTLSCMKSEVLNVSGHVAPCEKHPGSLLEGFTQTQVSTLAVKENLLVAGGFQGELICKFLDRPGVSFCSRTTYEDNAITNAVEIYTTPSGAVHFTASNNDCGVRDFDMEKFQLSKHFRFPWPVNHTSLSPDGKLLTIVGDNPEGILVDSRNGKAVASLCGHLDYSFASAWHPDGLTFATGNQDKTCRIWDMRNLSKSVAALKGNLGAIRSIRYTSDGRFMAMAEPADFVHVFDVKSGYEKEQEIDFFGEISGMSFSPDTESLFIGVWDRTYGSLLEFGRRRNYSYLDTVI

SEQ ID NO: 3511 - protein, 390 aa, Vinca minor
MSHQQRDDAEYMADEYDMEDGDDDMDDEFGGRDIGGSDSDVDEYDYMNNKMQDTSAAQARRGKDIQGIPWERLSITREKYRQTRLEQYKNYENIPQSGERSEKDCTSTEKGCSYYEFRRNSRSVKSTILHFQLRNLVWATSKHDVYFMSRFSVIHWSTLSCMKSEVLNVSGHVAPCEKHPGSLLEGFSQTQVSTLAVKDNLLIAGGFQGELICKFLDRPGVSFCSRTTYDDNAITNAVEIYNTPSGAVHFTASNNDSGVRDFDMEKFQLSKHFRFPWPVNHTSLSPDGKLLTIVGDNPEGILVDSKTGKTVANLCGHLDYSFASAWHPDGITFATGNQDKTCRIWDMRNLSKSVTVLKGNLGAVRSIRYTSDGRFMAMAEPADFSPPFSM

SEQ ID NO: 3512 - protein, 446 aa, Valeriana officinalis
MSHHHGDDAEYMADEYEMEDGDDDMDEEFRGRDTGGSDSDVDEYDHLSNKMADTSAAQARKGKDIQGIPWERLSITREKYRQTRLEQYRNYENIAQSGEGSEKECKITRKGASYYEFRRNSRSVKSTILHFQLRNLVWATSKHDVYLMSHFSVIHWSSLTCTRSEVLNVSGHVAPSEKHPGSLLEGFTQTQVSTLAVKDNLLVAGGFQGELICKYLDRPGVCFCSRTTYDDNAITNAIEIYNTASGALHFTASNNDSGVRDFDMEKFQLCKHFRFPWPVNHTSQSPDGKLLIIVGDNPDGLLVDSKTGKTVASLCGHLDYSFASAWNPDGLTFATGNQDKTCRIWDIRNTSKSIAALKGNLGAIRSIRYTSDGRFMSMAEPADFVHVFDVKSGYEKEQEIDFFGEISGMAFSPDTESLFVGVWDRTYGSLLEFGRCRNYSYLDTLI

SEQ ID NO: 3513 - protein, 443 aa, Actinidia deliciosa
MSNQQGDDAEYMADEYEMEDVDDDMDEEFVGREMGGSDSDVDEYDHMNNRMADTSAAQARRGKDIQGIPWERLSITREKYRQTRLEQYKNYENIPQSGEGSEKECNIIKKGGMYYEFRRNSRSVKSTILHFQLRNLVWATSKHDVYLMSHFQVVHWSSLTCNKSEVLNVSGHVAPCEKHPGSLLEGFSQTQVSTLAVKDRLLVAGGFQGELICKYLDRPGVSFCTRTTYDDNAITNAVEIYSTSSGASHFTASNNDCGVRDFDMEKFQLSKHFRFPWPVNHTSLSPDGKLLVIVGDNPDGILMDASTGKTILHLAGHLDFSFASAWHPDGLTFATGNQDKTCRIWDVRNLSKSVAALKGNLGAIRSIRYTSDGRFMAMAEPADFVHVYDAKGGYEKEQEIDFFGEISGMSFSPDTESLFIGVWDRTYGSLLEFGRRRNYSYLD

SEQ ID NO: 3514 - protein, 378 aa, Solanum tuberosum
MSHQQEDDADYMANEYDMEAIDDDMDDEFHGRDVGGSDSDADDYDYTNNKMQDTSAAEARRGRDIQGIPWERLSITREKYRQTRLEQYKNYENIPQSGEASEKDCLATKKEVSYYDFRRNSRSVKSTILHFQLRNLVWATSKHDVYLMSHFSVIHWSSLTCSKSEVLNVSGHVAPCEKHPGSLLEGFTQTQVSTLTVKDNLLVAGGFQGELICKYVDRPGVCFCSRTTYDDNAITNAVEIYNTSSGALHFIASNNDSGVRDFDMEKFQLSKHFRFPWPVNHASLSPDGKLIAIVGDNPEGLLVDSRNAKVVSPLSGHIDYSFASAWHPDGLTFATGNQDKTCRVWDIRNLSKSVVALKGNLGAIRSIRYTSDGRFMAM

SEQ ID NO: 3515 - protein, 221 aa, Fagus grandifolia
MSQYQGDDAEYMADEYEMEDVDDDMDDEFRGREMGGSESDVEEYEPSNNKLADTTAAQARSGKDIQGIPWDRLSITREKYRQTRLEQYKNYENIPHSGEGSGKDCKVTKKGGSYYVFRRNSRSVKSTILHFQLRNLVWATSKHDVYLMSHFSVVHWSSLTCGRNEVLNVSGHVAPSEKHPGSLLEGFTQTQVSTLSVKDKLLVAGGFQGELICKHLDRPGI

SEQ ID NO: 3516 - protein, 446 aa, Castanea mollissima
MSQYQGDDAEYMADEYEMEDVDDEMDDEFRGRDVAGSESDVDEYDHGNSKVHDTTAAQARSGKDIQGIPWDRLSITREKYRQTRLEQYKNYENIPQSGEGSGKDCKVTKKGGSYYEFRRNSRSVKSTILHFQLRNLVWATSKHDVYLMSHFSVVHWSSLNCSRQEVLNVSGHVAPSEKHPGSLLEGFTQTQVSTLSVKDKLLVAGGFQGELICKHLDRPGVSFCSRTTYDDNAITNAVEIYVSSSGAVHFTASNNDCGVRDFDMEKFQLTKHFRYPWPVNHTSLSPDGKLLTIVGDNPEGLLVDSQTGKMVTTLCGHLDFSFASAWHPDGVTFATGNQDKTCRVWDVRNLSKSVAVLKGNLGAIRSIRYTSDGQYMAMAEPADFVHVYDAKNGYEKEQEIDFFGEISGVSFSPDTESLFIGVWDRTYGSLLEYGRCRNYSYLDSLI

SEQ ID NO: 3517 - protein, 446 aa, Citrus sinensis
MSHYHADDAEYMADEYDMEDIDDDMDEEFRGRDMGGSDSDVDEYDYSNNKIADTSAAQARRGKDIQGIPWERLSITREKYRQTRLEQYKNYENIPNSGEGSGKDCKVTKKGASYYEFRRNSRSVKSTILHFQLRNLVWATSKHDVYLMSHFSVIHWSSLTSSRSQVLNVSGHVAPSEKHPGSLLEGFTQTQVSTLAVKDKLLVAGGFQGELICKHLDRPGVSFCSRTTYDDNAITNAVEIYGSPSGAVHFTASNNDCGVRDFDMGKYQLSKHFRFPWPVNHSSQSPDGKLLIIVGDNPDGLLVDSMTGKTIASLCGHLDFSFASAWHPDGVTFATGNQDKTCRIWDLRNLSESVAVLKGNLGAIRSIRYTSDGRYMATAEPADFVHVYDVKSGYEKEQEIDFFGEISGISFSPDTESLFIGVWDRTYGSLLEYGRCRNYSYLDSLI

SEQ ID NO: 3518 - protein, 446 aa, Citrus clementina
MSHHHADDAEYMADEYDMEDIDDDMDEEFRGRDMGGSDSDVDEYDYSNNKIADTSAAQARRGKDIQGIPWERLSITREKYRQTRLEQYKNYENIPNSGEGSGKDCKVTKKGASYYEFRRNSRSVKSTILHFQLRNLVWATSKHDVYLMSHFSVIHWSSLTSSRSQVLNVSGHVAPSEKHPGSLLEGFTQTQVSTLAVKDKLLVAGGFQGELICKHLDRPGVSFCSRTTYDDNAITNAVEIYGSPSGAVHFTASNNDCGVRDFDMGKYQLSKHFRFPWPVNHSSQSPDGKLLIIVGDNPDGLLVDSMTGKTTASLCGHLDFSFASAWHPDGVTFATGNQDKTCRIWDLRNLSESVAVLKGNLGAIRSIRYTSDGRYMATAEPADFVHVYDVKSGYEKEQEIDFFGEISGISFSPDTESLFIGVWDRTYGSLLEYGRCRNYSYLDSLI

SEQ ID NO: 3519 - protein, 446 aa, Citrus sinensis
MSHYHADDAEYMADEYDMEDIDDDMDEEFRGRDMGGSDSDVDEYDYSNNKIADTSAAQARRGKDIQGIPWERLSITREKYRQTRLEQYKNYENIPNSGEGSGKDCKVTKKGASYYEFRRNSRSVKSTILHFQLRNLVWATSKHDVYLMSHFSVIHWSSLTSSRSQVLNVSGHVAPSEKHPGSLLEGFTQTQVSTLAVKDKLLVAGGFQGELICKHLDRPGVSFCSRTTYDDNAITNAVEIYGSPSGAVHFTASNNDCGVRDFDMGKYQLSKHFRFPWPVNHSSQSPDGKLLIIVGDNPDGLLVDSMTGKTIASLCGHLDFSFASAWHPNGVTFATGNQDKTCRIWDLRNLSESVAVLKGNLGAIRSIRYTSDGRYMATAEPADFVHVYDVKSGYEKEQEIDFFGEISGISFSPDTESLFIGVWDRTYGSLLEYGRCRNYSYLDSLI

SEQ ID NO: 3520 - protein, 445 aa, Citrullus lanatus
MSHYHGDDTDYMADEYEMEDIDDDMDDEYHDREVEGSDSDADEFNSSSRIVDTTAAQARRGIDIQGIPWERLSITREKYRKTRLEQYKNYENIPNSGEGSEKDCKVTDKACSYYEFCRNSRSVKSTILHFQLRNLVWATSKHDAYLLSHFSVIHWSSLSCTKSEVLNVSGHVAPTEKHPGSLLEGFTQTQVSTLAVKDKLLVAGGFQGELICKHLDRPGVSFCSRTTYDDNAITNAVEIYTSASGAVHFTASNNDSGVRDFDMEKFQLSKHFCFPWPVNHAALNPDGKLLVIVGDNPEGLLVDSQTGKTVASLCGHLDFSFASAWHSDGVTFATGNQDKTCRIWDVRNLSKSVAALKGNLGAIRSIRYSSDGRYMAMAEPADFVHVFDVKSGYEKEQEIDFFGEISGVSFSPDTESLFIGVWDRTYGSLLEYHRRRNYSYLDSLY

SEQ ID NO: 3521 - protein, 458 aa, Fagus grandifolia
MSQHQGDDAEYMADEYEMEDVDDDMDDEFRGREMGGSESDVEEYEHSNSKLADTTAAQARSGKDIQGIPWDRRSITREKYRQTRLEQYRNHENIPHSGEGSGKDCKVTKKGGSYYVFRRNSRSVKSTILHFQLRNLVWATSKHDVYLMSHFSVVHWSSLTCSRNEVLNVSGHVAPSEKHPGSLLEGFTQTQVSTLSVKDKLLVAGGFQGELICKHLDRPGISFCSRITSDDNAITNAVEIYASSSGAVHFTASNNDSGVRDFDMEKFQLSKHFRFPWPVNHTSLSPDGKLLTIVGDNPEGMLVDSQTGKTVKPLCGHLDFSFASAWHPDGVTFATGNQDKTCRVWDVRNLSKSVAVLKGNLGAIRSIRYTSDGQYMAMAESADFVHVYDVKNGYEKEQEIDFFGEISGVSFSPDTESLFIGVWDRTYGSLLEYGRSRNYSYLDARDQSKRELAKDSTS

SEQ ID NO: 3522 - protein, 446 aa, Quercus alba
MSQYQADDAEYMADEYEMEDVDDEMDDEFRGRDMAGSESDVDEYDHGNSKAADTTAAQARSGKDIQGIPWDRLSITREKYRQTRLEQYKNYENIPQSGEGSGKDCKVTKKGGSYYEFRRNSRSVKSTILHFQLRNLVWATSKHDVYLMSHFSVVHWSSLNCSRQEVLNVSGHVAPSEKHPGSLLEGFTQTQVSTLSVKDKLLVAGGFQGELICKHLDRPGVSFCSRTTYDDNAITNAVEIYVSASGAVHFTASNNDCGVRDFDMEKFQLTKHFRYPWPVNHTSLSPDGKLLTIVGDNPDGMLVDSQTGKTVKSLCGHLDFSFASAWHPNGVTFATGNQDKTCRVWDVRNLSKSVAVLKGNLGAIRSIRYTSDGQYMAMAEPADFVHVYDAKNGYEKEQEIDFFGEISGVSFSPDTESLFIGVWDRTYGSLLEYGRCRNYSYLDSLI

SEQ ID NO: 3523 - protein, 445 aa, Lippia dulcis
MSHQLANEADDMEDEYEMEDADDMDEEAHGRDAGGSDSDMDEHDDLNNSVHDTTAAQARNGRDIQGIPWERLSITREKYRQTRLEQYKNYENIPQSGEGSEKECKATEKGALFYDFRLNSRSVRSTIFHFQLRNLVWATSKHDVYLMSHFSVMHWSTLKRTKSEILNVSGHVAPCEKHPGSLLEGFTQTQVSTLAVRDNLLVAGGFQGELICKYLDRPGVSYCTRTTYEDNAITNAVEIYTANSGAVHFIASNNDSGVRDFDMEKFQQANHFRFPWPVNHTSLSPDSKLLIIVGDDPESILVDSRSGKEIASLHGHLDYSFASAWHPDGLTFATGNQDKTCRVWDIRNLSKSVTALKGNLGAIRSIRYTSDGRFMAMAEPADFVHVFDVKNGYEQEQEIDFFGEISGMSFSPDTESLFIGVWDRTYGSLLEFNRRREYSFLDCII

SEQ ID NO: 3524 - protein, 445 aa, Gossypium raimondii
MSYYQEDDAEYMAEEYDMEDIDDMDEEFCGRDMSGSESDVDEYDYSNNKISDTSAAEARRGKDIQGIPWDQLSITREKYRQTRLEQYKNYENIPHSGEVSGKDCKITKKGASYYDFRLNSRSVKSTILHFQLRNLVWATSKHDVYLMSQFSVMHWSSLTHKKREILNVSGHVAPSEKHPGSLMEGFTQTQVSTLAVKDKLLVAGGFQGELICKHLDRPGISFCSRTTYDDNAITNAVEIYVTPSGAVHFTASNNDCGVRDFDMEKYQLSKHFHFLWPVNHTSLSPDGKLLIIVGDNPDIMLVDSDTGKTVMPLRGHLDFSFASAWHPDGVTFATGNQDKTCRIWDVRNLSKSIAVLKGNLGAIRSIRYTSDGKYMAMAEPADFVHVYDVKSGYENEQEIDFFGEISGLSFSPDTESLFIGVWDRTYGSLLEYSRQRNYLYLDSLM

SEQ ID NO: 3525 - protein, 442 aa, Malus domestica
MSHYAGYVEDEYEMEDVDDDMDDEFHGREMGASDSDVDEYDYSNSKVADTTAAQARKGKDIQGIPWDRLSITREKYRQTRLEQYKNYENIPNSGEGSGKDCKDTKKGSVYYQFRRNARSVKSTILHFQLRNLVWATSKHDVYLMSHFSVIHWSSLSCTKSEVLNVSGHVAPSEKHPGSLLEGFTQTQVSTLSVKDKLLVAGGFQGELICKHLDRPGVSFCSRTTYDDNAITNAVEIYDSPSGAVHFTASNNDSGVRDFDMEKFQLTKHFRYPWPVNHTSLSPDGKLLVIVGDNPEGMLVNSQTGKTVMSLSGHLDFSFASAWHPDGMTFATGNQDKTCRIWDVRNLSKSVAVLKGNLGAIRSIRYTSDGQYMMMAEPADFVHVYDVKSGYEKEQEIDFFGEISGISFSPDTESLFIGVWDRTYGSLLEYGRSRNYSYLDSLI

SEQ ID NO: 3526 - protein, 445 aa, Gossypium raimondii
MSYYQEDDAEYMADEYGMEDIDDMDEEFRARDMSGSESDVDEYDFSNNKISDTSAAEARRGKDIQGIPWDRLSITREKYRQTRLEQYKNYENIPHSGEVSGKDCKITKKGASYYDFRLNSRSVKSTILHFQLRNLIWATSKHDVYLMSRFSVMHWSSLTHKKREILNVSGHVAPSEKHPGSLMEGFTQTQVSTLAVKDKLLVAGGFQGELICKHLDRRGISFCSRTTYDDNAITNAVEIYVTPSGAVHFTASNNDCGVRDFDMEKFQLSKHFHFLWPVNHTSLSPDGKLLIIVGDNPDIMLVDSDTGKTVMPLHGHLDFSFASAWHPDGVTFATGNQDKTCRIWDVRNLSRSIAVLKGNLGAIRSIRYTSDGKYMAMAEPADFVHVYDVKSGYENEQEIDFFGEISGLSFSPDTESLFIGVWDRTYGSLLEYGRRRNYLYLHSLM

SEQ ID NO: 3527 - protein, 445 aa, Gossypium hirsutum
MSYYQEDDAEYMADEYGMEDIDDMDEEFRARDMSGSESDVDEYDFSNNKISDTSAAEARRGKDIQGIPWDRLSITREKYRQTRLEQYKNYENIPHSGEVSGKDCKITKKGASYYDFRLNSRSVKSTILHFQLRNLIWATSKHDVYLMSRFSVMHWSSLTHKKREILNVSGHVAPSEKHPGSLMEGFTQTQVSTLAVKDNLLVAGGFQGELICKHLDRRGISFCSRTTYDDNAITNAVEIYVTPSGAVHFTASNNDCGVRDFDMEKFQLSKHFHFLWPVNHTSLSPDGKLLIIVGDNPDIMLVDSDTGKTVMPLHGHLDFSFASAWHPDGVTFATGNQDKTCRIWDVRNLSRSIAVLKGNLGAIRSIRYTSDGKYMAMAEPADFVHVYDVKSGYENEQEIDFFGEISGLSFSPDTESLFIGVWDRTYGSLLEYGRRRNYLYLDSLM

SEQ ID NO: 3528 - protein, 442 aa, Prunus persica
MSHYAGYVEDEYEMEDVDDDMDDEFRGREMGGSDSDVDEYDYLNSKAADTTAAQARKGKDIQGIPWDRLSITREKYRQTRLEQYKNYENIPNSGEGSGKDGKDTKKGSLYYEFRRNARSVKSTILHFQLRNLVWATSKHDVYLMSHFSVIHWSSLRCTKSEVLNVSGHVAPSEKHPGSLLEGFSQTQVSTLAVKDKLLVAGGFQGELICKHLDRPGVSFCSRTTYDDNAITNAVEIYDSPSGAVHFTASNNDCGVRDFDMEKFQLTKHFRFPWPVNHTSLSPDGKLLVIVGDNPDGMLVNSQTGKTVMPLSGHLDFSFASAWHPDGITFATGNQDKTCRIWDVRNLSKSVAVLKGNLGAIRSIRYTSDGRYMMMAEPADFVHVYDVKSGYEKEQEIDFFGEISGISFSPDTESLFIGVWDRTYGSLLEYGRYRNYSYLDSLI

SEQ ID NO: 3529 - protein, 442 aa, Fragaria vesca
MSHYAGYVEDEYEMEDVDDDMDDEFRGRDLAGSESDVDEFDYANSKVADTTAAQARRGKDIQGIPWDRLSITREKYRQTRLEQYKNYENIPNSGEGSGKDCDITKKGSTYYEFRRNARSVKSTILHFQLRNLVWATSKHDVYLMSHFSVIHWSSISCSKSEVLNVSGHVAPSEKHPGSLLEGFTQTQVSTLAVKDKLLVAGGFQGELICKHLDRPGVSFCSRTTYDENAITNAVDIYDSPSGAVHFTASNNDCGVRDFDMEKFQLSKHFRFPWPVNHTSLSPNGKLLVIVGDNPDGMLVDSQTGKTVRALSGHLDFSFASAWHPDGVTFATGNQDKTCRVWDVRNLSKSVAVLKGNLGAIRSIRYTSDGRYMMMAEPADFVHVYDVKSGYEKEQEIDFFGEISGISFSPDTESLFIGVWDRTYGSLLEYGRRRDYSYLDSLI

SEQ ID NO: 3530 - protein, 445 aa, Lactuca sativa
MSHQQEDDEYMGDEYEMEDVDDNMEEEFHGRDVGSYSDVDEYDYMNNKLADTCAAQARRGKDIQGIPWERLSITRDKYRQTRLEQYKNYENIPQSGEASEKACKVTNKTVLYYDFRRNSRSVKSTILHFQLRNLVWATSKHDVYLMSRFSVIHWSSLTCNKSEVLNVSGHVAPCEKHPGSLLEGFTQTQVSTMAVKDNLLVAGGFQGELICKARSRPGVCFCLRTTYDDNAITNALDIYTTPSGAVHFTASNNDCGVREFDMENFQMTKHWRFPWPVNHTSISPDGKLLIIVGDSPEGMLVDSSSGKTVASLHGHLDFSFASAWNPDGYGFATGNQDKTCRVWDIRNISKSITSLKANLGAIRSIRYSSDGRFMAMAEPADFVHVFDVRDGCYDKEQEIDFFGEISGTSFSPDTDSLFIGVWDRTYSSLLEFGRRHNYSYLDSLI

SEQ ID NO: 3531 - protein, 445 aa, Gossypium hirsutum
MSYYQEDDAEYIAEEYDMEDIDDMDEEFCGRDMSGSESDVDEFDYSNNKISDTSAAEARRGKDIQGIPWDQLSITREKYRQTRLEQYKNYENIPHSGEVSGKDCKITKKGASYYDFRLNSRSVKSTILHFQLRNLVWATSKHDVYLMSQFSVMHWSSLTHKKREILNVSGHVAPSEKHPGSLMEGFTQTQVSTLAVKDKLLVAGGFQGELICKHLDRPGISFCSRTTYDDNAITNAVEIYVTPSGAVHFTASNNDCGVRDFDMEKYQLSKHFHFLWPVNHTSLSPDGKLLIIVGDNPDIMLVDSDTGKTVMPLRGHLDFSFASAWHPDGVTFATGNQDKTCRIWDVRNLSKSIAVLKGNLGAIRSIRYTSDGKYMAMAEPADFVHVYDVKSGYENEQEIDFFGEISGLSFSPDTESLFIGVWDRTYGSLLEYSRQRNYLYLDSLM

SEQ ID NO: 3532 - protein, 446 aa, Theobroma cacao
MSHYQEDYAEYMADEYDMEDIDDDMDEEFRGRYMSGSDSDLDEYDYMNNKISDTSAAQARRGKDIQGIPWDRLSITREKYRQTRLEQYKNYENIPHSGEGSGKDCKITQKGASYYDFRLNSRSVKSTILHFQLRNLVWATSKHDVYLMSHFSVMHWSSLAHRKHEILNVSGHVAPSEKHPGSLMEGFTQTQVSTLAVKDNLLVAGGFQGELICKNLDQPGISFCSRTTYDDNAITNAVEIYVTPSGAVHFTASNNDCGVRDFDMEKYQLSKYFHFLWPVNHTSLSPDGKLLIIVGDNPDGMLVDSSTGKTVMPLHGHLDFSFASAWHPNGVTFATGNQDKTCRIWDVRNLTRSVAVLKGNLGAIRSIRYTSDGKYMAMAEPADFVHVYDVKSGYENEQEIDFFGEISGLSFSPDTESLFIGVWDRTYGSLLEYGRRRNYSYLDSLI

SEQ ID NO: 3533 - protein, 445 aa, Cucumis sativus
MSHYHEDDTDYMADEYEMEDIDDDMDDECHDREDEGSDSDADEFNSSSRIVDTTAAQARRGIDIQGIPWERLSITREKYRKTRLEQYKNYENIPNSGEGSEKDCKVTDKACSYYEFCRNSRSVKSTILHFQLRNLVWSTSKHDAYLLSNFSVIHWSSLSYTKSDVLNVAGHVAPTEKHPGSLLEGFTQTQVSTLAVKDKLLVAGGFQGELICKHLDRPGVSFCFRTTYDDNAITNAVEIYTSASGAIHFTASNNDSGVRDFDMEKFQLSKHFCFPWPVNHAALNPDGKLLVIVGDNPEGLLVDSQTGKTVASLSGHLDFSFASAWHSDGITFATGNQDKTCRIWDVRNLSKSVAALKGNLGAIRSIRYSSDGRYMAMAEPADFVHVFDVKSGYEKEQEIDFFGEISGVSFSPDTESLFIGVWDRTYGSLLEYHRRRNYSYLDSLY

SEQ ID NO: 3534 - protein, 445 aa, Populus trichocarpa
MSHYQGDDAEYMEDEYEMEDVDDDMDEEFRAREMGSDSDIDEYDYLNNKVADTSAADARNGKDIQGIPWERLSITRDKYRQTRLEQYKNYENIPHSGEDSKKDCKITEKGGMYYEFRRNSRSVKSTILHFQLRNLVWATTKHDVYLMSHFSVIHWSSLTCSKADVLDVSGHVAPTEKHPGSLLEGFTQTQVSTLAVKDNLLVAGGFQGELICKHLDRPGVSFCSRTTYDDNAITNAVEIYDSPSGAVHFTASNNDHGVRDFDMEKYQLSKHFRFPWPVNHTSLSPDGKLLTIVGDSPDGMLVDSSSGKTVTSLSGHLDFSFASAWHPDGVTFATGNQDKTCRIWDVRNLSKSLAVLKGNLGAIRSIRYTSDGQYMAMAEPADFVHVYDVKNGYEKEQEIDFFGEISGVSFSPDTEALYIGVWDRTYGSLLEYGRCRNYSYLDSFV

SEQ ID NO: 3535 - protein, 157 aa, Gossypium hirsutum
MSYYQDDDAEYMADEYGMEDIDDMDEEFRARDMSGSESDVDEYDFSNNKISDTSAAEARRGKDIQGIPWDRLSITREKYRQTRLEQYKNYENIPHSGEVSGKDCKITKKGASYYDFRLNSRSVESTILHFQLRNLIWATSKHDVYLMSRFLSCIGLH

SEQ ID NO: 3536 - protein, 445 aa, Gossypium hirsutum
MSYYQEDDAEYIAEEYDMEDIDDMDEEFCGRDMSGSESDVDEYDYSNNKISDTSAAEARRGKDIQGIPWDQLSITREKYRQTRLEQYKNYENIPHSGEVSGKDCKITKKGASYYDFRLNSRSVKPPILHFQLRNLVWATSKHDVYLMSQFSVMHWSSLTHKKREILNVSGHVAPSEKHPGSLMEGFTQTQVSTLAVKDKLLVAGGFQGELICKHLDRPGISFCSRTTYDDNAITNAVEIYVTPSGAVHFTASNNDCGVRDFDMEKYQLSKHFHFLWPVNHTSLSPDGKLLIIVGDNPDIMLVDSDTGKTVMPLRGHLDFSFASAWHPDGVTFATGNQDKTCRIWDVRNLSKSIAVLKGNLGAIRSIRYTSDGKYMAMAEPADFVHVYDVKSGYENEQEIDFFGEISGLSFSPDTESLFIGVWDRTYGSLLEYSRQRNYLYLDSLM

SEQ ID NO: 3537 - protein, 446 aa, Euonymus alatus
MSHYHAEDAEYMADEYDMEDVEDDMDEEFRGRDIGGSDSDVDEFDYSNNKIADTSAAEAREGKDIQGIPWDRLSITREKYRQTRLEQYKNYENIPHSGEGSGKDCKVTKKGGSYYEFRRNSRSVKSTILHFQLRNLVWATSKHDVYLMSHFTVVHWSSLTCTRSEVLNVSGHVAPSEKHPGSLLEGFSQTQVSTLAVKENLLVAGGFQGELICKHLDRPGVSFCSRTTYDDNAITNAVDIYRNPSGALHFTASNNDCGVRDFDMEKYQLTKHFRFPWPVNHTSLSPDGKLLIIMGDNPDGMLVDSSTGKTVMPLRGHLDFSFASAWRPDGVTFATGNQDKTCRIWDVRNLSKSLAILKGNLGAVRSIRYTSDGRYMAMAEPADFVHVYDAKSGYEKEQEIDFFGEISGISFSPGTESLFIGVWDRTYGSLLEYGRCRNYSYLDSLI

SEQ ID NO: 3538 - protein, 445 aa, Cucumis melo
MSHYHEDDTDYMADEYEMEDIDDDMDDECHDREEEGSDSDADEFNSSSRIVDTTAAQARRGIDIQGIPWERLSITREKYRKTRLEQYKNYENIPNSGEGSEKDCKVTDKACSYYEFCRNSRSVKSTILHFQLRNLVWATSKHDAYLLSNFSVIHWSSLSYTKSDVLNVAGHVAPTEKHPGSLLEGFTQTQVSTLAVKDKLLVAGGFQGELICKHLDRPGVSFCFRTTYDDNAITNAVEIYTSASGAVHFTASNNDSGVRDFDMEKFQLSKHFCFPWPVNHAALNPDGKLLVIVGDNPEGLLVDSQTGKTVASLCGHLDFSFASAWHSDGITFATGNQDKTCRIWDVRNLSKSVAALKGNLGAIRSIRYSSDGRYMAMAEPADFVHVFDVKSGYEKEQEIDFFGEVSGVSFSPDTESLFIGVWDRTYGSLLEYHRRRNYSYLDSLY

SEQ ID NO: 3539 - protein, 446 aa, Aristolochia fimbriata
MSQYQAEDVEYMADDYEMADVDDDMDEEFRGRGMGDSDSEDEDYDHLNNKITDTSSAQARKGKDIQGIPWDRLSITREKYRQTRLEQYKNYENIPQSGEGSEKECKSTTKGGSFYEFRRNTRSVKSTILHFQLRNLVWATSKHDVYLMSHFSVIHWSAITCNKSEVLNVSGHVAPCEKHPGSLLEGFTQTQVSTLAVKDKLLVAGGFQGELICKYLDRPGVSFCCRTTYDDNAITNAVDIYDSPSGAVRFMASNNDCGVRDFDMERFQLCKHFRFPWPVNHTSLSPDGKLLVIVGDNPDGILVDSRTGKTISPLCGHLDFSFASAWHPDGRTFATGNQDKTCRIWDVRNLSESVAALKGNLGAIRSIRFTSDGQFMAMAEPADFVHVFDVRSGYEKEQEIDFFGEISGVSFSPDTESLFIGVWDRTYGSLLQYGRKRTYSYLDTLL

SEQ ID NO: 3540 - protein, 446 aa, Euonymus alatus
MSHYQAEDAEYVAEEYDMEDVEDDMDEEFRGRDMGGSDSDVDEFDYSNNKLADTSAAEARNGKDIQGIPWDRLSITREKYRQTRLEQYKNYENIPHSGEGSGKDCKVTKKGGSYYEFRKNSRSVKSTILHFQLRNLVWATSKHDVYLMSHFTVVHWSSLTCTRSEVLNVSGHVAPSEKHPGSLLEGFSQTQVSTLAVKENLLVAGGFQGELICKHLDRPGVSFCSRTTYDDNAITNAVDIYRNPSGALHFTASNNDCGVRDFDMEKYQLTKHFCFPWPVNHTSLSPDGKLLIIMGDNPDGMLVDSSTGKTVMPLHGHLDFSFASAWRPDGVTFATGNQDKTCRIWDVRNLSKSLAILKGNLGAVRSIRYTSDGRYMAMAEPADFVHVYDAKSGYEKEQEIDFFGEISGISFSPDTESLFIGVWDRTYGSLLEYGRCRNYSYLDSLI

SEQ ID NO: 3541 - protein, 446 aa, Tripterygium wilfordii
MSHYQVEDAEHMAEEYDMEDVEDDMDEEFRGRDMGGSDSDVDEFDYLNSKVADTSAAEAREGKDIQGIPWDRLSITREKYRQTRLEQYKNYENIPHSGEGSGKDCKVTKKGGSYYEFRRNSSSVKSTILHFQLRNLVWATSKHDVYLMSHFTVVHWSSLTCTRSEVLNVSGHVAPTEKHPGSLLEGFSQTQVSTIAVKENLLVAGGFQGELICKHLDRPGVSFCSRTTYDDNAITNAVDIYRNPSGALHFTASNNDCGVRDFDMEKYQLTKHFCFPWPVNHTSLSPDGKLRIIVGDNPDGILVDSSTGKTVMPLRGHIDFSFASAWHPDGVTFATGNQDKTCRIWDVRNLSKSQAVLKGNLGAVRSIRYTSDGRYMAMAEPVDFVHVYDAKSGYEKEQEIDFFGEISGISFSPDTESLFIGVWDRTYGSLLEYGRCRNYSYLDSLI

SEQ ID NO: 3542 - protein, 445 aa, Populus trichocarpa
MSHYQGDDAEYMADEYEMEDVDDDMDEEFRAREMGSDSDVDEYDYPNNKVADMSAADARNGKDIQGIPWERLSVTREKYRQTRLEQYKNYENIPHSGEVSRKDCKITKKGGLYYEFRRNSRSVKSTILHFQLRNLVWATTKHDVYLMSNFSVTHWSSLTCSKSDVLDVSGHVAPTEKHPGSLLEGFTQTQVSTLAVKGNLLVAGGFQGELICKHLDRPGVSFCSRTTYDDNAITNAVEIYDSPSGAVHFTASNNDCGVRDFDMEKYQLSKHFCFPWPVNHTSLSPDGKLLTIVGDNPAGMLVDSSTGKTVASLSGHWDFSFASAWHPDGVTFATGNQDKTCRIWDARNLSESVAVLKGNLGAIRSIRFTSDGQYMAMAEPADFVHVYDAKNGYEKEQEIDFFGEISGVSFSPDTEALYIGVWDRTYGSLLEYGRCRNYSYLDSFV

SEQ ID NO: 3543 - protein, 442 aa, Malus domestica
MSHYAGYVEDEYEMEDVDDDMDDEFHSREMGGSDSDVDEYDYLNSKVADTTAAQARKGKDIQGIPWDRLSITREKYRQTRLEQYKNYENVPNSGEGSGKDCKDTKKGSVYYEFRRNARSVKSTILHFQLRNLVWATSKHDIYLMSHFSVVHWSSLSCTKSEVLNVSGHVTPSEKHPGSLLEGFTQTQVSTLAVKDKLLVAGGFQGELICKHLDRPGVSFCSRTTYDDNAITNAVEIYDSPSGAVHFTASNNDCGVRDFDMEKFQLTKHFRYPWPVNHTSLSPDGKLLVIVGDNPEGILVNSQTGKTVMSLNGHLDFSFASAWHPDGMTFATGNQDKTCRIWDVRNLSKSVAVLKGNLGAIRSIRYTSDGQYMMMAEPADFVHVYDVKSGYEKEQEIDFFGEISGISFSPDTESLFIGVWDRTYGSLLEYGRSRNYSYLDSLI

SEQ ID NO: 3544 - protein, 508 aa, Solanum phureja
MKHQKKKKRSKTCKQVGVGNGSLPSGNSNDGRESVVTALTEAFSSVSVEEATCAYKEANGDLNKAMEILGDMVERKEEDKITSCSSSSGNVSSSLDSSNSDVFVGGHSWKNSVQRKAKMKKLVAATGTVSAMIGKDYVRTTPKKSCSKLKGLNDETSSNEDVEQFLYSMLGEDSDLSLAVVRDVLCQCGYEVEKALSVLLELSAPSNEQPKLSDCSANWKEEAVFLHSSDGLTDRTSDSTSHSSEGEVLENVWFWGPPGRNQLKVPAGNSEHSSSSTAGNSGPVLPQDILESLFNMPTPKSAEHEPTTMNWKNVVKKMTSLGQRFGSCPNDIPPLQHTHAEGAEYQLFRETAKQHWESMRSHYQKAATAFSNGQKGHAAYLADQGRLHNRKAQEADAKASQNIFAARNKNIENMITIDLHGQHVKPAMRLLKLHLLFGAFVRSVRLFRVITGCGAHGVGKSKLKNSVVELLKKERIEWTEENRGTLLIKLDGRMNFSFLDTDDDDDDN

SEQ ID NO: 3545 - protein, 150 aa, Solanum tuberosum
MRSHYQKAATAFSNGQKGHAAYLADQGRLHNRKAQEADAKASQDIFAARNKNIENMITIDLHGQHVKPAMRLLKLHLLFGAFVRSVRLFRVITGCGAHGVGKSKLKNSVVELLKKERIEWTEENRGTLLIKLDGRMNFSFLDTDDDDDDN

SEQ ID NO: 3546 - protein, 510 aa, Solanum phureja
MDHSTGKPGFFRNVLVRLCLFCVVIVCCRFAYVVTLKGETCDLGDFCFFSIPENLNVISGVGQLAGSVSAVMTTENAGKSAPTKPKLPDLWANKDFQKSAQFYSSVFEDLVADGFLNPNSKTLCVETPMGADVFALREIGVADSVGLYKKGSKPLVITGKAVKQPFEDDTFDFIFSGAGMIDKSLKPGDFAAEICRTLKPEGFLVVHTGSNDTYSFNSFLHLFNCCTLIKSRNIDGFDSTIREIVMKKDVFVEEKVSDSKNNCRHVPDYKMKLIKKAEPLIKEEPKKPWITLKKNAQSIKYLSSMADISFKQRYVYVDVGSRSYGSSIVSWFKKQYPKQNKTFEIYAVEADKTFHGQYKEKKGVTLLPYAAWVKNETLSFEINQDPGHKDVAKGRGMGRIQPVESSSESASEVDVIQGFDFAEWLMSAVSEKDYVVMKMDVEGTEFDLIPRLIETGAICLIDEVFLECHYNRWQKCCPGERSSKYPNTYSQCLDLFTSLRESGVLVHQWW

SEQ ID NO: 3547 - protein, 513 aa, Capsicum annuum
MDHSTAKPGLFRNVLVRLCLFCVVIVGCRFAYVVTLKGETCDLSDFCFFSLPENLNVISAGVGQLTKSVSAVMVNEDAGKSAPAKPRIPDLWASKDFQKSARFYSSVFQDLVAEGTLSSNSKTLCVETPMGADVFSLKEIGVEDSVGIYRKGSKPLVITGKAVKQPFKDDTFDFIFSGGGMIDKSPKPADFAAEICRTLKPEGFLVVHTGSKDTYSFNSFLHLFNCCTLIKSRNIDGFDSSMSAILEIVMKKDRYVEEQVSDLMHKCNIPDYKMKLIKKAEPLIKEEPKKPWITLKKNAQNIKYLSSMADISFKQRYVYVDVGSRSYGSSIVSWFKKQYPKQNKTFEIYAVEADKTFHGQYKEKKGVTLLPYAAWVRNETLSFEINQDPGHKDVAKGRGMGRIQPVESSGQSASEVDVIQGFDFAEWLKSAVTEKDYVVMKMDVEGTEFDLIPRLIETGAICLIDEVFLECHYNRWQKCCPGERSSKYQNTYGQCLDLFTSLRESGVLVHQWW

SEQ ID NO: 3548 - protein, 241 aa, Nicotiana tabacum
MIDKSTKPGDFAAEICRTLKPEGFFVVHTTGSKDTYSFNSFLHLFNCCTLIKSRNIDGFDSNTIREIVVKKVVFGDVNVEEKVSSDSKNKCNVPDYKLKLIKKAEPLIKEEPKKPWITLKKNAQNIKYLSSMADISFKQRYVYVDVGARSYGSSIVSWFKKQYPKQNKTFEIYAIEADKTFHGQYEGKKGVTLLPYAAWVRNETLSFEINQDPGHKDVAKGRGMGRINLLNLLVTLRVRWM

SEQ ID NO: 3549 - protein, 226 aa, Solanum tuberosum
MAETEPEAAVAPAVEAVVEAEKEDTSAQDMDVEALAADDTEDNGGSKRPREEENEPENEDATKKLKIDKSVEEERFENLDGSKTVDEEKKDGSGPVSVGPKNFGSSVEMFDYFYKLLHSWSPNLNLNKYEHIVLLDLLKKGHLEPDRKIGTGVRAFQIRFHPQFKSRCFFVIREDDSVDDFSFRKCVDHISPLPENMQVKHEANRDLARGGKGGGRGRGRGGKPRY

SEQ ID NO: 3550 - protein, 226 aa, Solanum phureja
MAETEPEAAAAPAVEPLVEAEKEDTSAQDMDVEAQAADDTEENGGSKRPREEENEVENEDVTKKLKVDKSVEEERFENLDGSKTVEEEKKYESGPVSVGPKNFGSSVEMFDYFYKLLHSWSPNLNLNKYEHIVLLDLLKKGHLEPDRKIGTGVRAFQIRFHPQFKSRCFFVIREDDSVDDFSFRKCVDHISPLPENMQVKHEANRDLARGGKGGGRGRGRGGKPRY

SEQ ID NO: 3551 - protein, 225 aa, Solanum melongena
MAETEPEAPAVEAVVEAEKVDTSAQDMDVEAQATDDRSENGGSKRPREEDNEPENEDATKKLKVDKSVEEERLENLDGSKTVDDEKKDGSGPVTVGPKNFGSSVEMFDYFYKLLHSWSPNLNLNKYEHIVLLDLLKKGHLEPDRKIGTGVRAFQIRFHPQFKSRCFFVIREDGSVDDFSFRKCVDHIQPLPENMQVKHEANKNLARGGKGGGHGRGRGRGGKPRY

SEQ ID NO: 3552 - protein, 235 aa, Nicotiana benthamiana
MAETEPEVAAAPAAEAVAQAEKEEIPVQDMDVEAQAADDEAENGGSKRPREEEQNEPENEDATKKLKVDQSVEEQRLENLDGSETAVDEEKKNGSGPASVGPKNFGSSVEMFDYFYKLLHSWSPNLNLNKYEHLVLLDLLKKGHLEPDRKIGTGIRAFQIRFHPQFKSRCFFVIREDDSVDDFSFRKCVDHILPLPENMQVKHEANKALAHSGKGRGRKGGGYGRDSGNGGKSRY

SEQ ID NO: 3553 - protein, 399 aa, Solanum phureja
MEPPNPQQFQQFLSSVLSQRGPSALPYAEDVKWLIRQHLLSLIDIYPSLQPKTASFTHNDGRTVNLLQAVGTVPMVYLDRPYNIPVIIWLMESYPRHPPLVFVNPTRDMVIKKPHPFVNPSGVVSIPYLQNWIYPSSNLVELVRNLSHFFGRDPPLYAKVQAHPSNPNPSPTPTSHPPPSTSFPNHSSPVGSSGIRPAIPPRPVQQPPYGAVKQDDWEDVFRRNATDKLLVDLHNDIVGLRNAQEKDMDGLFNAQGVLKQREEQLKQGLKEMQDEKEGLEQQLQMVLMNSDVLEGWLRENEGKVTNLGNVDVDTAFEPCDSLSKQMLDCTASDLALEDVIYSLDKAIQGGAIPFDQYLRNIRLLSREQFFHRATASKVRAAQMQAQVANMAARTSQYAL

SEQ ID NO: 3554 - protein, 282 aa, Solanum tuberosum
MASLDMTLDDMIKSRRSTERGGRGQGRARRGRGAGGSFRGGSFRGGRTTGAPRRGPLGVNARPSAYTIAKTFRRTKNLPWQNGLFEDSLRAAGLSSVLESGTKLYVSNLDIGVTNEDIRELFSEMGELVRFAIHYDKNGRPSGAAEVVFARRSDAFQALKRYNNVQLDGKPMKIEIVGSNPEIPLSARVNVVGGTNRRRTVVMAPGGPARGRGGATSRGSSQRGRGGFRNAPGRGRGGGGGRGWGRGRGRGGRGSNRAADKSAEDLDKELDSYHANADAMQT

SEQ ID NO: 3555 - protein, 282 aa, Solanum phureja
MASLDMTLDDMIKSRRNTERGGRGQGRARRGRGAGGSFRGGPFRGGRTTGAPRRGPLGVNARPSAYTIAKTFRRTKNLPWQNGLFEDSLRAAGLSSVLESGTKLYVSNLDIGVTNEDIRELFSEMGELVRFAIHYDKNGRPSGAAEVVFARRSDAFQALKRYNNVQLDGKPMKIEIVGSNPEIPLSARVNVVGGTNRRRTVVMAPGGPARGRGGATNRGSSQRGRGGFRNAPGRGRGGGGGRGWGRSRGRGGRGSNRAADKSAEDLDKELDSYHANADAMQT

SEQ ID NO: 3556 - protein, 301 aa, Tabernaemontana elegans
MTKMVSPDAISIILANPSPESSSGLPELVVQVLDLKPTGNRYMFTASDGKMKLKAILPSSLSSEVISGNIQNLGLICVLDYTLNDIPTKNEKYLIVTKCEAVSPALEAEYKTVVKTEETGILLKPKEEANIKMEVKCDEPGILLEPKQEIVTKSAHQIVHEQGGNMAPAARMAMTRRVHPLGSLNPYQGNWTIKVRVTSKGNMRTYKNIRGEGCVFNVELTDEDGTQIQATMFNDAARKFYDKFELGKVYYISKGTLKVANRQFNTVKNDYEMNINENSEVEEVSNEAAFIPETKYNLSNR

SEQ ID NO: 3557 - protein, 495 aa, Solanum phureja
MEGAATAQALSRIGLAGLAVMGQNLALNIAEKGFPISVYNRTTSKVDETLDRAQNEGQLPLIGQYNPRDFVLSIQRPRSVIILVKAGSPVDQTIAALSEYMEPGDTIIDGGNEWYENTERRIDEASSKGLLYLGMGVSGGEEGARNGPSLMPGGSYGAYTNIRDILEKVAAQVEDGPCVTYIGEGGSGNFVKMVHNGIEYGDMQLISEAYDVLKNAGGLSNSELADIFAEWNRGELESFLVEITADIFNVKDELTGNGELVDKILDKTGMKGTGKWTVQQAAELSIAAPTIAASLDSRYMSGLKDEREEASEIFRKEGLKEEISSDINGSSLDKKRLIDDVRQALYASKICSYAQGMNLLRAKSSEKGWNLNLGEMARIWKGGCIIRAVFLDRIKKAYQRNPNLANLMVDPEFAREMVQRQAAWRRVVGLAVQKGISVPGMSASLQYFDTYRRSRLPANLVQAQRDYFGAHTYERVDKSGAYHTEWAKLARKARV

SEQ ID NO: 3558 - protein, 495 aa, Solanum tuberosum
MEGAATAQALSRIGLAGLAVMGQNLALNIAEKGFPISVYNRTTSKVDETLDRAQNEGQLPLIGQYNPRDFVLSIQRPRSVIILVKAGSPVDQTIAALSEYMEPGDTIIDGGNEWYENTERRIDEASSKGLLYLGMGVSGGEEGARNGPSLMPGGSYGAYTNIRDILEKVAAQVEDGPCVTYIGEGGSGNFVKMVHNGIEYGDMQLISEAYDVLKNAGGLSNSELADIFAEWNRGELESFLVEITADIFNVKDELTGNGELVDKILDKTGMKGTGKWTVQQAAELSIAAPTIAASLDSRYMSGLKDEREEASEIFRKEGLKEEISSDINGSSLDKKRLIDDVRQALYASKICSYAQGMNLLRAKSSEKGWNLNLGELARIWKGGCIIRAVFLDRIKKAYQRNPNLANLMVDPEFAREMVQRQAAWRRVVGLAVQKGISVPGMSASLQYFDTYRRSRLPANLVQAQRDYFGAHTYERVDKSGAYHTEWAKLARKARV

SEQ ID NO: 3559 - protein, 493 aa, Amsonia hubrichtii
MESAAITADVVSRIGLAGLAVMGQNLALNIAEKGFPISVYNRTTSKVDETIDRAHREGQLPLIGQYNPRDFILSIQRPRSVIILVKAGAPVDQTIAALSEHMEPGDTIIDGGNEWYENTERRITEASAKGLLYLGMGVSGGEDGARYGPSLMPGGSHQAYSNIRDILEKVAAQVEDGPCVTYIGEGGSGNFVKMVHNGIEYGDMQLISEAYDVLKNAGGLSNSELADIFAEWNRGELESFLIEITADIFQVKDSETGQGELVDKILDKTGMKGTGKWTVQQAAELSIAAPTIAASLDSRYLSGLKDEREAASLIFKEEGLKEEINNVGVVDKKRLIDDVRQALYASKICSYAQGMNLLKAKSAEKGWNLNLGELARIWKGGCIIRAVFLDRIKKAYQRNPRLSNLLVDPEFAREMVQRQAAWRRVVGLAIQKGISVPGMSASLQYFDTYRRGRLPANLVQAQRDYFGAHTYERIDLPGSYHTEWSKLAQKARV

SEQ ID NO: 3560 - protein, 493 aa, Catharanthus roseus
METAAITADAVSRIGLAGLAVMGQNLALNIAEKGFPISVYNRTTSKVDETVDRAHREGQLPLTGQYNPRDFILSIQRPRSVIILVKAGAPVDQTIAALSEHMEPGDTIIDGGNEWYENTERRISEASARGLLYLGMGVSGGEDGARNGPSLMPGGSHPAYLNIRDILEKVAAQVEDGPCVTYIGEGGSGNFVKMVHNGIEYGDMQLISEAYDVLKNAGGLSNSELADIFAEWNRGELESFLIEITADIFQVKDSETGHGELVDKILDKTGMKGTGKWTVQQAAELSIAAPTIAASLDSRYLSGLKDEREAASQIFKEEGLKEEINNVGVVDKKRLIDDVRQALYASKICSYAQGMNLLRAKSAEKGWNLNLGELARIWKGGCIIRAVFLDRIKKAYQRNPGLANLLVDPEFARELVQRQAAWRRVVGVAIQKGVSVPGMSASLQYFDTYRRGRLPANLVQAQRDYFGAHTYERIDLPGSYHTEWAKLAQKARV

SEQ ID NO: 3561 - protein, 493 aa, Tabernaemontana elegans
MESAAITADAVSRIGLAGLAVMGQNLALNIAEKGFPISVYNRTTSKVDETVDRAHREGKFPLIGQHNPRDFILSIQRPRSIIILVKAGAPVDQTIAALSEHMEPGDTIIDGGNEWYENTERRISEASAKGLLYLGMGVSGGEDGARNGPSLMPGGSHQAYLNIRDILEKVAAQVEDGPCVTYIGEGGSGNFVKMVHNGIEYGDMQLISEAYDVLKNAGGLSNSELADIFAEWNRGELESFLIEITADIFRVKDSETGHGELVDKILDKTGMKGTGKWTVQQAAELSIAAPTIAASLDSRYLSGLKDEREAASQIFKEEGLKEEINNVGVVDKKRLIDDVRQALYASKICSYAQGMNLLRAKSAEKGWNLNLGELARIWKGGCIIRAVFLDRIKKAYKRNQGLANLLVDPEFAREMVQRQAAWRRVVGLAIQKGISVPGMSASLQYFDTYRRGRLPANLVQAQRDYFGAHTYERIDLPGSHHTEWSKLAQKARV

SEQ ID NO: 3562 - protein, 491 aa, Vinca minor
MESVAMGASRIGLAGLAVMGQNLALNIAEKGFPISVYNRTISKVDETVDRAHREGELPLTGQYDPKDFILSIQKPRSVIILVKAGAPVDQTIATLSEYMDPGDTIIDGGNEWYENTERRITEASSKGLLYLGMGVSGGEDGARNGPSLMPGGSHKAYLNIRDILEKVAAQVENDGPCVTYIGEGGSGNFVKMVHNGIEYGDMQLISEAYDVLKNAGGLSNSELADIFYEWNRGELESFLIEITADIFKVKDYESGEGELVDKILDKTGMKGTGKWTVQQAAELSIAAPTIAASLDSRYLSGLKDEREAASNIFKEEGLKEEVNNVGDVDKKRLIDDVRQALYASKICSYAQGMNLLRSKSSEKGWNLNLGEMARIWKGGCIIRAVFLDRIKKAYKRNQGLANLLVDPEFAREMVQRQAAWRRVVGLAVQKGISVPGMSASLQYFDTYRRGRLPANLVQAQRDYFGAHTYERIDLPGAYHTEWSKLGQKERV

SEQ ID NO: 3563 - protein, 487 aa, Lippia dulcis
MEAATLSQIGLAGLAVMGQNLALNIAEKGFPISVYNRTTSKVDETLDRAHREGQLPLTGHYNPKDFVLSLKNPAQLSFSQSRRPRRPDYRGSLRLHGARRHHHRRRKRVVRKHRAPHGRRVSNGLLYLGMGVSGGEEGARNGPSLMPGGSHRAYLNIHNILEKVAAQVDDGPCVTYIGEGGSGNFVKMVHNGIEYGDMQLISEAYDVLKNAGGLTNEELAEIFGEWNRGELESFLIEITSDIFKVKDEETGKGHLVDKILDKTGMKGTGKWTVQQAAELSIAAPTIAASLDSRYMSGLKEEREAAAEIFKKEGLTEEINNISSVDKKRLIDDVRQALYASKICSYAQGMNLLRSKSMEKGWGLNLGELARIWKGGCIIRAVFLDRIKQAYVRNPGLANLLVDPEFAREMVQRQAAWRRVVGLAIQKGISVPGMSASLQYFDTYRRGRLPANLVQAQRDYFGAHTYERIDRSGAYHTEWSKLARKARV

SEQ ID NO: 3564 - protein, 488 aa, Orobanche aegyptiaca
MESAVLSRIGLAGLAVMGQNLALNIAEKGFPISVYNRTISKVDETLDRAHREGQLPLSGHYTPRDFVLSIKKPRSIIILVKAGAPVDQTIAALSAHMEPGDTIIDGGNEWYENTERRMVDASADGLLYLGMGVSGGEDGARNGPSLMPGGSHKAYLNIHNILEKVAAQVDDGPCVTYIGEGGSGNFVKMVHNGIEYGDMQLISEAYDVLKNVGGLGNEELAEIFGEWNSGELESFLIEITCDIFKVEDEVTGNGHLVDKILDKTGMKGTGKWTVQQAAELSIAAPTIAASLDSRYMSGLKEEREAAAEIFKNEGLKEEINNVGSVDKKRLIDDVRKALYASKICSYAQGMNLLRAKSTEKGWGLNLGELARIWKGGCIIRAVFLDRIKQAYQRNPGLANLLVDPEFAREMVQRQAAWRRVVGLAIQKGISVPGMSASLQYFDTYRRGRLPANLVQAQRDYFGAHTYERVDCGGSYHTEWSKLARKARV

SEQ ID NO: 3565 - protein, 488 aa, Mimulus guttatus
MESAALSQIGLAGLAVMGQNLALNIAEKGFPISVYNRTISKVDETLDRAHREGQLPLTGHYNPKDFVLSIKKPRSIIILVKAGAPVDQTIAALSAHMEPGDTIIDGGNEWYENTERRIVDASANGLLYLGMGVSGGEDGARNGPSLMPGGSHRAYLNIHGILDKVAAQVDDGPCVTYIGEGGSGNFVKMVHNGIEYGDMQLISEAYDVLKNVGGLSNDELAEIFEEWNRGELESFLIEITTDIFKVKDLETGNGHLVDKILDKTGMKGTGKWTVQQAAELSIAAPTIAASLDSRYMSGLKEEREAASEIFKNEGLKEEIENVGDVDKKRLIDDVRQALYASKICSYAQGMNLLRAKSMEKGWGLNLGELARIWKGGCIIRAVFLDRIKQAYQRNPGLANLLVDPEFAREMVQRQSAWRRVVGVAIQKGVSVPGMSASLQYFDTYRRGRLPANLVQAQRDYFGAHTYERIDLPGAYHTEWSKLARNAKL

SEQ ID NO: 3566 - protein, 487 aa, Arnica chamissonis
MEAATLSRIGLAGLAVMGQNLALNIAEKGFPISVYNRTTSKVDETLDRAHNEGQLPLTGHYTPRDFVLSIQKPRSVIILVKAGAPVDQTIAALTEHMEPGDTIIDGGNEWYENTERRIVEANSKGLLYLGMGVSGGEEGARNGPSLMPGGSYDAYNNIKDIVEKVAAQVEDGPCVTYIGSGGSGNFVKMVHNGIEYGDMQLISEAYDVLKNVGGLSNSELAEIFDEWNKGELESFLIEITADIFKVKDEHGEGELVDKILDKTGMKGTGKWTVQQAAELSVAAPTIAASLDCRYLSGLKDEREAAAKVLAEAGLKEEVGTVRSGIDKKRLIDDVRQALYASKICSYAQGMNLLRAKSLEKNWDLNFGELARIWKGGCIIRAVFLDRIKKAYQRNPDLASLVVDPDFAKEMVQRQAAWRRVVGLAISAGISTPGMCASLAYFDTYRRARLPANLVQAQRDLFGAHTYERVDRPGAFHTEWTKLARKNA

SEQ ID NO: 3567 - protein, 487 aa, Helianthus annuus
MEAATLSRIGLAGLAVMGQNLALNIAEKGFPISVYNRTTSKVDETLDRAHNEGQLPLTGHYTPRDFVLSIQKPRSVIILVKAGAPVDQTIAALAAHMEPGDTIIDGGNEWYENTERRIVEAADKGLLYLGMGVSGGEEGARNGPSLMPGGSFEAYNNIKDIVAKVAAQVEDGPCVTYIGEGGSGNFVKMVHNGIEYGDMQLISEAYDVLKNVGGLSNDELAEIFDEWNRGELESFLIEITADIFKVKDEHGEGWLVDKILDKTGMKGTGKWTVQQAAELSVAAPTIAASLDCRYLSGLKDEREAAAKVLSDAGLKEEVGSVRSGIDKKRLIDDVRQALYASKICSYAQGMNLLRAKSVEKNWNLNFGELARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERVDREGAFHTEWTKLARKSG

SEQ ID NO: 3568 - protein, 487 aa, Arabidopsis lyrata
MESAALSRIGLAGLAVMGQNLALNIAEKGFPISVYNRTTSKVDETLDRASDEGNLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAARVLEDAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 3569 - protein, 487 aa, Arabidopsis lyrata
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILGKVAAQVEDGPCVTYIGEGGSGNFVKMVHNGIEYGDMQLISEAYDVLKNVGGFSNEELAEIFTEWNRGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKGWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNN

SEQ ID NO: 3570 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 3571 - protein, 487 aa, Eutrema halophilum
MESAALSRIGLAGLAVMGQNLALNIAEKGFPISVYNRTTSKVDETLDRASVEGNLPVSGQYSPRDFVLSIQRPRSLIILVKAGAPVDHTIAAFSEYMEPGDCIIDGGNEWYLNTERRISEAEQKGLLYIGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNRGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSSEKGWNLNFGELARIWKGGCIIRAVFLDRIKKAYQRNPDLASLVVDPDFAKEMVQRQAAWRRVVGLAVSAGISTPGMCASLAYFDTYRRARLPANLVQAQRDLFGAHTYERIDRPGAYHTEWSKLAKKST

SEQ ID NO: 3572 - protein, 214 aa, Brassica napus
MESAALSRIGLAGLAVMGQNLALNIADKGFPISVYNRTTSKVDETLDRASEEGKLPVSGQYSPRDFVLSIQRPRSVIILVKAGAPVDQTISALSEYMEPGDCIIDGGNEWYQNTERRIVEAEKKGLLYLGMGVSGGEEGARNGPSLMPGGSFQAYNNVKDILEKVAAQVEDGPCVTYIGEGGSGNFVKMVHNGIEYGDMQLISEAYDVLKNVGG

SEQ ID NO: 3573 - protein, 174 aa, Brassica napus
MESAALSRIGLAGLAVMGQNLALNIADKGFPISVYNRTTSKVDETLDRASEEGKLPVSGQYSPATSSSPSNAPDPSSSSSKPAPPLTRPSPPSPSTWSPVTASSTAETSGTRTQSEGSSKLRRKDCSTWGWESPEARKGLVTAPPSCLEDPSRRITMLKTFSRKSPLRWRMVLA

SEQ ID NO: 3574 - protein, 487 aa, Brassica rapa
MESAALSRIGLAGLAVMGQNLALNIADKGFPISVYNRTTSKVDETLDRASEEGKLPVSGQYSPRDFVLSIQRPRSVIILVKAGAPVDQTISALSEYMEPGDCIIDGGNEWYQNTERRIVEAEKKGLLYLGMGVSGGEEGARNGPSLMPGGSFQAYNNVKDILEKVAAQVEDGPCVTYIGEGGSGNFVKMVHNGIEYGDMQLISEAYDVLKNVGGLSNDELAEIFTEWNRGELESFLVEITSDIFRVKDEFGDGELVDKILDKTGMKGTGKWTVQQAAELSVAAPTIAASLDCRYLSGLKEERENAAKVLEEAGLKEDIGSASRGIDKKRLIDDVRQALYASKICSYAQGMNLLRAKSVEKEWGLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKGN

SEQ ID NO: 3575 - protein, 487 aa, Unknown
  Sequence found in Organisms: Brassica napus, Brassica rapa
MESAALSRIGLAGLAVMGQNLALNIAEKGFPISVYNRTTSKVDETLDRAAVEGNLPVSGQYSPRDFVLSLQRPRSLIILVKAGAPVDQTIAAFSEYMEPGDCIIDGGNEWYQNTERRISEAEQKGLLYLGMGVSGGEEGARNGPSLMPGGSFQAYDNIKDILGKVAAQVEDGPCVTYIGEGGSGNFVKMVHNGIEYGDMQLISEAYDVLKNVGGLSNEELAEIFTEWNRGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRSGAYHTEWTKLARKSN

SEQ ID NO: 3576 - protein, 576 aa, Brassica rapa
MKSKEEEEEEEDGGEGQKGKSFIEKLRRRAVSVGHRRVFRSPSTPAHISFNPNNSSSSKFASSSRKLAGSLWEFYQYYDQDHEIPPLAKMHRAPYSSGGDPSNRRLRHGHGKTAVRDNGALDLTDDQPESAGSIRKQIGQMLMKHHQLTQRNDHPLQPLSPASSLEVAPYKGAITPGSSLDLHGRRRAGEPNYNNLKTSTELLKVLNRIWTLEEQHSANISLIKALKSELAHARARIKELLRCQQADRREMDDLVKQLAEEKLSKDTKERDRLSSAVQQLEEERKLRRRSESLQRKLARELSEVKSTLSHCVDEMERGSKSKKMLERLCDEFARGIKSYEREVHGLKQKVDKSWEGWGEEDQMVLCIAETWLDERIQSAEVGSVLEKLALEIEAFLESKQKLSGNEVPKNRRSSLESAPFNAMSAPIQEVDSQEEEDSNCFELKKHGTVETRRSQSPSSLQVKFEDQMAWAMSNNEKKSKKKSRDIEAEKGEKERSNAVGEMIRTHRRLLSETQGIDEGSCSYQPSRRAESPIRHWNPRAMTSDLTAQGVKDNTLKAKLSEARTKSSRPRIRLFKG

SEQ ID NO: 3577 - protein, 487 aa, Arabidopsis thaliana
MESVALSRIGLAGLAVMGQNLALNIADKGFPISVYNRTTSKVDETLDRASNEGKLPVAGQYSPRDFVLSIQRPRSVIILVKAGAPVDQTISALSEYMEPGDCIIDGGNEWYQNTERRIVEAEKKGLLYLGMGVSGGEEGARNGPSLMPGGSFTAYNNVKDILEKVAAQVEDGPCVTYIGEGGSGNFVKMVHNGIEYGDMQLISEAYDVLKNVGGLSNDELAEIFTEWNRGELESFLVEITSDIFRVKDDYGDGELVDKILDKTGMKGTGKWTVQQAAELSVAAPTIAASLDCRYLSGLKDERENAAKVLEEAGLKEDIGSASRGVDKKRLIDDVRQALYASKICSYAQGMNLLRAKSLEKGWDLNLGEMARIWKGGCIIRAVFLDRIKKAYQRNPNLASLVVDPDFAKEMVQRQAAWRRVVGLAISAGISTPGMCASLAYFDTYRRARLPANLVQAQRDLFGAHTYERTDRPGAYHTEWTKLARKSQ

SEQ ID NO: 3578 - protein, 487 aa, Lactuca sativa
MEAAALSRIGLAGLAVMGQNLALNVAEKGFPISVYNRTTSKVDETLDRAHNEGQLPLTGHYTPRDFVLSIQKPRSVIILVKAGAPVDQTIEALAAHMEPGDTIIDGGNEWYENTERRIVEAENRGLLYLGMGVSGGEEGARNGPSLMPGGSYEAYNNIKDIVEKVAAQVEDGPCVTYIGEGGSGNFVKMVHNGIEYGDMQLISEAYDVLKNVGGLSNTELAEIFDEWNRGELESFLIEITADIFKVKDEHGEGELVDKILDKTGMKGTGKWTVQQAAELSVAAPTIAASLDCRYLSGLKDEREDAARILAAAGLKEEVGTVRSGIDKKRLIDDVRQALYASKICSYAQGMNLLRAKSSEKNWNLNFGELARIWKGGCIIRAVFLDRIKKAYQRNPNLASLLVDPDFAKEMVQRQAAWRRVVGLAISAGISTPGMCASLTYFDTYRRARLPANLVQAQRDLFGAHTYERIDREGAFHTEWTKLARKKA

SEQ ID NO: 3579 - protein, 267 aa, Ambrosia trifida
MEPGDTIIDGGNEWYENTERRIVEAADKGLLYLGMGVSGGEEGARNGPSLMPGGSFEAYNNIKDIVSKVAAQVEDGPCVTYIGEGGSGNFVKMVHNGIEYGDMQLISEAYDVLKNVGGLSNSELAEIFDEWNRGELESFLIEITADIFKVKDEHGEGELVDKILDKTGMKGTGKWTVQQAAELSVAAPTIAASLDGRYLSGLKDEREAASKILSDAGLKDEIGSVRSGIDKKRLIDDVRQALYASKICSYAQGMNLLRAKSVEKIGT

SEQ ID NO: 3580 - protein, 371 aa, Ambrosia trifida
QTLSNNSQHGRHCSLTHRLSRPSRHGPKPALNIAEKGFPISVYNRTTSKVDETLDRAHTEGQLPLTGHYTPKDFVLSIKKPRSVIILVKAGAPVDQTIAALAQHMEPGDTIIDGGNEWYENTERRIVEAADKGLLYLGMGVSGGEEGARNGPSLMPGGSFEAYNNIKDIVSKVAAQVEDGPCVTYIGEGGSGNFVKMVHNGIEYGDMQLISEAYDVLKNVGGLSNSELAEIFDEWNRGELESFLIEITADIFKVKDEHGEGELVDKILDKTGMKGTGKWTVQQAAELSVAAPTIAASLDGRYLSGLKEEREAASKILSDAGLKDEIGSVRSGIDKKRLIDDVRQALYASKICSYAQGMNLLRAKSVEKIGT

SEQ ID NO: 3581 - protein, 487 aa, Lactuca sativa
MEAAALSRIGLAGLAVMGQNLALNVAEKGFPISVYNRTTSKVDETLDRAHNEGQLPLTGHYTPRDFVLSIQKPRSVIILVKAGAPVDQTIEALAAHMEPGDTIIDGGNEWYENTERRIVEAENRGLLYLGMGVSGGEEGARNGPSLMPGGSYEAYNNIKDIVEKVAAQVEDGPCVTYIGEGGSGNFVKMVHNGIEYGDMQLISEAYDVLKNVGGLSNTELAEIFDEWNRGELESFLIEITADIFKVKDEHGEGELVDKILDKTGMKGTGKWTVQQAAELSVAAPTIAASLDCRYLSGLKDEREDAARILAAAGLKEEVGTVRSGIDKKRLIDDVRQALYASKICSYAQGMNLLRVKSSEKNWNLDFGELARIWKGGCIIRAVFLDRIKKAYQRNPNLASLLVDPDFAKEMVQRQAAWRRVVGLAISAGISTPGMCASLTYFDTYRRARLPANLVQAQRDLFGAHTYERIDREGAFHTEWTKLARKKA

SEQ ID NO: 3582 - protein, 489 aa, Cirsium arvense
PINGGRFSLSHRSRRTRRHGSKPSSQHRRERVSDLRLQSHHLKVDETLDRAHTEGQLPLTGHYTPRDFVLSIQKPRSVIILVKAGAPVDQTIAALAAHMEPGDTIIDGGNEWYENTERRMVEASEKGLLYLGMGVSGGEEGARNGPSMMPGGSYEAYNNIKEIVEKVAAQVEDGPCVTYIGEGGSGNFVKMVHNGIEYGDMQLISEAYDVLKNVGGLSNEELAEIFDEWNKGELESFLIEITADIFKVKDEHGDGELVDKILDKTGMKGTGKWTVQQAAELSVAAPTIAASLDCRFLSGLKDERVAAAEVLAAAGMKEEVGTIRSGVDKKRLIDDVRQALYASKICSYAQGMNLLRAKSVEKNWNLNFGELARIWKGGCIIRAVFLDRIKKAYQRNPNLASLVVDPDFAKEMVQRQAAWRRVVGLAVSAGISTPGMCASLSYFDTYRRARLPANLVQAQRDLFGAHTYERVDRAGSFHTEWTKLARKNA

SEQ ID NO: 3583 - protein, 392 aa, Vinca minor
MDPGDTIIDGGNEWYENTERRINEASAKGLLYLGMGVSGGEDGARNGPSLMPGGSHQAYTNIRDVIEKVAAQVEDGPCVTYIGEGGSGNFVKMVHNGIEYGDMQLISEAYDVLKNAGGLSNSELADIFAEWNRGELESFLIEITADIFNVKDYETGNGELVDKILDKTGMKGTGKWTVQQAAELSIAAPTIAASLDSRYLSGLKEEREAASKIFKEEGLKEEINNVGNVDKKRLIDDVRQALYASKICSYAQGMNLLRAKSIEKGWNLNLGELARIWKGGCIIRAVFLDRIKKAYQRNSGLANLLVDPEFAREMVQRQAAWRRVVGVAVQKGISVPGMSASLQYFDTYRRGRLPANLVQAQRDYFGAHTYERIDLPGAYHTEWAKLASKTKV

SEQ ID NO: 3584 - protein, 496 aa, Tropaeolum majus
MEASTALSRIGLAGLAVMGQNLALNIAEKGFPISVYNRTTSKVDETLDRANNEGHLPLSGHYSPLDFVLSIQRPRSVIILVKAGSPVDQTIATLSEHMEPGDCIIDGGNEWYQNTERRIEEAQQKNLLYLGMGVSGGEEGARNGPSLMPGGSFQAYNNVKDILEKVAAQVEDGPCVTYIGEGGAGNFVKMVHNGIEYGDMQLISEAYDVLKNVGGLTNEELAEIFTEWNKGELESFLVEITSDIFRVKDEDYGDGYLVDKILDKTGMKGTGKWTVQQAAELSVAAPTIAASLDCRYLSGLKDERENAAEVLKNAGLNEEVNTVSHGIDKKRLIDDVRQALYASKICSYAQGMNLLRAKSGEKGWNLNLGEMARIWKGGCIIRAVFLDRIKQAYQRNPNLPSLIVDPEFAREMVQRQAAWRRVVGLAISAGISTPGMCASLAYFDTYRRARLPANLVQAQRDLFGAHTYERIDRPGAYHTEWTKLARKNKGGVGAFN

SEQ ID NO: 3585 - protein, 495 aa, Theobroma cacao
MEASPALSRIGLAGLAVMGQNLALNVAEKGFPISVYNRTTSKVDETVQRAQEEGQLPLFGQYSPREFVLSVQRPRSVVILVKAGSPVDQTIAALSDHMEPGDCIIDGGNEWYENTERRIQEVSNKGLLYLGMGVSGGEEGARNGPSLMPGGSHQAYSNIKDILEKVAAQVEDGPCVTYIGEGGSGNFVKMVHNGIEYGDMQLISEAYDVLKHVGGLTNDELAEIFSEWNRGELESFLIEITSDIFRVKDELEDGYLVDKILDKTGMKGTGKWTVQQAAELSVAAPTIAASLDCRYLSGLKEERENAAGVLKEAGLKEEVGSLAQGIDKKRLIDDVRQALYASKICSYAQGMNLLRAKSVEKGWNLNLGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERTDRPGAFHTEWTKLARKSTAGVGALN

SEQ ID NO: 3586 - protein, 277 aa, Citrus sinensis
MEASALSRIGLAGLAVMGQNLALNVAEKGFPISVYNRTTSKVDETLDRAHREGQLPLTGHYTPRDFVLSIQRPRSVIILVKAGSPVDQTIAALSEHMSPGDCIIDGGNEWYLNTERRIHEASQKGLLYLGMGVSGGEEGARHGPSLMPGGSFEAYNNIRDILQKVAAQVDDGPCVTYIGEGGSGNFVKMVHNGIEYGDMQLISEAYDVLKHVGGVSNAELAEIFDEWNKGELESFLVEITADIFKVKDEYGEGELVDKILDKNRNERDRQMDRSASC

SEQ ID NO: 3587 - protein, 393 aa, Ambrosia trifida
MDATTLSRIGLAGLAVMGQNLALNIAEKGFPISVYNRTTSKVDETLDRAHTEGQLPLTGHYNPKDFVLSIKKPRSVIILVKAGAPVDQTIAALAEHMEPGDTIIDGGNEWYENTERRIVEAADKGLLYLGMGVSGGEEGARNGPSLMPGGSFEAYNNIKDIVSKVAAQVEDGPCVTYIGEGGSGNFVKMVHNGIEYGDMQLISEAYDVLKNVGGLSNSELAEIFDEWNRGELESFLIEITADIFKVKDEHGEGELVDKILDKTGMKGTGKWTVQQAAELSVAAPTIAASLDGRYLSGLKDEREAAAKVLSDAGLKDEIGSVRSGIDKKRLIDDVRQALYASKICSYAQGMNLLRAKSVEKIGLDFGELARIWKGRVYYQGGFLDRSSSIPAEP

SEQ ID NO: 3588 - protein, 495 aa, Cucumis sativus
MEASTALSRIGLAGLAVMGQNLALNIAEKGFPISVYNRTTSKVDETVDRAHNEGNLPLFGQYNPRDFVLSIQRPRSVIILVKAGLPVDQTIAALSDHLEPGDAIIDGGNEWYENTERRIAQASERGILYLGMGVSGGEDGARHGPSLMPGGSFQAYSNVQDILKKVAAQVDDGPCVTYIGEGGSGNFVKMVHNGIEYGDMQLISEAYDVLKHVGGLSNSELADIFSEWNRGELESFLIEISADIFKVKDEHGDGELVDKILDKTGMKGTGKWTVQQAAELSIAAPTIAASLDCRYLSGLKDERESAAEVLKEAGMTDSVGSVRSGIDKKKLIEDVRQALYASKICSYAQGMNLLRAKSLEKGWNLNFGELARIWKGGCIIRAVFLDRIKKAYQRNPNLASLLVDPEFAREMVQRQAAWRRVVGLAISAGISTPGMCASLAYFDTYRRARLPANLVQAQRDLFGAHTYERVDRQGSYHTEWTKLARSADAGVGIFN

SEQ ID NO: 3589 - protein, 190 aa, Cynara scolymus
  misc_feature (173)..(173): Xaa can be any naturally occurring amino acid
  misc_feature (188)..(188): Xaa can be any naturally occurring amino acid
MEAASLSRIGLAGLAVMGQNLALNIAEKGFPISVYNRTTSKVDETLDRAHTEGQLPLTGHYTPRDFVLSIQKPRSVIILVKVGAPVDQTIAALVAHMEPGDTIIDGGNEWYENTERRMVEASEKGLLYLGMGVSGGEEGARNGPSMMPGGSYEAYSNIKEIVEKVAAQVEDGXCVRILGKVDLVILLXGS

SEQ ID NO: 3590 - protein, 495 aa, Cajanus cajan
MESAALSRIGLAGLAVMGQNLALNIAEKGFPISVYNRTSSKVDETVDRARSEGSLPLTGQYTPRDFVLSLQRPRSVIILVKAGAPVDHTIAALSDHLEPGDCIIDGGNEWYENTERRIAHVADKGLLYLGMGVSGGEDGARHGPSLMPGGDRQAYNNIQDILTKVAAQVEDGPCVTYIGEGGSGNFVKMVHNGIEYGDMQLISEAYDVLKHVGGLSNSEIGDIFAEWNRGELESFLIEITADIFKVKDEDGEGFLVDKILDKTGMKGTGKWTVQQAAELSIAAPTIAASLDCRYLSGLKEERESAAAVLREAGLSDELGLGLGRSVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNGVGALN

SEQ ID NO: 3591 - protein, 495 aa, Ricinus communis
MEASVALSRIGLAGLAVMGQNLALNIAEKGFPISVYNRSTSKVDETIHRAQNEGPFPLTGHYTPRDFVLSLQRPRSVIILVKAGAPVDQTIAALSEHMEAGDCIIDGGNEWYQNTERRIDEANQKGLLYLGMGVSGGEEGARFGPSLMPGGSFEAYNNIKDILQKVAAQVEDGPCVTYIGEGGSGNFVKMVHNGIEYGDMQLISEAYDVLKNVGGLSNAELAEIFTEWNKGELESFLIEITSDIFRVKDEHGDGELVDKILDKTGMKGTGKWTVQQAAELSVAAPTIAASLDCRYLSGLKEERESAAQVLKEAGLKEEVEAVKSGIDKKRLIDDVRQALYASKICSYAQGMNLLRAKSVEKGWNLNFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERIDRPGSFHTEWTKLARKSNAGVGAFN

SEQ ID NO: 3592 - protein, 495 aa, Glycine max
MESAALSRIGLAGLAVMGQNLALNIAEKGFPISVYNRTASKVDETVDRARNEGSLPLTGQYTPRDFVLSLQRPRSVIILVKAGAPVDQTIAALSDHLDPGDCIIDGGNEWYENTERRMSLVADKGLLYLGMGVSGGEDGARHGPSLMPGGSHQAYSNVQDILHKIAAQVEDGPCVTYIGEGGSGNFVKMVHNGIEYGDMQLISEAYDVLKHVGGLSNSELADIFAEWNRGELESFLIEITADIFKVKDEDGEGFLVDKILDKTGMKGTGKWTVQQAAELSIAAPTIAASLDCRYLSGLKEERESAAAVLKEAGLSDELGRVSVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARKSGTGVGALN

SEQ ID NO: 3593 - protein, 494 aa, Gossypium hirsutum
EASPALSRIGLAGLAVMGQNLALNVAEKGFPISVYNRTTSKVDETVQRAQDEGQLPLFGHYTPREFVLSIKRPRSVVILVKAGSPVDQTIAALSDHMEPGDCIIDGGNEWYENTERRIQEVSNKGLLYLGMGVSGGEEGARNGPSLMPGGSHQAYSNIQDILEKVAAQVEDGPCVTYIGEGGSGNFVKMVHNGIEYGDMQLISEAYDVLKHVGGLSNDELAEIFAEWNRGELESFLIEITSDIFRVKDDLSDGFLVDKILDKTGMKGTGKWTVQQAAELSVAAPTIAASLDCRYLSGLKEERENAAEVLKEAGLKEEVGSLANGIDKKRLIDDVRQALYASKICSYAQGMNLLRAKSVEKGWNLNFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERIDRPGSFHTEWKKSAQKSNAGVGALN

SEQ ID NO: 3594 - protein, 495 aa, Ricinus communis
MEASVALSRIGLAGLAVMGQNLALNIAEKGFPISVYNRSTSKVDDTIHRAQNEGPFPLTGHYTPRDFVLSLQRPRSVIILVKAGAPVDQTIAALSEHMEAGDCIIDGGNEWYQNTERRIDEANQKGILYLGMGVSGGEEGARFGPSLMPGGSFEAYNNIKDILQKVAAQVEDGPCVTYIGEGGSGNFVKMVHNGIEYGDMQLISEAYDVLKNVGGLSNAELADIFTEWNKGELESFLIEITSDIFRVKDEHGDGELVDKILDKTGMKGTGKWTVQQAAELSVAAPTIAASLDCRYLSGLKEERESAAEVLKEAGLKEEVGTVKSGIDKKRLIDDVRQALYASKICSYAQGMNLLRAKSVEKRWNLNFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERIDRPGSFHTEWTKLARKSNAGVGAFN

SEQ ID NO: 3595 - protein, 495 aa, Euonymus alatus
MEASQALSRIGLAGLAVMGQNLALNIADKGFPITVYNRTGSKVDETLVRAHEEGQLPLTGKYTPRDFVLSLQRPRSIIILVKAGAPVDQTIAALADHMEPGDTIIDGGNEWYENTERRMQEAASRGLLYLGMGVSGGEEGARYGPSLMPGGSFQAYNNINDILQKVAAQVEDGPCVTYIGEGGSGNFVKMVHNGIEYGDMQLISEAYDVLKNVGGLTNAELAEIFDEWNKGELESFLIEITADIFKVKDEHGDGELVDKILDKTGMKGTGKWTVQQAAELSVAAPTIAASLDCRYLSGLKEERENAAEILKEAGLKEEVGSVRSGVDKKRLIDDVRQALYASKICSYAQGMNLLRAKSNEKGWNLNFGELARIWKGGCIIRAVFLDRIKKAYQRNPNLASLVVDPEFAREMVQRQAAWRRVVGLAISAGISTPGMCASLSYFDTYRRARLPANLVQAQRDLFGAHTYERVDRPGSFHTEWTKLARKSNAGVGALN

SEQ ID NO: 3596 - protein, 494 aa, Vitis vinifera
MEASTLSRIGLAGLAVMGQNLALNIAEKGFPISVYNRTTSKVDETLDRAHREGHLPLSGHYSPRDFVLSIQRPRSIVILVKAGAPVDQTIAALSEHMEAGDCIIDGGNEWYENTERRIVEASGKGILYLGMGVSGGEEGARHGPSLMPGGSYQAYQNIEDIVKKVAAQVDDGPCVTYIGEGGSGNFVKMVHNGIEYGDMQLISEAYDVLKNVGGLSNSELSDIFGEWNRGELESFLIEITADIFKVKDEHGDGELVDKILDKTGMKGTGKWTVQQAAELSVAAPTIAASLDCRYLSGLKEEREAAAGVLSEAGLKDEVGFARSGVDKKRLIDDVRQALYASKICSYAQGMNLLRAKSVEKGWNLNFGELARIWKGGCIIRAVFLDRIKKAYQRNPNLASLIVDPEFAREMVQRQAAWRRVVGLAISAGISTPGMCASLAYFDTYRRARLPANLVQAQRDLFGAHTYERIDRPGSFHTEWTKLARKSDAGFATLK

SEQ ID NO: 3597 - protein, 495 aa, Tripterygium wilfordii
METSQALSRIGLAGLAVMGQNLALNIAEKGFPITVYNRTGSKVDETLVRAHEEGQLPLTGKYTPRDFVLSLQRPRSVIILVKAGAPVDQTIAALADHMEPGDTIIDGGNEWYENTERRMQEAASRGLLYLGMGVSGGEEGARQGPSLMPGGSFQAYNNINDILQKVAAQVEDGPCVTYIGEGGSGNFVKMVHNGIEYGDMQLISEAYDVLKNVGGLTNAELAEIFDEWNKGELESFLIEITADIFKVKDEHGDGELVDKILDKTGMKGTGKWTVQQAAELSVAAPTIAASLDCRYLSGLKEERENAAEVLKEAGLKEEVGSVRSGVDKKRLIDDVRQALYASKICSYAQGMNLLRAKSNEKGWNLNFGELARIWKGGCIIRAVFLDRIKKAYQRNSNLASLVVDPEFAREMVQRQAAWRRVVGLAISAGISTPGMCASLSYFDTYRRARLPANLVQAQRDLFGAHTYERVDRPGSFHTEWTKLARNTNAGVGAFN

SEQ ID NO: 3598 - protein, 495 aa, Gossypium raimondii
MEASPALSRIGLAGLAVMGQNLALNVAEKGFPISVYNRTTSKVDETVQRAQDEGQLPLFGHYTPREFVLSIKRPRSVVILVKAGSPVDQTIAALSDHMEPGDCIIDGGNEWYENTERRIQEVSNKGLLYLGMGVSGGEEGARNGPSLMPGGSHQAYSNIQDILEKVAAQVEDGPCVTYIGEGGSGNFVKMVHNGIEYGDMQLISEAYDVLKHVGGLSNDELAEIFAEWNRGELESFLIEITSDIFRVKDDLSDGFLVDKILDKTGMKGTGKWTVQQAAELSVAAPTIAASLDCRYLSGLKEERENAAEVLKEAGLKEEVGSLAKGIDKKRLIDDVRQALYASKICSYAQGMNLLRAKSVEKGWNLNFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERIDRPGSFHTEWKKSAQKSNAGVGALN

SEQ ID NO: 3599 - protein, 495 aa, Gossypium hirsutum
MEASPALSRIGLAGLAVMGQNLALNVAEKGFPISVYNRTTSKVDETVQRAQDEGQLPLFGHYTPREFVLSIKRPRSVVILVKAGSPVDQTIAALSDHMEPGDCIIDGGNEWYENTERRIQEVSNKGLLYLGMGVSGGEEGARNGPSLMPGGSHQAYSNIQDILEKVAAQVEDGPCVTYIGEGGSGNFVKMVHNGIEYGDMQLISEAYDVLKHVGGLSNDELAEIFAEWNRGELESFLIEITSDIFRVKDDLSDGFLVDKILDKTGMKGTGKWTVQQAAELSVAAPTIAASLDCRYLSGLKEERENAAEVLKEAGLKEEVGSLAKGIDKKRLIDDVRQALYASKICSYAQGMNLLRAKSVEKGWNLNFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERIDRPGSFHTEWKKYAQKSNAGVGALN

SEQ ID NO: 3600 - protein, 495 aa, Citrullus lanatus
MEASPALSRIGLAGLAVMGQNLALNIAEKGFPISVYNRTTSKVDETVDRAHNEGNLPLFGQYNPRDFVLSIQRPRSVIILVKAGLPVDQTIAALSDHLEPGDAIIDGGNEWYENTERRIAQASERGILYLGMGVSGGEDGARHGPSLMPGGSFQAYSNVEDILKKVAAQVDDGPCVTYIGEGGSGNFVKMVHNGIEYGDMQLISEAYDVLKHVGGLSNSELADIFSEWNRGELESFLIEISADIFKVKDEHGDGELVDKILDKTGMKGTGKWTVQQAAELSIAAPTIAASLDCRYLSGLKEERENAAEVLKEAGLNDSVGSVRSGIDKKKLIEDVRQALYASKICSYAQGMNLLRAKSLEKGWNLNLGELARIWKGGCIIRAVFLDRIKKAYQRNPNLASLLVDPEFAREMVQRQAAWRRVVGLAISAGISTPGMCASLAYFDTYRRARLPANLVQAQRDLFGAHTYERVDRQGSYHTEWTKLARNADAGVGIFN

SEQ ID NO: 3601 - protein, 494 aa, Fragaria vesca
MEASTALSRIGLAGLAVMGQNLALNIAEKGFPISVYNRTSSKVDETVHRAATEGDLPLSGQYTPKDFVLSLQRPRSVIILVKAGAPVDQTIAALSAYMEPGDAIIDGGNEWYENTERRIHEASAKGLLYLGMGVSGGEEGARHGPSLMPGGSHQAYSNVQDILHKVAAQVEDGPCVTYIGEGGSGNFVKMVHNGIEYGDMQLISEAYDVLKNIGGLSNSELAQIFEEWNRGELESFLVEITADIFKVKDDLADGFLVDKLLDKTGMKGTGKWTVQQAAELSVAAPTIAASLDCRFLSGLKEERESAEEALKEAGFKEEIGNVVSGIDKKRLIDDVRQALYASKICSYAQGMNLLRAKSMEKGWNLNLGELARIWKGGCIIRAVFLDRIKNAYQRNQGLPNLIVDPDFAKEMVQRQAAWRRVVGLAVAAGISTPGMCASLSYFDTYRRGRLPANLVQAQRDLFGAHTYERVDRPGSFHTEWTKLAQKSSGVGALN

SEQ ID NO: 3602 - protein, 495 aa, Glycine max
MESAALSRIGLAGLAVMGQNLALNIAEKGFPISVYNRTASKVDQTVDRARNEGSLPLTGQYTPRDFVLSLQRPRSVIILVKAGSPVDHTIAALSDHLDPGDCIIDGGNEWYENTERRMNLVADKGLLYLGMGVSGGEDGARHGPSLMPGGSHHAYSNVQDILHKIAAQVEDGPCVTYIGEGGSGNFVKMVHNGIEYGDMQLISEAYDVLKHVGGLSNSELAEIFVEWNRGELESFLIEITADIFKVKDEDGEGFLVDKILDKTGMKGTGKWTVQQAAELSIAAPTIAASLDCRYLSGLKEERESAAAVLKEAGLSDELGRVNVSGVDKKRLIDDVRQALYASKICSYAQGMNLLRAKSNEKGWNLNLGELARIWKGGCIIRAVFLDRIKKAYQRNPNLASLIVDPEFAREMVQRQAAWRRVVGLAVSAGISTPGMCASLAYFDTYRRARLPANLVQAQRDLFGAHTYERVDRPGAFHTEWTKLARNSGAGVGALN

SEQ ID NO: 3603 - protein, 495 aa, Trigonella foenum-graecum
MDASTLSRIGLAGLAVMGQNLALNIAEKGFPISVYNRTTSKVDETVDRAHREGSLPLTGQYSPREFVLSLQRPRSVIILVKAGAPVDQTIAALSDHMEPGDCIIDGGNEWYENTERRIQQISEKGILYLGMGVSGGEEGARNGPSLMPGGSYQAYSNIQDILMKVAAQVEDGPCVTYIGEGGSGNFVKMVHNGIEYGDMQLISEAYDVLKHVGGLSNSEIADIFAEWNSGELESFLIEITADIFKVKDEGGDGYLVDKILDKTGMKGTGKWTVQQAAELSVAAPTIAASLDCRYLSGLKEERENAAAVLKEAGLSEEVGGFVRSGVDKKRLIDDVRQALYASKICSYAQGMNLLRAKSDEKGWNLNFGELARIWKGGCIIRAVFLDRIKKAYQRNPNLASLIVDPEFAKEMVQRQGAWRRVVGLAISAGISTPGMCASLAYFDTYRRARLPANLVQAQRDLFGAHTYERLDRPGAFHTEWAKLARQSGTGAAALN

SEQ ID NO: 3604 - protein, 399 aa, Medicago truncatula
MEPGDCIIDGGNEWYENTERRIQQISEKGILYLGMGVSGGEEGARNGPSLMPGGSYQAYSNIQDILTKVAAQVEDGPCVTYIGEGGSGNFVKMVHNGIEYGDMQLISEAYDVLKHVGGLSNSELADIFAEWNSGELESFLIEITADIFKGKDEGGDGYLVDKILDKTGMKGTGKWTVQQAAELSVAAPTIAASLDCRYLSGLKEERENAAAVLKEAGLGEEVGGFVRSGVDKKRLIDDVRQALYASKICSYAQGMNLLRAKSDEKGWNLNFGELARIWKGGCIIRAVFLDRIKKAYQRNPNLASLIVDPEFAKEMVQRQGAWRRVVGLAISAGISTPGMCASLAYFDTYRRARLPANLVQAQRDLFGAHTYERLDRPGAFHTEWTKLARQSGTGAAALN

SEQ ID NO: 3605 - protein, 494 aa, Citrus clementina
MEASALSRIGLAGLAVMGQNLALNVAEKGFPISVYNRTTSKVDETLDRAHREGQLPLTGHYTPRDFVLSIQRPRSVIILVKAGSPVDQTIAALSEHMSPGDCIIDGGNEWYLNTERRIHEASQKGLLYLGMGVSGGEEGARHGPSLMPGGSFEAYNNIRDILQKVAAQVDDGPCVTYIGEGGSGNFVKMVHNGIEYGDMQLISEAYDVLKHVGGVSNAELAEIFDEWNKGELESFLVEITADIFKVKDEYGEGELVDKILDKTGMKGTGKWTVQQAAELSVAAPTIAASLDCRYLSGLKEEREKAAKVLKEAGLKDEVQNVGVHVDKKRLIDDVRQALYASKICSYAQGMNLLRSKSNEKGWNLNFGELARIWKGGCIIRAVFLDRIKKAYQRNPNLASLVVDPEFAREMVQRQAAWRRVVGLAISAGISTPGMCASLSYFDTYRRARLPANLVQAQRDLFGAHTYERIDRPGSFHTEWTKLARQTGAGVGAFN

SEQ ID NO: 3606 - protein, 495 aa, Prunus persica
MEASPALSRIGLAGLAVMGQNLALNIAEKGFPISVYNRTTSKVDETVDRAHNEGNLPLFGQNNPRDFVLSIQRPRSVIILVKAGAPVDQTIAALSAHMEPGDAIIDGGNEWYENTERRIAEATGRGLLYLGMGVSGGEEGARHGPSLMPGGSHQAYTNVQDILHKVAAQVEDGPCVTYIGEGGSGNFVKMVHNGIEYGDMQLISEAYDVLKNVGGLSNEELGEIFAEWNKGELESFLIEITADIFKVRDDLADGFLVDKLLDKTGMKGTGKWTVQQAAELSVAAPTIAASLDCRYLSGLKEEREKAEETLKQAGFKEVIGSVTSGIDKKRLIDDVRQALYASKICSYAQGMNLLRAKSVEKGWGLNLGELARIWKGGCIIRAVFLDRIKNAYQRNQNLPNLIVDPDFAKEMVQRQAAWRRVVGLAVSAGISTPGMCASLSYFDTYRRGRLPANLVQAQRDLFGAHTYERVDRPGAFHTEWTKLAQKSGSGVGALN

SEQ ID NO: 3607 - protein, 471 aa, Eutrema halophilum
LGQNLALNIAEKGFPISVYNRTTSKVDETLDRASVEGNLPVSGQYSPRDFVLSIQRPRSLIILVKAGAPVDQTIAAFSEYMEPGDCIIDGGNEWYLNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNQGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSSEKGWNLNFGELARIWKGGCIIRAVFLDRIKKAYQRNPDLASLVVDPDFAKEMVQRQAAWRRVVGLAVAAGISTPGMCASLAYFDTYRRARLPANLVQAQRDLFGAHTYERIDRPGAYHTEWSKLAKKST

SEQ ID NO: 3608 - protein, 493 aa, Euonymus alatus
MEASQALSRIGLAGLAVMGQNLALNIAEKGFPITVYNRTGSKVDETLVRAHEEGKLPLTGKYTPRDFVLSLQRPRSVIILVKAGAPVDQTIAALADHMEPGDTIIDGGNEWYENTERRMQEASSRGLLYLGMGVSGGEEGARYGPSLMPGGSFQAYNNIEDILHKVAAQVEDGPCVTYIGEGGSGNFVKMVHNGIEYGDMQLISEAYDVLKNVGGLTNGELAEIFDEWNKGELESFLIEITADIFKVKDEHGDGELVDKILDKTGMKGTGKWTVQQAAELSVAAPTIAASLDCRYLSGLKEERENAAAVLKEAGLKEEAGSVRSGVDKKSLIDDVRKALYASKICSYAQGMNLLRAKSNEKDWNLNFGELARIWKGGCIIRAVFLDRIKKAYQRNPNLASLVVDPEFAREMVQRKAAWRRVVGLAISAGISTPGMCASLCYFDTYRRARLPANLVQAQRDLFGAHTYERVDRPGSFHTEWTKLARNTDAGAFN

SEQ ID NO: 3609 - protein, 492 aa, Platanus occidentalis
STALSRIGLAGLAVMGQNLALNIAEKGFPISVYNRTTSKVDETIERAKQEGNLPLIGQYSPRDFVLSLQRPRSVIILVKAGSPVDQTIAALSEFMDSGDCIIDGGNEWYENTERRTREVADKGILYLGMGVSGGEEGARHGPSLMPGGSYQAYLNIEDIVKKVAAQVEDGPCVTYIGEGGSGNFVKMVHNGIEYGDMQLISEAYDVLKVVGGLSNSELAEIFADWNRGELESFLIEITADIFKVKDDYGEGELVDKILDKTGMKGTGKWTVQQAAELSVAAPTIAASLDCRYLSGLKEEREAAAEVLKEAGMKEEVGAVRSGIDKKRLIDDVRQALYASKICSYAQGMNLLRAKSVEKGWNLNFGELARIWKGGCIIRAVFLDRIKKAYQRNPQLASLVVDPEFAREMVQRQAAWRRVVGLAISAGISTPGMCASLAYFDTYRRARLPANLVQAQRDLFGAHTYERIDRPGSFHTEWTKLARQSKTSVGAFN

SEQ ID NO: 3610 - protein, 497 aa, Lotus japonicus
MESSIAASRIGLGGLAVMGQNLALNIADKGFPISVYNRTTSKVDETVDRAHREGSLPLIGQYNPRDFVLSLQRPRSVIILVKAGAPVDQTIAGLSEHLEPGDCIIDGGNEWYENTERRIQTVTEKGLLYLGMGVSGGEEGARNGPSLMPGGSFQAYNNIQDILFKVAAQVEDGPCVTYIGEGGSGNFVKMVHNGIEYGDMQLISEAYDVLKHVGGLSNSELADIFGEWNRGELESFLIEITADIFKVKDEEFGADGYLVDKILDKTGMKGTGKWTVQQAAELSVAAPTIAASLDCRFLSGLKEERENAAAVLKEAGLSEGEEVGSVRVDKKRLIDDVRQALYASKICSYAQGMNLLRAKSNEKGWGLNFGELARIWKGGCIIRAVFLDRIKKAYQRNPNLASLIVDPEFAKEMVQRQAAWRRVVGLAISAGISTPGMCASLAYFDTYRRARLPANLVQAQRDLFGAHTYERVDRPGNFHTEWTKLARKSGTGVGALN

SEQ ID NO: 3611 - protein, 497 aa, Quercus alba
MATPALSHIGLAGLAVMGQNLALNIAEKGFPISVYNRTASKVDETHHRAQSEGDLPLTPHYTPRDFVLSIQRPRSIIILVKAGSPVDQTIAALSSFMEPGDSIIDGGNEWYLNTERRIEQASTQGLLYLGMGVSGGEEGARYGPSLMPGGSYQAYSNVQNILQRVAAQVDDGPCVTYIGEGGSGNFVKMVHNGIEYGDMQLISEAYDVLKNIGGLSNSELADIFAEWNRGELESFLVEITADIFRVKDEFGEGELVDKVLDKTGMKGTGKWTVQQAAELSIAAPTIAASLDGRYMSGLKEERESAAAALREAGLKEDEQLGGVKKGIDKKRLIDDVRQALYASKICSYAQGMNLLRAKSVEKGWDLNLGELARIWKGGCIIRAVFLDRIKKAYKRNPNLASLVVDPEFAREMVQRQAAWRRVVGLAVSAGISTPGMCASLSYFDTYRRARLPANLVQAQRDLFGAHTYERIDRPGSFHTEWTKLARTSENSGVAALN

SEQ ID NO: 3612 - protein, 496 aa, Fagus grandifolia
MEAATPALSHIGLAGLAVMGQNLALNIAEKGFPISVYNRTASKTDETLQRAHNEGALPLTGHYTPQDFVLSIQRPRSIIILVKAGSPVDQTISALSSFMEPGDSIIDGGNEWYLNTERRIDHVSSQGLLYLGMGVSGGEEGARFGPSLMPGGSYQAYTNVQNILQKVAAQVDDGPCVTYIGEGGSGNFVKMVHNGIEYGDMQLISEAYDVLKNIGGLSNRELAEIFDEWNRGELESFLVEITADIFRVKDEYGEGELVDKVLDKTGMKGTGKWTVQQAAELSIAAPTITASLDGRFLSALKEERESAAEALRNAGLNEDEELGAVKKGIDKKRLIDDVRQALYASKICSYAQGMNLLRAKSVEKSWDLNFGELARIWKGGCIIRAVFLDRIKKAYQRNPNLASLVVDPEFAKEMVQRQAAWRRVVGLAVSAGISTPGMCASLSYFDTYRRARLPANLVQAQRDLFGAHTYERIDRPGSFHTEWTKLARNAGVGALN

SEQ ID NO: 3613 - protein, 494 aa, Cicer arietinum
MDSSTLSRIGLAGLAVMGQNLALNIAEKGFPISVYNRTTSKVDETVDRAHREGSLPLTGQYSPREFVLSLQRPRSVIILVKAGNPVDQTIAALSDHMEPGDCIIDGGNEWYENTERRIQQISNKGILYLGMGVSGGEEGARNGPSLMPGGSYQAYSNIQDILMKVAAQVEDGPCVTYIGEGGAGNFVKMVHNGIEYGDMQLISEAYDVLKHVGGLSNSELADIFAEWNSGELESFLVEITADIFKVKDDIGDGYLVDKILDKTGMKGTGKWTVQQAAELSVAAPTIAASLDCRYLSGLKEERENASAVLKEAGLNEEAGFVKSGIDKKRLIDDVRQALYASKICSYAQGMNLLRAKSDEKGWNLNLGELARIWKGGCIIRAVFLDRIKKAYQRNPNLASLIVDPEFAKEMVQRQGAWRRVVGLAISAGISTPGMCASLAYFDTYRRARLPANLVQAQRDLFGAHTYERLDRPGAFHTEWTKIARQSGTGVAALN

SEQ ID NO: 3614 - protein, 490 aa, Papaver somniferum
MEASAGLSRIGLAGLAVMGQNLALNIAEKGFPISVYNRTTSKVDETIERAKSEGDLPLTGHYSPRDFVLSLQKPRSVIILVKAGTPVDQTISTLSEYMEEGDTIIDGGNEWYENTERRIRETEQKGILYLGMGVSGGEEGARNGPSMMPGGSLTAYKNIEEIVKKVAAQVEDGPCVTYIGEGGSGNFVKMVHNGIEYGDMQLISEAYDVLKNVGGLSNEELARIFDEWNKGELESFLVEITADIFKVKDDLSEGELVDKILDKTGMKGTGKWTVQQAAELSVAAPTIAASLDCRYLSGLKEERENAEAILKEAGMVDQVGPVRSGIDKKRLIDDVRQALYASKICSYAQGMNLLRAKSNEKGWGLDLGEMARIWKGGCIIRAVFLDRIKQAYQRNPQLASLVVDPEFAKEMVQRQAAWRRVVGLAVQAGISTPGMCASLAYFDTYRRARLPANLVQAQRDLFGAHTYERIDRPGAFHTEWTKLARQSNFK

SEQ ID NO: 3615 - protein, 496 aa, Aquilegia formosa
MDASAAGLSRIGLAGLAVMGQNLALNIADKGFPISVYNRTTSKVDETLERAKHEGDLPLTGHYSPRDFVLSIQRPRSVVILVKAGSPVDQTISALSEYMESGDTIIDGGNEWYENTERRMREVADKGILYLGMGVSGGEEGARNGPSLMPGGSYQAYLNVEDIVKKVAAQVEDGPCVTYIGEGGSGNFVKMVHNGIEYGDMQLISEAYDVLKNVGGLSNSELADIFAEWNRGELESFLIEITADIFKVQDEHGNGELVDKILDKTGMKGTGKWTVQQAAELSVAAPTIAASLDCRYLSGLKEEREVAAAVLKEAGMQDVFGAAMPNIDKKRLIDDVRQALYASKICSYAQGMNLLRAKSVEQSWNLNFGELARIWKGGCIIRAVFLDRIKKAYQRNPQLASLIVDPDFAKEMVQRQAAWRRVVGLAIQAGISTPGMCASLAYFDTYRRARLPANLVQAQRDLFGAHTYERIDRPGAFHTEWTKLARQGKTGMGVLH

SEQ ID NO: 3616 - protein, 494 aa, Populus trichocarpa
MDASTLSRIGLAGLAVMGQNLALNIAEKGFPISVYNRTTSKVDETLHRAQSEGPFPLTGQYSPRDFVLSIQRPRSIIILVKAGNPVDQTISALTEFMEPGDTIIDGGNEWYQNTERRIQEVGDKGILYLGMGVSGGEEGARHGPSLMPGGSLEAYNNIESVLKSVAAQVDDGPCVTYIGEGGSGNFVKMVHNGIEYGDMQLISEAYDVLKNVGGLSNGELAEIFGEWNRGELESFLIEITSDIFKVKDDLADGDLVDKILDKTGMKGTGKWTVQQAAELSVAAPTIAASLDCRYLSGLKEERESAAEILEKAGLKEEMGSVKSEIDKKRLIDDVRQALYASKICSYAQGMNLLRSKSVEKGWDLNLGELARIWKGGCIIRAVFLDRIKKAYQRNPSLASLVVDPEFAREMVQRQAAWRRVVGLAISAGISTPGMCASLAYFDTYRRARLPANLVQAQRDLFGAHTYERTDRPGAFHTEWTKLARKSNAGFGAFN

SEQ ID NO: 3617 - protein, 489 aa, Papaver somniferum
EASAGLSRIGLAGLAVMGQNLALNIAEKGFPISVYNRTTSKVDETIERAKSEGDLPLTGHYSPRDFVLSLQKPRSVIILVKAGTPVDQTISTLSEYMEEGDTIIDGGNEWYENTERRIRETEQKGILYLGMGVSGGEEGARNGPSMMPGGSLTAYKNIEEIVKKVAAQVEDGPCVTYIGEGGSGNFVKMVHNGIEYGDMQLISEAYDVLKNVGGLSNEELARIFDEWNKGELESFLVEITADIFKVKDDLSEGELVDKILDKTGMKGTGKWTVQQAAELSVAAPTIAASLDCRYLSGLKEERENAEAILKEAGMVDQVGPVRSGIDKKRLIDDVRQALYASKICSYAQGMNLLRAKSNEKGWGLDLGEMARIWKGGCIIRAVFLDRIKQAYQRNPQLASLVVDPEFAKEMVQRQAAWRRVVGLAVQAGISTPGMCASLAYFDTYRRARLPANLVQAQRDLFGAHTYERIDRPGAFHTEWTKLARQSNFK

SEQ ID NO: 3618 - protein, 478 aa, Castanea mollissima
MATPALSHIGLAGLAVMGQNLALNIAEKGFPISVYNRTASKVDETHHRAQTEGDLPLTPHYTPRDFVLSIQRPRSIIILVKAGSPVDQTIAALSSFMDPGDSIIDGGNEWYLNTERRIQQVSSQGLLYLGMGVSGGEEGARYGPSLMPGGSFQAYSNVQNILQRVAAQVDDGPCVTYIGEGGSGNFVKMVHNGIEYGDMQLISEAYDVLKNIGGLSNSELADIFAEWNRGELESFLVEITADIFRVRDEFGEGELVDKVLDKTGMKGTGKWTVQQAAELSIAAPTIAASLDGRYMSGLKEERESAAAALREAGLKEEEQLGGVKKGIDKKRLIDDVRQALYASKICSYAQGMNLLRAKSVEKGWDLNLGELARIWKGGCIIRAVFLDRIKKAYQRNPNLASLVVDPEFAREMVQRQAAWRRVVGLAVSAGISTPGMCASLSYFDTYRRARLPANLVQAQRDLFGAHTYERIDRPGSFH

SEQ ID NO: 3619 - protein, 215 aa, Papaver somniferum
MEASAGLSRIGLAGLAVMGQNLALNIAEKGFPISVYNRTTSKVDETIERAKSEGDLPLTGHYSPRDFVLSLQKPRSVIILVKAGTPVDQTISTLSEYMEEGDTIIDGGNEWYENTERRIRETEQKGILYLGMGVSGGEEGARNGPSMMPGGSLTAYKNIEEIVKKVAAQVEDGPCVTYIGEGGSGNFVKMVHNGIEYGDMQLISEAYDVLKNVGG

SEQ ID NO: 3620 - protein, 490 aa, Papaver somniferum
MEASAGLSRIGLAGLAVMGQNLALNIAEKGFPISVYNRTTSKVDETIERAKSEGDPPLTGHYSPRDFVLSLQKPRSVIILVKAGTPVDQTISTLSEYMEEGDTIIDGGNEWYENTERRIRETEQKGILYLGMGVSGGEEGARNGPSMMPGGSLMAYKNIEEIVKKVAAQVEDGPCVTYIGEGGSGNFVKMVHNGIEYGDMQLISEAYDVLKNVGGLSNEELARIFDEWNKGELESFLVEITADIFKVKDDLSEGELVDKILDKTGMKGTGKWTVQQAAELSVAAPTIAASLDCRYLSGLKEERENAEAILKEAGMVDQVGPVRSGIDKKRLIDDVRQALYASKICSYAQGMNLLRAKSNEKGWGLDLGEMARIWKGGCIIRAVFLDRIKQAYRRNPQLASLVVDPEFAKEMVQRQAAWRRVVGLAVQAGISTPGMCASLAYFDTYRRARLPANLVQAQRDLFGAHTYERIDRPGAFHTEWTKLARQSNFK

SEQ ID NO: 3621 - protein, 492 aa, Populus trichocarpa
MDASTLSRIGLAGLAVMGQNLALNIAEKGFPISVYNRTTSKVDETLIRAQSEGPFSLTGHYSPRDFVLSIQRPRSIIILVKAGNPVDQTISALTEFMEPGDTIIDGGNEWYQNTERRIQQVADKGILYLGMGVSGGEEGARHGPSLMPGGSFEAYKNIESVLKSVAAQVDDGPCVTYIGEGGSGNFVKMVHNGIEYGDMQLISEAYDVLKNVGGLSNSELAEIFGEWNRGELESFLIEITSDIFKVKDNLVDGDLVDKILDKTGMKGTGKWTVQQAAELSVAAPTIAASLDCRYLSGLKEERESAAEILKEAGLEEEVGSVKSGVDKKRLIDDVRKALYASKICSYAQGMNLLRAKSVEKGWDLDFGELARIWKGGCIIRAVFLDRIKKAYQRNPNLASLVVDPEFAREMVQRQAAWRRVVGLAISAGISTPGMCASLAYFDTYRRARLPANLVQAQRDLFGAHTYERTDRPGAFHTEWTKLARKSSAGAFS

SEQ ID NO: 3622 - protein, 499 aa, Aristolochia fimbriata
MDASALALSQIGLAGLAVMGQNLALNIAEKGFPISVYNRTSSKVDETVSRAQQEGGLPLAGHYSPRDFVLSIKRPRSIVILVKAGAPVDQTISALSQFMEPGDAIIDGGNEWYENTERRMEEADQRGLLYLGMGVSGGEEGARRGPSLMPGGSYQAYENVRDIVQKVAAQVDDGPCVTYVGPGGSGNFVKMVHNGIEYGDMQLISEAYDVLKTVGGLSNSELADIFSEWNRGELESFLIEITADIFKVKDDLAGEGELVDKILDKTGMKGTGKWTVQQAAELSIAAPTIAASLDCRYLSGLKEERENASRVLEDAGIGRPGEVLLGRSVDKKRLIDDVRQALYASKICSYAQGMNLLRAKSVEKAWDLNLGELARIWKGGCIIRAVFLDRIKKAYERNRELPNLVVDPEFAREMVQRQAAWRRVVGLAIEAGISTPGMCASLAYFDTYRRARLPANLVQAQRDLFGAHTYERVDRSGSFHTEWTKIARQSKPGAVGAFN

SEQ ID NO: 3623 - protein, 237 aa, Phaseolus coccineus
MESAALSRIGLAGLAVMGQNLALNIAEKGFPISVYNRTASKVDETVDRARNEGFLPLTGQYNPREFVLSIQRPRSVIILVKAGAPVDQTIAALSDHLEPGDCIIDGGNEWYENTERRISQVADKGLLYLGMGVSGGEDGARYGPSLMPGGSKTAYNNVHDILHKIAAQVDDGPCVTYIGEGGSGNFVKMVHNGIEYGDMQLISEAYDVLKHVGGLSNSELADINAEWPLRPGSLRVS

SEQ ID NO: 3624 - protein, 492 aa, Amborella trichopoda
MEVATLSRIGLAGLAVMGQNLALNIAEKGFPISVYNRTTSKVDDTVHRADAEGGLPLLGHRSPQDFILSIQRPRSVVILVKAGRPVDQTIATLSAFMEPGDCLIDGGNEWYENTERRIEEASARGLLYLGMGVSGGEEGARNGPSLMPGGSFDAYQNIRDILEKVAAQVSDGPCVTYIGPGGSGNFVKMVHNGIEYGDMQLISEAYDVLKHVGGLSNQELVEIFEGWNRGELESFLIEITSDIFRVKDEFGEGELVDKILDKTGMKGTGKWTVQQAAELSVAAPTIAASLDCRYLSGLKEEREAASKAFSEFGLSEVLARPAVDKKKLIEDVRQALYASKICSYAQGMNLLRAKSVEKGWGLNLGELARIWKGGCIIRAVFLDRIKKAYERNRELPNLMVDPEFAREMVQRQAAWRRVVGLAIEAGISTPGMNASLAYFDSYRRARLPANLVQAQRDLFGAHTYERIDRPGSYHTEWTKLARQNKAGVSALN

SEQ ID NO: 3625 - protein, 505 aa, Citrus sinensis
MEASALSRIGLAGLAVMGQNLALNVAEKGFPISVYNRTTSKVDETLDRAHREGQLPLTGHYTPRDFVLSIQRPRSVIILVKAGSPVDQTIAALSEHMSPGDCIIDGGNEWYLNTERRIHEASQKGLLYLGMGVSGGEEGARHGPSLMPGGSFEAYNNIRDILQKVAAQVDDGPCVTYIGEGGSGNFVKMVHNGIEYGDMQLISEAYDVLKHVGGLSNAELAEIFDEWNKGELESFLVEITADIFKVKDEYGEGELVDKILDKTGMKGTGKWTVQQAAELSVAAPTIAASLDCRYLSGLKEEREKAAKVLKEAGLKDEVQNVGVHVDKKRLIDDVRQALYASKICSYAQGMNLLRSKSNEKGWNLNFGELARIWKGGCIIRAVFLDRIKKAYQRNPNLASLVVDPEFAREMVQRQAAWRRVVGLAISAGISTPGMCASLSYFDTYRRARLPANLVQAQRDLFGAHTYERIDRPGSFHTEWTKLPARLVPVLVRSIELLPFVACLFD

SEQ ID NO: 3626 - protein, 489 aa, Silene vulgaris
MAAVTPAQIGLAGLAVMGQNLALNIAEKGFPISVYNRTTTKVDETIHRAQTEGNLPMYGQYSPRDFVLSIQRPRSIIILVKAGAPVDQTIAGLAEFMEPGDTIIDGGNEWYENTERRIVDAHARGLLYLGMGVSGGEDGARFGPSLMPGGDFEAYSNVENVLKKIAAQVDDGPCVTYIGEGGAGNFVKMVHNGIEYGDMQLISEAYDVLRHVGGLSNEELGSIFDEWNRGELESFLVEITADIFKVKDELADGELVDKILDKTGMKGTGKWTVQQAAELSVAAPTIAASLDCRYLSGLKEERESAAKALLDAGMKEEVSAVRSGVDKKRLIDDVRQALYASKICSYAQGMNLLRAKSTEKNWNLNLGELARIWKGGCIIRAVFLDRIKQAYQRNSNLASLVVDPEFAKEMVQRQAAWRRVVGLAISAGISTPGMCASLAYFDTYRRARLPANLVQAQRDYFGAHTYERVDRSGSYHTEWSKLARKGAQH

SEQ ID NO: 3627 - protein, 536 aa, Solanum phureja
MDSLFLQKGVLVWLFLFSLRFICGTTAQGTVFIDGKIAIGRIDKHFICATLDWWPPEKCDYGTCAWDHSSFLNLDLNNIIFLNAIKAFSPLKIRLGGTLQDKVIYQTEDHKQPCVSFVRNTTEMFGFTPGCLPLSRWDELNAFFNKSGASIIFGLNALYGRSVHPDGLSVGAWDPSNAESLIRYTVKKGYDIHGWELGNELSGSGVGTRVAADQYASDTIALYKTVQDAYENSETKPLVLAPGGFFDEGWFKEVVNKAGASFDVATHHIYNLGPGRDEHLLEKILDPSYLDGEADTFNKLQNILKASGSSVVAWVGEAGGAYNSGRNHVTNAFAFSFWYLDQLGMSAAYDTKTYCRQTLIGGNYGLLNTTTFVPNPDYYSALLWHRLMGRNVLATSFSGTKKIRAYAHCAKQSQGITLLLINLDGNTTIHARVDFNGTMLHRRKHRHHHNHRKSSIKLPRSSKIASNTREEYHLTAKDGNLQSQTMLLNGNALIVDSSGNIPTFEPIYVNSTEAITVAPFSIVFVHIPYVLLPACS

SEQ ID NO: 3628 - protein, 504 aa, Solanum phureja
MDFFYKAKAVKLKSHLDKYLVADDDQENIRQSRNGSSRKARWLVELVEAENSHFIRLKSSSGKYLTASDEPFLLGMTGKKVFQTLPEKMKDLRIEWEVIRDGFQVKLRGFGGKYLRANGGMPPWRNKVTHDNPYSGSTLNWILWNVEPIDVPENESLTDYLTMVSSFSSVSDELLSLDLGSPTSVHSSFSFSPRSAKISLPKRSAMELFHKAKAVRLQSHHEKYLTAEEDEESVTQDRNGASKNAKWTVEFVEKTENVIRLKSCYGKYLTASNQPFLLGMTGRKVLQTLPNRLDSSIEWEPIREGHQVKLRTRYGQFLRGNGGLPPWRNSVTHDIPHRSKTQDWVLWDVHVVEILAHSTAETAAAMAETTLVGGNSDSFASESSSATTTGSSKSYSFSRQESSDSLISSPPKLVDGRHIYYHIMDEFGEIDEGTEGLCITFKGNSVDDLKKRLEEETGLEDITVCTRSALNGKLYPLRLQLPPNNANMNVIILPSSSKEARDIA

SEQ ID NO: 3629 - protein, 501 aa, Capsicum annuum
MDFFNKAKAGKLKSHLDKYLVADDDQENIRQSRNGSSRKARWIVEVVDDDVENRHLIRLKSVSGKHLTASDEPFLLGMTGRKVLQTLPEKIKDERIEWEPIRDGFQVKLRGFGGKYLRANGGTPPWRNKVTHDNPYTGSTQNWILWNVEPIDVPENESLTDYLTMVSSFSSVSDELSSLDLGSPVSVHSSFSFSPRTMTKTTCITKTSAMELFHKAKAVRLQSHHDKYLTAEEDEESVTQDRNGASKNAKWTVEFVPKTDNVIRLKSCYGKYLTASNQPFLLGMTGRKVLQTIPARLDSSIEWEPIREGQQVKLRTRYGQFLRGNGGLPPWRNSVTHDIPQRTKTQDWVLWDIHVVEILPHSNGVPAAPAVELGRSSDSFASESGSPTTGSSKSLSFSRQESSDSLVNSPPKMGDGRLIYYHMTDEFGEVEEGTEGLCITFKGNSVEDLRKRLEEETGLEDITVCTKSPLNGKLYPLRLQLPPNNANMNVIILPSSSKEAL

SEQ ID NO: 3630 - protein, 78 aa, Solanum phureja
MRFVSKLTFLIISIGCIFQVSSLGADASSLLPLILDQMIGSNPANTFLDPFKVLEQIPFGLENFLLRESTGKRRRRGT

SEQ ID NO: 3631 - protein, 197 aa, Solanum tuberosum
MRVISKLTLLIISIGCIFQVSSLGADASSLLPLILDQMIGSNPANTFLDPFKVLEQIPFGLENREETTLPLSIARVDWKETAEGHVISIDVPGLKKDDIKIEIEENRVLRVSGERKKEEEKNDEQNHWHCVERSYGKFWRQFRLPENADIDTMKAKLENGVLTISFAKLSADRIKGPKVVSIESKQEGKESSVREEL

SEQ ID NO: 3632 - protein, 338 aa, Solanum phureja
MRMGGENVVGYEREVEEVEEEREKEMVVTHGSPQQQMKLVVVGYALTSKKTKSFLQPKLVGLARNKGILFVAIDQSRPLSDQGPFDIVLHKLSGSKWSCILEDYRKTHPHVAVLDPPDAIQQVYNRQYMLEDVADLNLSDSYGKVGVPRQLVIEKDPSSISDAVDKAGLSLPLVAKPLVARSHELSLAYDMASLQKLEPPLVLQEFINHGGVLFKVFIVGEAVKVVRRFSLPDVSKRELSNNAGVFHFPRVSCVAASAEEADLDPSVGELPPRPLLERLARELRRRLGLRLFNLDIIREHGTKDRYYVIDINYFPGYGKMPEYEHIFTDFLLSLMKQK

SEQ ID NO: 3633 - protein, 337 aa, Solanum phureja
MRMRGEIVGYKEEEDYKTEEEEEEREMVGGGLPESKFVVVGYALTSKKVKSFLQPKLEGLARSKGILFVAIDQSKSLSDQGPFDIVLHKLSGTKWRRILEEYRLTHPDVTVLDPPDAIQQVYNRQYMLEDVADLNLSDTYGKVGVPRQLVIEKDSSSIPDAVGKADLRLPIVAKPLAAKSHELSLAYDKFSLQMLEPPLVLQEFINHGGILFKVYIVGEAVKVVRRFSLPDISKRELAKNPGVFRFPRVSCAAASADEADLDPSVGELPPRPLLEKLAKELRRRLGLRLFNLDIIRELGTKDRYYVIDINYFPGYGKMPEYEHIFTDFLLSLVKQKQ

SEQ ID NO: 3634 - protein, 333 aa, Solanum lycopersicum
MRDEIVGYKEEENYKKEEEREMVGGGLVESKKFVVVGYALTSKKVKSFLQPKLEGLARSKGILFVAIDQSKPLSDQGPFDIVLHKLSGSKWRRILEEYRLTHPDVTVLDPPEAIQHIYNRQYMLEDVADLNLSDTYGEVGVPRQLVIEKDSSSIPDAVGKAELRLPIVAKPLAAKSHELSLAYDKFSLQMLEPPLVLQEFINHGGILFKVYIVGEAVKVVRRFSLPDISKRELSTNPGVFRFPRVSCAAASADEADLDPCVGELPPRPLLEKLAKELRRRLGLHLFNLDIIRELGTKDRYYVIDINYFPGYGKMPEYEHIFTDFLLSLVKQKQ

SEQ ID NO: 3635 - protein, 341 aa, Amsonia hubrichtii
MKMRDDVGYKMVEEDGMRKSEEEVVAAAKYSVAGGFTQPMKVVVVGYALTSKKTKSFLQPKLEGLARNKGILFVAIDHTRPLSDQGPFDIVLHKLSGKEWGHILEDYRQTHPEVTVLDPPDAIQHVYNRQSMLQDVADLNLSDAYGKVGVPKQLVIKKDPSSIPDAVGKAGLRLPLVAKPLVAKSHELSLAYDQYSLKKLEPPLVLQEFINHGGVLFKVYIVGEAIKVVRRFSLPDVSKRELSESAGVFRFPRVSCAAASADEADLDPNVAELPPRPLLERLARELRRRLGLRLFNLDIIREHGTKDNYYVIDINYFPGYGKMPEYEHIFTDFLLSLVRSK

SEQ ID NO: 3636 - protein, 1160 aa, Solanum phureja
MGLIDSQSLSSPVKITVTSSPTGGCHGLTSPIRRHSLSTNPNSPLSGKGLRGSSGGRYLSMSKESTDEFVAYTVHIPPTPDNRTVADSQNSPVGVGSSRKSYGYGNPSDGYIKDTIFTGGFNSATKAHVRKSSEDEPMVMKCKTMCQMDGCDEKKAEEKCECGYVICRECYLDCVGFDGGHCPGCKESYKGISDDESDEPRSEAKDQANPLPSRGRGGRMEKNFSLVQSFKNPNQDFDHTRWLFETKGTYGYGNALWPSDGHEFGRGLDRSENPPDFSDRRNRPLTRKVGISAAIISPYRLLMVLRLGALACFLTWRISHPNHEALWLWIMSVVCEVWFAISWLLDQLPKLCPVRRITDLSVLKERFESSGPNLRNPKGLSDLPGIDVFVSTADAEKEPPLVTANTILSILAVDYPVEKVACYLSDDGGSLVTFEALAEAASFARIWVPFCKKHKIEPRNPESYFGQKRDPLKNKVKLDFVRDRRRVKREYDEFKVRINALPESIRRRSDAYNTQQELRAKRKQVELGEDLSEPIKVPKATWMSDGTHWHGTWSSAEEGHSRGDHEGIIQIMLVPPNAEPLYGNEADEKNMIDTTDVDVRLPMLVYVSREKRPGFDHNKKAGAMNALVRASAIMSNGAFILNLDCDHYIYNSLAMREGMCFMLDKGGDRICYVQFPQRFEGVDPNDRYANHNTVFFDVGMRALDGLQGPMYVGTGCIFRRIALYGFSPPRATEHRGWFGSRKTRKLLRKPNIQKDQEDDEMFLPMIGNKDDEEEVSRSLLTKQFGNSIPLVDSIAVAEFGGRLLHELRGKGCQGRPAGSLAVHREPLDASALAEAVGVISCYYEDKTEWGNRVGWIYGSITEDVVTGYRMHNRGWRSIYCVTKRDAFRGTAPINLTDRLIQVLRWATGSVEIFFSRNNALFASPRMKFLQRVAYFNVGMYPFTSIFLLVYCLLPALSLFSGKFIVQSLNVTFLVFLLAITITLCMLALLEIKWSGITLHDWWRNEQFWLIGGTSAHPAAVIQGLLKVIAGVDISFTLTSKSGAPADGEDEFAELYEFRWTVLMIPPITIILINMIAIAVGTFRTVYSPFPQWSKLLGGVFFSFWVLSHLYPFAKGLMGKRGKVPTIVFLWSALICIVISLLAVYVYPPSGHQDFSSFQFP

SEQ ID NO: 3637 - protein, 197 aa, Solanum phureja
MASEPEKVVPPVEAPVAEPEKAAPPPSTTRPTDYFAVADVVLRLLVFASALVSVVVMSTSKETEMLPNPRPAKFTQSPALIYFVVALSVAGFFSLITTLGSLYSLIKPGCCAKIISHFIVIDVLLLGIVASATGAAGSVTYIGLKGNTYVGWREICTLYGKFCRYLGASIGVSLFASVMLVLLVLLSVYSLSKKIPK

SEQ ID NO: 3638 - protein, 197 aa, Solanum tuberosum
MASEPEKVVPPVEAPEAEPEKAAPPPSTTRPTDYFAVADVVLRLLVFASALVSVVVMSTSKETEMLPYPRPAKFTQSPALIYFVAALSVAGFFSLITTLGSLYSLIKPGCCAKIISHFIVIDVLLLGIVASATGAAGSVTYIGLKGNTYVGWREICTLYGKFCRYLGASIGVSLFASVMLVLLVLLSVYSLSKKIPK

SEQ ID NO: 3639 - protein, 197 aa, Solanum melongena
MASEPEKAIPPAEASVAEPEKVTLPPSTTRPTDYFAVADVVLRFLVFASALVSVVVMSTSKETEMVPTPRSAKFNYSPALIYFVAALSVAGFFSLITTLGSLYSVIKPGCYAKIISYFIVIDVLLLGIVASATGAAASVIYIGLKGNTHVGWIKICTFYGKFCRYLGASAGVSLFATIILVLLVLLSVYSLSKKIPK

SEQ ID NO: 3640 - protein, 203 aa, Capsicum annuum
MATEPEKVAPPTEAPVAEPEKAAPPPTARPTDYFEVADVVLRLLVFASALVSVVLMSTSKQTEIVPIPIPPYQAPRSAKFNHSPALIYFVAAHSVAGFFSIITTLGSLYSLIKPGCSAKIISHFIVIDVLLLGIVASATGAAASVTYIGLKGNTHSGWGKICSLYDKFCRYLGASVGVSLFATIMLVLLVLLSVYSLSKKIPK

SEQ ID NO: 3641 - protein, 203 aa, Nicotiana tabacum
  misc_feature (121)..(121): Xaa can be any naturally occurring amino acid
MATEPEKVVAPAEASVAEPEKAALPPTTAPTDYFAVADVVLRLLVFASALVSVVVMSTSKQTEMVPTPFPPYRAPLPAKFNHSPALIYFIAALSVAGFFSILTTLGSLYSLTKPGCSAKIXSHFIIIDVILLGIVASATGAAAAVAYIGLKGNTHVGWGKVCNMYGKFCRYLGASIGVSLFATVMLLLLVLLSVYSLSKKIPK

SEQ ID NO: 3642 - protein, 1449 aa, Solanum phureja
VTVLVGETGSGKSTQLVQFLADSGITGTGSIVCTQPRKLAANSLASRVREESQECYDDCSISCNPPHSSCQQFDSKVIFMTDHCLLQHYMGDKTLSNISCIIVDEAHERSLNTDLLLALIKKLLHQRFDLRLIIMSATVDANQLAGYFFGCGTFHVAGRTFPVDIKYVPCEDDAHHAVGAIASYVHDVIKMVTEIDRTEGAGAILAFLTSQSEVEWACEQFKAPLAIALPLHGKLSYDDQNRVFLSYPGKRKVIFTTNLAETSLTIPGVKYVVDSGMVKESRFEPGSGMNVLRICSVSQSSANQRAGRAGRTEPGKCFRLYSQSDFEDMPRHQEPEIRKVHLGVAVLRILALGIKNVQDFDFVDAPKPKAIEMATRNLVQLGAVTQRDDASYELTAEGLKLVKLGIEPRLGKMILSCFDQRLGKEGVALAAVMANSSSIFCRVGSEGDKLKSDCRKVQFCHPSGDLFTLLSVYREWEIVPREKKNSWCWDNSINAKSMRRCHETVLEMEACLQNELNMILASYWRWHPQVHNKCDEVLQSIILSSLAENVAVYSGYDQLGYEVALSGKCVQLHPSCSLLNFGQRPRWVVFGDVLASANEYLVCVTAFEFSSLVSLTPAPLFDFLKMDALKLEKKVLTGFGVVLLKRFCGKSNSSINNLVSRIRTSYKDERIGIQVNVDENEVLLYASSRDMESVTFQVNDALEYESKLLRNECLEKCLFNGGSAASASVALFGAGAVIKHLELEKRCLTVDIFPSNGNAIDDKELLMCLERATSGNICMVHKYSGMGQDKEENKWGTVKFLTPDAAEQATFLNKVEFNGGFLKMVPSRSIHSSDQKMFRSVLKAKVSWPRRYSKGVGFLRCDPMDVPLILDDISDLMIGGNVIRCEASDKNPDNIVIARLDRDIAETEILEVLRATTNRRILDFFLVRGDSVENPPIATCEEALRKEISPFMPKKVPFVNSVRVQVFQPKLTEYFAKAAIIFDGSLHLEAAKALEQIDGMVLPGCLPWQKIRCERLFHSSVSCPAAVYHVIRNQLDSLLASLRRRKVGKCELQRNDNGSCTVRISATATKVVADLRRPLEQLMKGKIVDHVDITPKVVQLLFSREGSNIMRTIQRETGTYIYFDKHSLLVSIFGSLDNVDRAQQRFIGSLLALHENKQLEVHLRGGLLPHDLMKRVVQTFGPDLSALKEKVPGAEFSLNTKRHCIYINGTKDMKQSVEDIISEIAQRSFPIQTTGDDADCPVCLCELEDPYKLEACCHVFCRTCLLEQCESAIKSREGFPMCCLHQGCAEPILLADLKSLLSIEKLEELFRASLGAFVAANGSTYRFCPSPDCPSVYRIADPDMVGAPFACGACYVETCTSCHLEYHPYLSCETYQKVKDDPDCSLEEWSKGKDNVKKCPVCRFTIEKVDGCNHIECKCGKHVCWVCLLFFDTSDNCYDHLRSVHRSIT

SEQ ID NO: 3643 - protein, 191 aa, Brassica juncea
GARMSATAAGSYAMALADVAKRNDTLELTSADVEKLEKVFSDPQVLNFFANPTVEVEKKRLVIDDIVKSSSLQSHTSNFLNILVDANRINIVRDIVKEFEMVYNKITDTQLAEVRSVVKLEPPQTSSDRQQVQKLTGAKNVRVKTILDPSLVAGFTIRYGDSGSKLIDMSVKKQLEDIAAQLELGEIQLAA

SEQ ID NO: 3644 - protein, 128 aa, Arabidopsis lyrata
MELPLLSYASSASFSRTGFYSSSSSTSICEFPERRRSFRMRFNGGERSRSVIASAERSSEGIEKTDGGGGFAGTAMEVTTLDRGFANSTTVDFPIWDKIGAVVRLTYGIGIYGAMAVAGRFIWFGDWN

SEQ ID NO: 3645 - protein, 171 aa, Brassica oleracea
ASSIGEELFYRVAVQGALSDIFLKGTQLMTDSRGMASLTGILPPFVPFAQAFAAVITATLTGSLYFLAASPKDPTYIVAPVLRSRRDDFKKLLSAWYEKRQMKKIYSPLLEGVLAFYLGIEWVQTDNILAPMMTHGIYSTVILGHGLWKIHDHRRRLRRRIERLRSETADE

SEQ ID NO: 3646 - protein, 279 aa, Cleome spinosa
VDLPVWDKIGAIVRLAYGIGIYGAMALTGRFLCSMTGIDSSGGFDPSLDAVLSGLGYAAPPIMALLFILDDEVVKLSPHARAIRDVEDEELRSFFCGMSPWQFMFIVAASSVGEELFYRAAVQGALADMFLRGTQMISDSRGIASLTGVLPPFVPFAQAFAAVITATLTGSLYYIAASPKDPTYIVAPVLRSRSGRGELKKLLSAWYEKRQMKKIYSPLLEGLLGLYLGLEWIQTDNILAPIMTHGIYSAVILGHGLWKIHDNRRRLRRRIQRLKSDIT

SEQ ID NO: 3647 - protein, 498 aa, Eutrema parvulum
MDAKALIFAVLFVVLSLRFLIERIKRKPNLPPSPAWSLPVLGHLRLLRPPIHRTFLSISQSLGDAPIFSLRFGKRLVFVNTSHSIAEECFTKNDVVLANRPNFILAKHVAYDYTTMIAASYGDHWRNLRRIGSVEIFSNHRLNSFLSIRQDEIRRLILRLSRNFSQEFAKVEMKSMLSDLTFNNIIRMVAGKRYYGDGAEDDPEAKRVRQLIADVVALAGAGNAVDYLPVLGWVSNYETRVKKLASRLDEFLQGLVDEKREPKEKGNTMIDHLLSLQESQPDYFTDRIIKGNMLALILAGTDTSAVTLEWALSNLLNHPEVLNKARDEIDRKVGLNRLLEESDISNLPYLQNIVSETLRMYPAVPMLLPHVASEDCKVAGYDMPRGSILLTNAWAIHRDPQLWDDPTSFKPERFEKEGEANKLMSFGLGRRACPGSGLAHRLINLTLGSLIQCLEWERIGEEEVDMSESKGGTLPKAKPLEAMCRARASVGKLFHEAA

SEQ ID NO: 3648 - protein, 168 aa, Eutrema halophilum
MEEAQILILTFLFLSLTFFFIGRIKRKQNLPPSPPFALPIIGHLRLLKPPLHRAFLSVSQSLGDAPVFSLRLGNRLVFVVSSHSIAEECFTKNDVVVLANRPHSVASKHISYDYTTMASASYSEHWRNLRRIGAVEIFSAHRLNLFSSIRRNEIRRFIARLSRNSSHE

SEQ ID NO: 3649 - protein, 501 aa, Arabidopsis lyrata
MEEESQTLILTILILILTLTILLIKKLKPKPNLPPSPLFSLPIIGHLRLLKPPLHRIFLTISKSLNNSPIFSLRLGNKLVFVVSSNSIVEECFTKNDVVLANRPKSIASKHISYNYSSMVSAPYSEHWRNLRRIGAVEIFSSHRLNSFSSIRRDEARRLIVRLSQNSSLEFAKVEMNSMLSNLAFNNIIRMVTGKCYYGDGAEDDAEAKRVRQLIAEAMSCFGAGHAADHLPVLRWITGFERRVKKIAGRLDEFFQELVDEKRAAKETENTMIDHLLSLQESQPEYYTDHTIKGTMLSLILAGTDTSAVTLEWALSSLLNHPEVLKKARDEIDNKIGLNRLLEESDVPNLPYLQNIVSETLRLYPAGPLSVPHVASEVCKVGGYDMPRGTMLLVNVWAIHRDPKLWDDPASFKPERFEKEGETHKLLAFGLGRRACPGSGLAQRLVSLSLGSLIQCFEWERIGEEEVDMTEGGGLTMPRANPLVAMCRARAFVGKILHESA

SEQ ID NO: 3650 - protein, 240 aa, Euphorbia peplus
MFLLKTWRSTAFGVYGYLNFTKSGFLEHSKNFKPEDMQIRIEGKNCVVTGANSGIGYATAEGLASRGANVYMVCRNKERGEDALSKIQNKTGNQNVHLEVCDLSSVSEIKSFASRFVSKDVPVHVLVNNAGLLENERVTTPEGLELNFAVNVLGTYAMTELMVPLLEKASPNAKVITVSSGGMYTTPLTTDLQFSDGKFNGVEQYARNKRVQVALTEKWAETYKDRGISFYSMHPGCQES

SEQ ID NO: 3651 - protein, 240 aa, Euphorbia esula
  misc_feature (189)..(189): Xaa can be any naturally occurring amino acid
  misc_feature (222)..(222): Xaa can be any naturally occurring amino acid
  misc_feature (237)..(237): Xaa can be any naturally occurring amino acid
MFLLKTWRSTAFGVYGYLNFTKSGFLEHSKNFKPEDMQIRIEGKNCVVTGANSGIGYATAEGLASRGANVYMVCRNKERGEDALSKIQNKTGNQNVHLEVCDLSSVSEIKSFASRFVSKDVPVHVLVNNAGLLENERVTTPEGLELNFAVNVLGTYAMTELMVPLLEKASPNAKVITVSSGGMYTTPLXTDLQFSDGKFNGVEQYARNKRVQVALTEKWAEXYKDRGISFYSMHPGXQES

SEQ ID NO: 3652 - protein, 305 aa, Fagus grandifolia
MFLLKTWRSTAFGIYGYLNFTKSGFIEHSKKFKPEDVQTRIDGKNCIVTGANSGLGYATAEGLASRGATVYMICRNKERGEAALSKIQSTTGNQNVHLEVCDLSSVSEIKSFTSRFSSKDVPIHVLVNNAGLLEHKRVTTSEGFELNFSVNVLGTYAITEMMLPLLEKTAPDARVITVSSGGMYTAPLTTDLQFSDSNFNGVDQYARNKRVQVALTEKWAETFKNKGIGFYSMHPGWAETPGVAKSLPSLSKRLPGNLRTSEEGADTVIWLALQPKENWYQVHFILIGLKRLNTLCFQLLVALMC

SEQ ID NO: 3653 - protein, 322 aa, Carica papaya
MFLLKTWRTTAFGVYGYLNFTKNGFLEHSKNFKEKEMQVKIDRKNCIVTGANSGIGYAAAEGLASCGATVYLICRNKERGEAALSKIQSATGNTNVHLEVLDLSSQSEIKSFVSRFASKDIPVHVLVNNAGLLETKRVTTSEGFEMNFAVNVLGTYTMTELMLPLLEKAAPDAKVITVSSGGMYTVPLTTDLQYSDEKFDGVVQYARNKRVQVALTEKWAEMYTNKGIGFYSMHPGWAETPGIAKSLPGFNKSFSGKLRTSAEGADTIIWLALQPKENLVPGALYFDRAEAPKHLKLAATAQSHAVIDSIIDNLRSMAALPQ

SEQ ID NO: 3654 - protein, 322 aa, Prunus persica
MFLLKAWRQTAFGIYGYLNFTKSGFIEHSKQFKPEDTQTRIEGKNCIVTGANSGIGFATAEGLASRGANVYMVCRNKERGEAAQSKIQSNTGNQNVHLEVCDLSSVSDIKSFASQFSSKDVPVHILVNNAGLLEHNRITTSEGFELNFAVNVLGTYAMTELMLPLLEKAAPDARVITVSSGGMYTTPLTKDLQFSEENFNGVQQYSRNKRVQVALTEKWAEINKNKGIGFYSMHPGWAETPGVATSLPSFSKALSGKLRTNEEGADTIIWLALQPKEKVVSGSFYFDRAEAPKHLMFAATSGSHALIDSIFESLKSLSSISA

SEQ ID NO: 3655 - protein, 41 aa, Brassica rapa
HASATSGLKSAIESLTLYRFSRSSVSDFELQRGEQDQRLGV

SEQ ID NO: 3656 - protein, 471 aa, Brassica napus
MLTLAKPKKESKRAAELKRMREDFKRQRKEEMERMNEESEAMEKAIKAQKKMQERKKRKAVRKKKYEESLLEARRNYRDMGLMWARLAEDSNVATALGLVFFYIFYRVVVLNYRKQKKDYDDRLKIEKAEAEERKKMRELEREMEGIELDDEEEESGEKNPYLQMAKQFMKSGARVRRASSNRRMPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSSETWRQVANKRSCYGCCRSELP

SEQ ID NO: 3657 - protein, 665 aa, Arabidopsis thaliana
MLTWVKPKKESKRAAELKRMREDFKRQRKEEIETMKEERVMMEKTMKAQKKQQERKKRKAVRKKKYEESLREARKNYRDMADMWARLAQDPNVATALGLVFFYIFYRVVVLNYRKQKKDYEDRLKIEKAEADERKKMRELEREMEGIEEEDEEVEEGTGEKNPYLQMAMQFMKSGARVRRASNKRLPEYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIVEIAAINMMRDGRTELTTDDLLQAAQIEERGMLDRKDRSLETWRQVAINEAAMAVVAVNFPDMKNIEFLTINPRAGRELGYVRVKMDHIKFKEGMLSRQSILDHITVQLAPRAADELWYGEDQLSTIWAETSDNARSAARSLVLGGLSDKHHGLNNFWVADRINDIDVEALRILNMCYERAKEILGRNRTLMDEVVEKLVQKKSLTKQEFFTLVELYGSSKPMPPSILELRKIKRLELEEMVLKLDMTTARNSS

SEQ ID NO: 3658 - protein, 460 aa, Raphanus sativus
  misc_feature (207)..(207): Xaa can be any naturally occurring amino acid
EIRLELEEIVKFFTHGEMYRRRGVKIPGGILLCGPPGVGKTLLSKAVAGEAGVNFFSISASQFVEIYVGVGASRVRALYQEARDNAPSVAFIDELDAVGRERGLIKGSGGQERDATLNQLLVSLDGFEGRGEVITIASTNRPDILDPALVRPGRFDRKIFIPKPGLIGRMEILQVHARKKPMAEDLDYMAVASMTDGMVGAELANIXEIAAINMMRDGRTELTTDDLLQAAQIEERGMLDRKDRSSETWRQVAINEAAMAVVAVNFPDLKNIEFLTINPRAGRELGYVRVKMDHIKFNEGMLSRQSLLDHITVQLAPRAADELWYGEDQLSTIWAETSDNARSAARSLVLGGLSEKHHGLNNFWMTDRINDIDVEALRILNMCYDRAKEILQKNRTLMDEVVEKLVQKKSLSKQEFFTLVEIYGSIEPMPPSILELRKIKRLQLQEAVMKQDMTTARNSS

SEQ ID NO: 3659 - protein, 877 aa, Theobroma cacao
MACHFSFGSSLYPELPSLKLKSQNPFFSTTYPSISCQIYSFKSNNSDDDDKTKKSQFNFLALPITLTIISTSFPQKSSLAAVKVSDRKKTQKKTQEALTPEQLKQWSKDLPIVKSRIPYTEILSLKLEGKLKHLIKPPSVSLKQRAEPVLVVLEDSRVLRTVLPSIDSDRKFWDSWDELKIESLCVNAYTPPIKRPEVPAPYLGFLGRVPASMLSWFKPKKESKRAAEIRRAREEFKRQRKEELARMREEREMIEKAIKVQKKEEVRRKKQEIRKRKYEESLRDARRNYQSMANVWASLAQDSNVATALGLVFFVIFYRTVVLSYRRQKKDYEDRLKIEKAEAEERRKMRELEREMEGIEGEDDEAEQVGGEQNPYLKMAMQFMKSGARVRRAHNKRLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGNVITIASTNRPDILDPALVRPGRFDRKIFIPKPGLIGRMEILQVHARKKPMAEDVDYMAVASMTDGMVGAELANIVEVAAINMIRDGRTEITTDDLLQAAQIEERGMLDRKERGPETWKQVAINEAAMAVVAVNFPDLRNIEFVTIAPRAGRELGYVRMKMDHIKFKEGMLSRQSLLDHITVQLAPRAADELWYGEGQLSTIWAETADNARSAARTFVLGGLSEKHHGLSNFWVADRINEVDLEALRIVNMCYERAKEILQQNRKLMDAVVDELVQKKSLTKQEFFGLVELHGSLKPMPPSILDVRLAKRAQFQEMMMNQKVEVAGSSS

SEQ ID NO: 3660 - protein, 890 aa, Populus trichocarpa
MACHFPSSSSLHPKTTIKPHQIPLRTITYPSIRCKKQDPILENDNKTENTNKKTHFSFLSLPITLTIISTSLTPHPAFAATPTPKTYHKKKTLKKTQQEALTPDQLKQWSQNLPVVSNRIPYTQVLILKENNKLKHVIKAPNASLKQRPEAVLVVLDDNQVFRTVLPSLESNRRFWDSWDEFKIDALCVNAYSPPVKRPELPKPYLGFLWKVPEFMLSRLKPKKESKRAMELRMAREEFKRQRKEELKKMREEREIIEKAIKMQKKDEDRRRKRETRTKKYEESLRDARKNYTRMASMWANLAQDSNVTTLLGLVFFVIFYRTVVLSYRKQKKDYDDRLKIEKADAEERKKMRELERELMGIEEEEEDESVPGKAEQNPYLKMAMQFMKSGARVRRAHNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVSLDGFEGRGEVITIASTNRPDILDPALVRPGRFDRKIFIPKPGLIGRMEILKVHARKKPMADDVDYMAVASMTDGMVGAELANIIEVAAINMMRDGRTEITTDDLLQAAQIEERGMLDRKERSPETWKQVAINEAAMAVVAVNFPDLRNIEFVTIAPRAGRELGYVRMKMDHVKFKEGMLSRQSLLDHITVQLAPRAADELWYGEGQLSTIWAETADNARSAARSYVLGGLSEKHHGLSNFWAADRINEIDLEALRVMNFCYDGAKEILQQNRKLMDAVVDELVRKKSLTKQEFFNLVELHGVIKPMPPSILYIRVAKRAQFQEMLVHQNETTITSNARATCQESSI

SEQ ID NO: 3661 - protein, 889 aa, Malus domestica
MDCHSLLGSSSSLSPYPKPIPLTKTQPKPLPPSTVSSSSSSHLSPADDDDENDKTHKPNFDFLKLSVTLTVISTSLPRIPTAVAAVKEKKRAPKKSTPKKSEALSPQELESWSQGLPVVSNRIPYTQLLALSQEGKLKHVIKPPGIELQKRAEPVLVVLEDSRVLRTVLPSVDSDRRFWEQWEELKIESFCVNAYTPPLKRPEVPTPYLGFVAKWPRFLSSFSGKPKKESKRAMELRRAREEFKMQRKEELDRMRKEREMIDKAMKAQKKEEERRVRREMRKKKHDDSLREARRNYQEMANVWANLAQDTNVATALGLVFFYIFYRTVVLSYRRQKKDYEDRLKIEKAEAEERKKMRELEREMEGIEGDEEDEIEPGKGEQNPYLKMAMQFMKSGARVRRAHNKRLPQYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIFIPKPGLIGRIEILKVHARKKPMAEDVDYMAIASMTDGMVGAELANIIEVAAINMMRDGRTEITTDDLLQAAQMEERGMLDRKERSLDTWKQVAINEAAMAVVAVNFPDLRNIEFVTIAPRAGRELGYVRMKMDPIKFREGMLTRQSLLDHITVQLAPRAADELWFGKDQLSTIWAETADNARSAARTYVLGGLSEKHHGLSNFWVADRLNDLDVEALQIVNMCYERAKEILQKNRTLMDAVVDELVEKKSLTKQEFFSLVELHGTLKPMPPSILDIRAAKRKQFQEMMMNQKEAALGSNLRAKM

SEQ ID NO: 3662 - protein, 884 aa, Ricinus communis
MASHFPFSSSLYPKTYNHNPRKFLLRHPTFPSISCQKQNPILENDNETTKTYADSRKTHFNFLTLPITLTVISTSFTAQPALAAVSTAKTTRKKKTQKKAPQETLTPDQLKQWSKDLPIVANRIPYTEVLKFKETNKLKHVIKAPKACLKQQAEAVLVVLDGNQVFRTVLPSFVSNKRFWDSWDELKIDALCINAYTPPVKKPEMPKPYLGFLWKVPEFLLSKFKRKKESRRAMELRRAREEFKRQRKEELARMREEREMIEKAIKMQKKEEQRRIKKEIRKKKYEESLRDAERNYTRMANMWADLAQDSNVATFLGLVFFVIFYRTVVLSYRKQKKDYEDRLKIEKAEAEERKKMRELEREMMGIEDEEEDESEQGKGEKNAYLKMAMQFMRSGARVRRAHNRRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRSLYQEAKENAPSVVFIDELDAVGRERGLIKGSGGQERDATLNQLLVCLDGFEGRGEVITIASTNRPDILDPALVRPGRFDRKIYIPKPGLIGRMEILKVHARKKPMADDVDYMAVASMTDGMVGAELANIIEVAAINMMRDGRTEMTTDDLLQAAQIEERGMLDRKERSPGTWKQVAINEAAMAVVAVNFPDLKNIEFVTISPRAGRELGYVRMKMDHVKFKEGMLSRQSLLDHITVQMAPRAADELWYGEGQLSTIWAETADNARSAARTYVLGGLSEKHYGQFDFWVADRINEIDLEALRILNLCYEQAKEILQRNHKLMDAVVDELVQKKSLTKQEFFHLVELYGSIKPMPLSILDLRAAKREEFQKMMMNQKEKTASNL

SEQ ID NO: 3663 - protein, 823 aa, Prunus persica
MACQCLLGSYSSSSLSPNPKPKTLNKNPPKPLAPSSISSHLSTTDDNDENDKTHKPNFDFLKLSVTLTVISTALPQIPTGIAAVKEKKRVPKKSTLKKSEALSHQELQSWSQGLPVVSNRIPYTQLLILNQEGKLKHVIKPPGVELQKRVEPVLVVLEDNRVLRTVLPSVDSDRRFWEQWEELKIESLCVNAYTPPLKRPEVPSPYLGFVAKWPAFLSSFVKPKKESKRAMENYLEMANVWANLAQDSNVATALGLVFFYIFYRTVVFSYRRQKKDYEDRLKIEKAEAEERKKMRELEREMEGIEGEEEEEIEQGKGEQNPYLKMAMQFMKSGARVRRAHNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIYIPKPGLIGRIEILKVHARKKPMAEDVDYMAIASMTDGMVGAELANIVEVAAINMMRDGRTEITTDDLLQAAQMEERGMLDRKERSLDTWKQVAINEAAMAVVAVNYPDLKNIEFVTIAPRAGRELGYVRMKMDPIKFKEGMLTRQSLLDHITVQLAPRAADELWFGEDQLSTIWAETADNARSAARTYVLGGLSEKHHGLSNFWVADRLNDLDTEALQIVNMCYERAKEILRKNRKLMDAVVDELVQKKSLTKQEFCSLVELHGSIKPMPPSILDIRAAKRKQFQDMMMNQKEPALGSNL

SEQ ID NO: 3664 - protein, 878 aa, Gossypium raimondii
MAYHFSFGSSLYPKLPSLKPKLQNPFFFSSYPSISCQIYSSKSNSSDDDDKAKKTHFNFVALPITLTIISTSFPQQSSLAAVKVSDRKKTQKKTQEALTPEQIKQWSKNLPIVTNRIPYTEILSLKHEGKLKHLIKPPSASLKQRAEPVLVVLEDSRVLRTVLPSIDSDRKFWDSWDELKIESFCVNAYTPPIKRPEVPSPYLGFLWRVPAFMLSWFKPKKESKRALEIRRQREEFKRQKTEELARMREEREMIEKMMKAQKKEDERRKKREIRKRKYEESLRDARRNYQSMANMWASLAQDSNVATALGLVFFVIFYRTVVLSYRKQKKDYEDRLKIEKAEAEERKKMRELEREMEGIEGEDDEAEQGGGEQNPYLKMAMQFMKSGARVRRAQNKRLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGNVITIASTNRPDILDPALVRPGRFDRKIFIPKPGLIGRMEILQVHARKKPMAEDVDYMAVASMTDGMVGAELANIVEVAAINMIRDGRTEITTDDLLQAAQIEERGMLDRKERSPETWKQVAINEAAMAVVAVNFPDLRNIEFVTIAPRAGRELGYVRMKMDHIKFTEGMLSRQSLLDHITVQLAPRAADELWFGEGQLSTIWSETADNARSAARMFVLGGLSEKHHGLSNFWVADRINEIDSEALQIVNICYERAKEILQQNRKLMDAVVDELVEKKSLTKQEFFGLVELHGSLQPMPPSIVDIRVAKRTQFQEMMMNPNVKVTGSSSS

SEQ ID NO: 3665 - protein, 880 aa, Manihot esculenta
MASNFLFSSSPFPNVQKPRKFLLRPRDYPSISCQKQDPNPENHNETSKTHKANKTHFSFLAVPITLTIISSSLSPQPVLAAAAKTGHKKKTQKKTQESLTLDELKQWSKDLPIVSNRIPYTEILSFKESNKLKHVIKAPKACFRERAEAVLVVSDDNKVFRTVLPSLESNKRFWDAWDELKIDTMCVNAYTPPVKKPELPKPYLGFLWKVPEFMLSKFKPKKESKRAMELRKMREEIKRQRKEELARMREEREMIEMIIKIQKKEEQRRIKRKIRKKKNKESLLYAQMNSIRMANMWAQLARDRNVSTLLGVVFFVIFYRTVVLSYKKQKKDYEDRLKIEKAEAEERKKMRELEMEMMGIEEEEEGEGEGEQGKGEQNAYLKMATQFMKSGARVRRAHNRRLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRSLYQEARENAPSVVFIDELDAVGRERGLIKGSGGQERDATLNQLLVCLDGFEGRGEVITIASTNRPDILDPALVRPGRFDRKIFIPKPGLIGRIEILKVHARKKPMADDVDYMAVASITDGMVGAELANIIEVAAINMMRDGRTEITTDDLLQAAQIEERGMLDRKERSPETWKQVAINEAATAVVAVNFPDLRNIEFVTIAPRAGRELGYVRMKMDHVKFKGGMLSRQSLLDHITVLLAPRAADELWHGEGQLSTIWAETADHARSAARTYVLGGLSEKHYGLFDFWVADRINEIDLEALRILNSCYERAKEILQQNRELMDAVVDLLVQNKSLSKQEFFHLVELHGSIKPMPPSIIDLRDAKRVEFQETMMNQKETTVSNL

SEQ ID NO: 3666 - protein, 883 aa, Eucalyptus grandis
MAFHCDLGSSTLPFRAIRKPNLNKPKNSSLIPTRPPIRCRIRAPENGNEGHHPEDETKRPQFNFLSIPATLTIIYASLPQPAAAATKVSEKKRSAKKAPEALTPEQLKSWSKGLPLVTDRIPYTDIVELKKQGKLKHVIKPPGISLRQRVEPVLVVLEDSRVLRTVLPSIDGNRKFWDMWDQLSIDSACVNAYTPPVKKPDVPAPYLGFMWSVPGFMLKLMQPKKESKRAMELRQMREEFKRQKKEELARMREEREMIEKAMKKQKREEERQSKKEIRKRKYEESLREARKNYRQMAIVWADLAGDTNVATALGLVFFVIFYRTVVLSYRRQKKDYEDRLKIEKAEAEERKKMRELERELEGIEGDDEEIEGGEGGEQNPYMKMAMQFMKSGARVRRAHNKRLPQYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIYIPKPGLIGRVEILKVHARKKAMAEDVDYLAVASMTDGMVGAELANIVEVAAINMMRDGRTEITTDDLLQAAQIEERGMLDRKERSPETWKQVAINEAAMAVVAVNFPDLRNIEFVTIAPRAGRELGYVRMKMDHMKFKEGMLSRQSLLDHITVQLAPRAADELWYGEGQLSTIWAETADNARSAARTYVLGGLSEKHYGVTNLWVADHINEIDLEALRIVNECYNRAKEILQLNRKLMDAVVDELVQKKSLTKQEFFQLVELHGSLKPMPPSILDIRAAKREKFQEMMMMNQKEAVVGKHV

SEQ ID NO: 3667 - protein, 666 aa, Vinca minor
MWLFSFVKPKPQSKKALELKRMREEFKKKQNAELGKMREDMEMMEKASKMQKKMEERQRRKELKMIKAEESFRKAQKNSEDMSRLWANLASDSNVTLALGFVFFFIFYQTVVLSYRKQKRDYEDRLKIEKAEAEEKKKMRDLEKEMAGIEGDDDEEEGGKGEQNPYMKTAMQFMKSGARVRRAHSKRLPQYLERGVDVKFSDVAGLGKIREELEEIVKFFTHGEMYRRRGIKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIYIPKPGLIGRIEILKVHARKKPMAPDVDYMAVASMTDGMVGAELANIVEVAAINMMRDERTEITTDDLLQAAQMEERGMLDRKERSLETWKQVAINEAAMAVVAVNFPDLRNIEFLTIAPRAGRELGYVRMKMDHVKFKSGMLSRQSLLDHITVQLAPRAADELWYGEGQLSTIWAETADNARSAARTLVLGGLSEKYYGLNNFWTADRINDIDSEALRIINMCYERAKEILQRNRGLMDVVVDELVEKKSLTKQEFFSLVQLHGSVQPMPPSIIDIRAAKRLELQNVLRDQNEASQKSV

SEQ ID NO: 3668 - protein, 855 aa, Gossypium hirsutum
NPFFFSSYPSISCQIYSSKSNSSDDDDKAKKTHFNFVALPITLTIISTSFPQQSSLAAVKVSDRKKTQKKTQEALTPEQIKQWSKNLPIVTNRIPYTEILSLKHEGKLKHLIKPPSASLKQRAEPVLVVLEDSRVLRTVLPSIDSDRKFWDSWDELKIESFCVNAYTPPIKRPEVPSPYLGFLWRVPAFMLSWFKPKKESKRALEIRRQREEFKRQKKEELARMREEREMIEKIMKAQKKEDERRKKREIRKRKYEESLRDARRNYQSMANMWASLAQDSNVATALGLVFFVIFYRTVVLSYRKQKKDYEDRLKIEKAEAEERKKMRELEREMEGIEGEDDEAEQGGGEQNPYLKMAMQFMKSGARVRRAQNKRLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGNVITIASTNRPDILDPALVRPGRFDRKIFIPKPGLIGRMEILQVHARKKPMAEDVDYMAVASMTDGMVGAELANIVEVAAINMIRDGRTEITTDDLLQAAQIEERGMLDRKERSPETWKQVAINEAAMAVVAVNFPDLRNIEFVTIAPRAGRELGYVRMKMDHIKFTEGMLSRQSLLDHITVQLAPRAADELWFGEGQLSTIWSETADNARSAARMFVLGGLSEKHHGLSNFWVADRINEIDSEALQIVNICYERAKEILQQNRKLMDAVVNELVEKKSLTKQEFFGLVELHGSLQPMPPSIVDIRVAKRTQFQEMMMNPNVKVTGSSSS

SEQ ID NO: 3669 - protein, 830 aa, Vitis vinifera
MASHCILNSPHFPCLPFLSRPKIRTKTKNLAIRPPIISYHFSTSQPQEYEDNDKESKKAKQNPCNFLNLSITLTIISASLPQPSLAAAAAGKSAGKKRSSRKPEALTPQELKSWTEGLPVVTDRVPYTDILDLKREGKLKHVIKPPGGPGVGLRQRAEAVLVVLEDSRVLRTVVPSVEKDRRFWEMWDELKIDSVCVNAYSPPVKGPELPVPYLGFLSRIPAYMFSFVKPKPESTRDARRKYERMANFWANLAADSNVATALGFVFFYIFYRTVVLSYRKQKKDYEDRLKIEKAEAEEKKKMRELERQLEGIEGGEDESEIVGGEQNPYMKMAMQFMKSGARVRRAHNKRLPQYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGNVITIASTNRPDILDPALVRPGRFDRKIYIPKPGIIGRIEILKVHARKKPMAEDVDYMAVGSMTDGMVGAELANIIEIAAINMMRDGRSEITTDDLLQAAQIEERGMLDRKERSPEMWKRVAINEAAMAVVAVNFPDLKNIEFVTISPRAGRELGYVRMKMDHIKFKEGMLSRQSLLDHITVQLAPRAADEIWYGEDQLSTIWAETADNARSAARTFVLGGLSEKHQGLSSFWVADRINDIDLEALRILEVCYERAKEILKQNRKLMDAVVDELVQKKSLTKQEFFRLVEVHGSLKPMPPNILDIRAAKRIQFQERMMSQREAAVGKNI

SEQ ID NO: 3670 - protein, 587 aa, Gossypium hirsutum
MANMWASLAQDSNVATALGLVFFVIFYRTVVLSYRKQKKDYEDRLKIEKAEAEERKKMRELEREMEGIEGEDDEAEQGGGEQNPYLKMAMQFMKSGARVRRAQNKRLPQYLERVVDVKFSDVAGLGKIRLELEEIVKFFTHGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGNVITIASTNRPDILDPALVRPGRFDRKIFIPKPGLIGRMEILQVHARKKPMAEDVDYMAVASMTDGMVGAELANIVEVAAINMIRDGRTEITTDDLLQAAQIEERGMLDRKERSPETWKQVAINEAAMAVVAVNFPDLRNIEFVTIAPRAGRELGYVRMKMDHIKFTEGMLSRQSLLDHITVQLAPRAADELWFGEGQLSTIWSETADNARSAARMFVLGGLSEKHHGLSNFWVADRINEIDSEALRIVNICYERAKVILQQNRKLMDAVVNELVEKKSLTKQEFFGLVELHGSLQPMPPSIVDIRVAKRTQFQEMMMNPNVKVTGRSSS

SEQ ID NO: 3671 - protein, 885 aa, Cajanus cajan
MASHCFLRYPSPNPKFKTLPKPPYHPSVSSRIQTPQPDNDNDNDATNPQNDNRFDFLKLTVTLTIISASLPQPAAAAAATRGKKRPPRKQSSKKLEALSPEELRTWTQGLPVVSDRLPYSEILDLRKNGKLKHIIKPSSANLRLRGEAVLVVLDDSRVLRTVLPSFESHSMFWDSWDELKIDSLCVNAYTPPIKRPEWPPSLLSMIWVPPFVKNFFVNIFEDRERKPKKESRKIAEYRQMRMDLKREKEEEMRRLREERETMERNMRIQKKEEERKRKKEMRKRKYQESLRQASERYERMAYFWSDLANNSNVANALGVLFFYIFYRTVVLSYRKQKKDYEDRLKIERAEAEERRKMRELEREMEGIEGDDEESEQGKGEENAYLKMAKQFMKSGARVRRAQNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIYIPKPGLIGRIEILKVHARKKPMAEDVDYMAVASMTDGMVGAELANIVEVAAINMMRDSRTEITTDDLLQAAQMEERGMLDRKERSRETWKQVAINEAAMAVVAVNFPDLKNIEFVTIAPRAGRELGYVRVKMDSVKFNEGMLTRQSLLDHITVQLAPRAADELWFGSDQLSTIWAETADNARSAARTFVLGGLSEKYHGISNFWVSDRINDIDSEAMRIVNSCYERAKEILEQNRTLMDAVVNELVEKKSLTKQEFFRLVELHGSLKPMPPSILDLRVAKCSEFQKLINSEKETSLRSHA

SEQ ID NO: 3672 - protein, 884 aa, Citrus clementina
MACNFSFPSSLSLDIFPTKPKSKNPKNTQKFQFCTPFSCKNQIFNPENEDRNKNQNSKRPHLGLLTIPVTLTIISTSLAQKPAFAATKVASGKKKKSQKKTQEALTPEQLKKWSKDLPIVSDRIAYTEIFSLKDEGKLKHVIKSPSGSLRQKAEPVLVVLEDSRVLRTVLPSLDSNRKFWESWDELKIDSLCVNAYTPPLKKPEVPNPYLGFLWRVPASMLSTFRPKKESKRAAEIRRAREELKRQRKEELEKMREESEMMEKAMDMQKKEEERRRKKEIRLQKYEESLQDARDNYRYMANVWENLAKDSTVATGLGIVFFVIFYRTVVLNYRRQKKDYEDRLKIEKAEREERKKLRQLERELEGLEGADDEIEQGEAEQNPHLKMAMQFMKSGARVRRAYGKGLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRSLYQEAKDNAPSVVFIDELDAVGRERGLIKGSGGQERDATLNQLLVCLDGFEGRGNVITIASTNRPDILDPALVRPGRFDRKIFIPKPGLIGRMEILKVHARKKPMADDVDYLAVASMTDGMVGAELANIVEVAAINMMRDGRTEITTDDLLQAAQIEERGMLDRKERSPETWRQVAINEAAMAVVAVNFPDLKNIEFVTIAPRAGRELGYVRMKMDHMKFKEGMLSRQSLLDHITVQLAPRAADELWCGEGQLSTIWAETADNARSAARTFVLGGLSDKHFGLSNFWVADRINEIDTEALRILNLCYERAKEILQRNRNLLDAVVNELVEKKSLTKQEFFHLVELHGSLEPMPPSIVDIRAAKRSEIQEIMTTQNVTSIGSNA

SEQ ID NO: 3673 - protein, 884 aa, Citrus sinensis
MACNFSFPSSLSLDIFPTKPKSKNPKNTQKFQFCTPFSCKNQNFNPQNEDRNKNQNSKRPHLGLLTIPVTLTIISTSLAQKPAFAATKVASGKKKKSQKKTQEALTPEQLKKWSKDLPIVSDRIAYTEIFSLKDEGKLKHVIKSPSGSLRQKAEPVLVVLEDSRVLRTVLPSLDSNRKFWESWDELKIDSLCVNAYTPPLKKPEVPNPYLGFLWRVPASMLSTFRPKKESKRAAEIRRAREELKRQRKEELEKMREESEMMEKAMDMQKKEEERRRKKEIRLQKYEESLQDARDNYRYMANVWENLAKDSTVATGLGIVFFVIFYRTVVLNYRRQKKDYEDRLKIEKAEREERKKLRQLERELEGLEGADDEIEQGEAEQNPHLKMAMQFMKSGARVRRAYGKGLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRSLYQEAKDNAPSVVFIDELDAVGRERGLIKGSGGQERDATLNQLLVCLDGFEGRGNVITIASTNRPDILDPALVRPGRFDRKIFIPKPGLIGRMEILKVHARKKPMADDVDYLAVASMTDGMVGAELANIVEVAAINMMRDGRTEITTDDLLQAAQIEERGMLDRKERSSETWRQVAINEAAMAVVAVNFPDLKNIEFVTIAPRAGRELGYVRMKMDHMKFKEGMLSRQSLLDHITVQLAPRAADELWCGEGQLSTIWAETADNARSAARTFVLGGLSDKHFGLSNFWVADRINEIDTEALRILNLCYERAKEILQRNRNLLDAVVNELVEKKSLTKQEFFHLVELHGSLEPMPPSIVDIRAAKHSEIQEIMTNQNVTSIGSNA

SEQ ID NO: 3674 - protein, 608 aa, Cajanus cajan
KKEMRKRKYQESLRQASERYERMAYFWSDLANNSNVANSLGVLFFYIFYRTVVLSYRKQKKDYEDRLKIERAEAEERRKMRELEREMEGIEGDDEESEQGKGEENAYLKMAKQFMKSGARVRRAQNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIYIPKPGLIGRIEILKVHARKKPMAEDVDYMAVASMTDGMVGAELANIVEVAAINMMRDSRTEITTDDLLQAAQMEERGMLDRKERSRETWKQVAINEAAMAVVAVNFPDLKNIEFVTIAPRAGRELGYVRVKMDSVKFNEGMLTRQSLLDHITVQLAPRAADELWFGSDQLSTIWAETADNARSAARTFVLGGLSEKYHGISNFWVSDRINDIDSEAMRIVNSCYERAKEILEQNRTLMDAVVNELVEKKSLTKQEFFRLVELHGSLKPMPPSILDLRVAKCSEFQKLINSEKETSLRSHA

SEQ ID NO: 3675 - protein, 573 aa, Prunus persica
MACQCLLGSYSSSSLSPNPKPKTLNKNPPKPLAPSSISSHLSTTEDNDENDKTQKPNFDFLKLSVTLTVISTALPQIPTGIAAVKEKKRVPKKSTLKKSEALSHQELQSWSQGLPVEGKLKHVIKPPGVELQKRVEPVLVVLEDNRVLRTVLPSVDSDRRFWEQWEELKIESLCVNAYTPPLKRPEVPSPYLGFVAKWPAFLSLFVKPKKESKRAMELRRAREEFKTQRKEELERMRKERDMIDKAMKAQKKEEERRVRREMRKKKHDESLRQARRNYLEMANVWANLAQDSNVATALGLVFFYIFYRTVVFSYRRQKKDYEDRLKIEKAEAEERKKMRELEREMEGIEGEEEEEIEQGKGEQNPYLKMAMQFMKSGARLRRAHNKRLPQYLERGVDVKFSDVAGLGKIRLELEEIAKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFVERYISLSLVL

SEQ ID NO: 3676 - protein, 631 aa, Tripterygium wilfordii
MRKEREMMEKAFKFQKKQEERRIKREMRRRKSEESLSNAQRNYTRMGNMWADMAQDSTVVTALGLAFFVIFYRTVVLSYRKQKKDYEDRLKIEKAEAEERKKMRELEGDMLGLEDEEDESEQEKGEKNPYMKMAMQFMKSGARVRRAHNKRLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIFIPKPGIIGRMEILQVHARKKPMADDVDYLAVATMTDGMVGAELANIVEVAAINMMRDGRTEITTDDLLQAAQMEERGMLDRKERSPEMWKQVAINEAAMAIVAVNFPDLKNIEFVTIAPRAGRELGYVRMKMDHLKFKEGMLSRQSLLDHITVQLASRAADEIWYGEDKLSTIWAETADNARSAARTFVLGGLSEKYHGSSNFWIADRINDIDSEALRILNLCYDRAKEILLQNRTLLDAVVEELVQKKSLTKQQFSDLVELHGNLKPMPPSIIDIRASKRAQFQEIMQNQKETVVETNV

SEQ ID NO: 3677 - protein, 388 aa, Quercus alba
KRQNKEELEEMRKEREMMEKAIRVQKKEEARKRKMEERKRRHVASLQEARRNYEDMADMWARLAQDSNVATALGLVFFVIFYQTVVLNYRKQKKDYEDRLKIEKAEAEERKKMRELEREMEGIEGEDEEDEESGQGRGEQNPYLKMAMQFMKSGARVRRAHNKRLPQYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIYIPKPGLIGRIEILKVHARKKSMAEDVDYMAVASMTDGCRASQHS

SEQ ID NO: 3678 - protein, 884 aa, Citrullus lanatus
MACERFLTLSSPFPNSRLGILKPRTWRRPYPSISSQISTPYNFQRDEDNDSKKNNLNLLEIPVTLVILSTSLPISSALAATASKEVKERRRGPKKSSAKKVEALSPQELLLWSQGLPSVSNRIPYTEVLDLKREGKVKHVIKVPNGFLRVRSEPVMVVLEDSRVLRTVLPSVESNRRFWELWDELGIDSVCVNAYTPPIKPPDVPTPYLGFLARVPEFMYSFVKPKKESKRAVELRRVREELKMEKTVELAKMRQEREMIEKAMKMQKKEEERRIKREKRRKKQEESLREARKNYQHMAIVWANLARDSNVATALGLVFFVIFYRTVVFSYRRQKKDYEDRLKIEKAEAEERKKMRELERELEGVEGEDDDIEQGKGEQNPYLKMAMQFMKSGARVRRAHGNRLPQYLERGVNVKFEDVAGLGKIRLELEEIVKFFTQGEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGEVITIASTNRPDILDPALVRPGRFDRKIYIPKPGLIGRMEILKVHARKKPMAEDVDYMAVASMTDGMVGAELANIVEVAALNMIRDGRTEITTDDLLQAAQIEERGMLDRKERSTETWKQVAINEAAMAVVAVNFPDLKNIEFVTIAPRAGRELGYVRMKMNAIKYNEGMLTRQSLLDHITVQLAPRAADELWYGEDQLSTIWAETADNARSAARTFVLGGLSEKHHGVSNFWVADRINDIDMEALRTLNVCYERAKEILQQNRKLMDAVVDDLIQKKSLTKQEFLQLVELHGSVKPMPPSIIDLRIAKRTKFEEMMKNQKKIPVGSNSS

SEQ ID NO: 3679 - protein, 880 aa, Sesamum indicum
MACNCILNSSFLPSLPLYQHPNLRKPKTLFAISCNLGKNHSGNRREVKEDKEESIFKRAPLNLLKFSVTLTVISVSLPQPCLAAAKVSEKKRLGKRTEALTPEELRKWTQGLPVVSDRLAYSEILDLKRENKLRHIIKPPNVRLKQQPEVVLAVLEDNKVVRVVLPSVQSDSKFWEEWDELQINGLCINAYSPPLKKPEIPKPYLGFLSEIPSWMFSLVKPKPQSKKALELKRVREEFRRRKDEELAKMRQDRVMMEKAMNMQKKMAAKQRRMEIKKVKYEESLRQARRNSESMAYMWNRLASDSNVSTALGFVFFYIFYRTVVLNYKKQKKDYEDRLKIEKAEAEEKKKMRQLEREMAGIEAGDDEEEGGKEDDNPYMKMAEQFMRSGARVRRAQNRRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEAKENAPSVVFIDELDAVGRKRGLIKGSGGQERDATLNQLLVCLDGFEGRGEVITIASTNRPDILDPALVRPGRFDRKIYIPKPGLIGRVEILKVHARKKPMAPDVDYTAVASITDGMVGAELANIIEVAAINMMRDGRTEITTDDLLQAAQIEERGMLDRKERSPEVWKQVAINEAAMAVVAVNFPDLKNIEFVTIAPRAGRELGYVRMKMDHIKFKEGMLSRQSLLDHITVQLAPRAADELWYGKDQLSTIWAETTDNARSAARTFVLGGLSEKHYGLNNFWIEDRINYIDSEALRILEACYERAKLILQQNRALMDAIVNTLVEKKSVTKQEFFNLVNLHGSIQPMPASILDIRSAKRLELQNTLKNNKEAAALQGSR

SEQ ID NO: 3680 - protein, 884 aa, Fragaria vesca
MALQCLLGSYSSSSLPPSPTPKTPKPPPKSSISSHLATAPDNDDDDDEKTKKPNFDFLRLSVTLTVISASLPQTPTSRAAVKDKKPRASKKSSASRKSETLSPQELQSWSQGLPVVSNRIPYTQLLELSRESKLKHVIKPPGVELRQKAQPVLVVLEDSRVLRTVLPPAVADRRFWEEWEKLSLESLCVNAYTPPVKPPEVPLPYLSFLAKMPAVVAWLTRTRKPAKKESKRAAELRQAREAFKMQRKEELERMRSEREMIDRAMKAQKKEEERRLRREARKKKHDESLREARRNYLEMANVWANLAQDSNVATALGLVFFYIFYRTVVFSYRRQKKDYEDRLKIEQAEAEERKKMRDLERMEGIEGGEEDEEGEPGKGEQNPYMKMAMQFMRSGARVRRAHNKRMPQYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEAKDNAPSVVFIDELDAVGRERGLIKGSGGQERDATLNQLLVCLDGFEGRGEVITIASTNRPDILDPALVRPGRFDRKIFIPKPGLIGRIEILKVHARKKPMAEDVDYMAIASMSDGMVGAELANIVEVAAINMMRDGRTEITTDDLLQAAQMEERGMLDRKDRSIVTWKQVAINEAAMAVVAANFPDLKNIEFVTIAPRAGRELGYVRMKMDPINFKEGTLTRQSLLDHITVQLAPRAADELWFGEGQLSTIWAETADNARSAARTYVLSGLSEKNYGLSNFWVADRLNDLDVQALQIVNMCYERAKEILEQNRKLMDAVVDELVKKKSLTKQDFFNLVELHGSLKPVPPSLLDIRAAKRKQFQEMMKQKELVSGSNL

SEQ ID NO: 3681 - protein, 521 aa, Amsonia hubrichtii
MAGLEGDDDEEEGGKGEQNPYMKMAMQFMKSGARVRRAQNKRLPQYLERGVDVKFSDVAGLGKIREELEEIVKFFTHGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVSLDGFEGRGQVITIASTNRPDILDPALVRPGRFDRKIYIPKPGLIGRIEILKVHARKKPMAPDVDYMAVASMTDGMVGAELANIIEVAAINMMRDGRTEITTDDLLQAAQMEERGMLDRKERSPETWKQVAINEAAMAVVAVNFPDLRNIEFVTIAPRAGRELGYVRMKMDHVKFKEGMLSRQSLLDHITVQLAPRAADELWYGECQVSTIWAETADNARSAARTLVLGGLSEKYYGLNNFWVADRLNDIDSEALKITNMCYGRAKEILQRNRELMDAVVNALVEKKSLTKQEFFDLVQLHGSVQPMPPSIVDIRSAKQLEFQNMLRDQKEASLNSI

SEQ ID NO: 3682 - protein, 830 aa, Mimulus guttatus
MAGNCILNSPFSPAPPPPLLFRPNFPKPKTLARISCNLTETPETITTNEEEEKEEESKLRKAPLDLVKFSVTLTVISASLPQPSLAAAKVSEKKRLGKRTEALTPEELEKWTKGLPVVSHRLGYSEILDMKRENKIKHIVKPPNAGLKQRPEVVLVVLEDNKVVRSVLPSVESDPKFWQEWDELKIDGLCMTAYSPSVKNPDIPKPYLGFLSKIPLWMFSLLKTKPQSKKALELKRSIRQARRSSDSMAIVWERLASDSNVSTALGFVFFYIFYRTVVLNYRKQKKDYDDRLKIEKAEADEKKKMRDLEKEMAGIEDGDEEGEEGGKGEDNPYMKTAQQFMKSGARVRRAQRKKLPQFLERGVDVKFTDVAGLGKIRLELEEVVKFFTHGEMYRRRGVKIPGGILLCGPPGVGKTLLAKAVAGEAGVNFFSISASQFVEIYVGVGASRVRALYQDARENAPSVVFIDELDAVGRERGLIKGSGGQERDATLNQLLVCLDGFEGRGEVITIASTNRPDILDPALVRPGRFDRKIYIPKPGVIGRVEILKVHARKKPMAPDVDYMAVASMTDGMVGAELANIIEVAAINMMRDSRTEITTDDLLQAAQIEERGMLDRKDRSPEMWKQVAINEAAMAVVAVNFPDLRNIEFLTISPRAGREMGYVRLKMDNMKFKEGMLSRQSLLDHITVQLAPRAADGLFYGEHQLSTIWAETADNARSAARTLVLGGLSEKHYGLNNFWTANRINDIDSEALRILDICYERAKSILEQNRGLMDAVVDNLIEKKSLTKQEFFNLVELHGSIQSMPPSILDIRSAKLLQLQNIIADVEASHR

SEQ ID NO: 3683 - protein, 664 aa, Tabernaemontana elegans
MFSFVKPKPQSKKALELKRMREELKKRKNVELAKIREDNEMMEKTIKMQKKMEERKKRREMRKIKAAESLRQAQKSSQDMARLWANLASDSNVATALGFVFFFIFYQTVVLSYRRQKKDYEDRLKIEKAEAEEKKKMKELEREMAGIEGDDDEEEGGKGEQNPYMRMAMQFMKSGARVRRAQNKRLPQYLERGVDVKFSDVAGLGKIREELEEIVKFFTHGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGQVITIASTNRPDILDPALVRPGRFDRKIYIPKPGLIGRIEILKVHARKKPMAPDVDYMAVASMTDGMVGAELANIVEVAAINMMRDGRMEITTDDLLQAAQMEERGMLDRKERSPETWKQVAINEAAMAVVAVNFPDLRNIEFVTIAPRAGRELGYVRMKMDHVKFKEGMLSRQSLLDHITVQLAPRAADELWYGESQLSTIWAETADNARSAARTLVLGGLSEKYYGLNNFWVTDRLNDIDTEALRITNMCYERAKEILQRNRVLMDAVVSELVKKKSLTKQEFFNLVQLHGSVLPMPPSIVDIRSAKQLEFQNMLRDQKEASLKGA

SEQ ID NO: 3684 - protein, 533 aa, Artemisia annua
KRKMKELERGIAGLEPGDDEDEEGKQGEENPYMKMAQQFMKSGARVRRAQNARLSQYLERGVDVKFTDVAGLGKIRLELEEIVKFFTHGEIYRRRGVKIPGGILLCGPPGVGKTLLAKAVAGEAGVNFFSISASQFVEIYVGVGASRVRALYQEARDSAPSVVFIDELDAVGRERGLIKGSGGQERDATLNQLLVCLDGFEGRGNVITIASTNRPDILDPALVRPGRFDRKIFIPKPGLIGRVEILKVHARKKPMAEDVDYAAVAAMTDGMVGAELANIVEVAAINMMRDGRTEISTDDLLQAAQIEERGMLDKKDRSLEIWKQVAINEAAMAVVAVNFDDLRNIEFINIAPRAGRELGYVRVKMDHIKFKEGLLSRQSLLDHITVQLAPRAADEIWHGASQLSTIWAETADNARSAAREFVLGGLSDKYYGVSNFWVADRINDIDAEALRILNMCYGRAKEILEQNRRLMDAVVDALVEKRSLNRQEFINLVELHGVIKPSPPSILDMRAIKRAQMEPVIMKHKEEARQATI

SEQ ID NO: 3685 - protein, 889 aa, Phaseolus coccineus
MASHCFLRYPSSSFSLNPKFRNIPKPPYYPSISSRIRTPKSDNDENNDDNNKTPNHNRFDILKLSVTLTVISATLPQAAAAAAAVTKGKKRSSRKQSGKKPEALSPEELKTWSRGLPVVSDRLPYSEIIELKRDGKLKHIIKPTSAKLRQRSEAVLVVLDDSRVLRTVLPSVESHSSFWDSWDALKIDSVCVNAYTPPIKSPEWPTPLLSRIYVPPFVLKFLLAEDSETKPKKESKKAAEYRQMRLQLKKEKDDDLRRMRQEMETEERNIKAQKKEEEKRKRRAIRKRKYRESIRQASERNERMAYFWSDLANNSNVANALGVLFFYIFYRTVVLSYRKHKKDYEDRLKIEQAEAEERKKLRELEREMEGIEGDDEEIEQGKGEDNDYLKMAKQFMRSGARVRRAQNRRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARDNAPSVVFIDELDAVGRERGLIKGSGGQERDATLNQLLVCLDGFEGRGEVITIASTNRPDILDPALVRPGRFDRKIYIPKPGLIGRIEILKVHARKKPMAEDVDYMAVASMTDGMVGAELANIIEVAAINMMRDSRTEITTDDLLQAAQMEERGMLDRKERSTETWKQVAINEAAMAVVAVNFPDLKNIEFVTIAPRAGRELGYVRVKMDSVKFNNGMLTRQSLLDHITVQLAPRAADELWFGSDQLSTIWAETADNARSAARTFVLGGLSEKYYGMSNFWVSDRINDIDSEAMRILDLCYERAKEILEQNRRLMDAVVNELVEKKSLTKQEFFHLVDLHGSLKPMPPSVLDIRIAKCREFQKQIDSGKEASLSSQA

SEQ ID NO: 3686 - protein, 883 aa, Glycine max
MASHCFLRFPPSSFSLNPKSKRLPKPRYHPSIFSRIQTPNPDEDDKVPNDNRIDFLKLSVTLTVISASLPKPAAAATTKVKKRSPKKQSAKKPEGLSPEELKTWTSGLPVVSDRLPYSEIIELKKSGKLKHVIKPNSAKLRQRGEAVLVVLDDSRVLRTVLPSLESHSKFWDSWDELKIDSVCVNAYTPPIKSPELPTSLLANIWVPPFVQKFIAYVFEERQTKPKKESKKAAEFREMRMQLQREKEEELRKSREERETMDRNMKAQKKEEGKRRKREIRKRKYKESLRQASDRNKKMAYFWSDLANNSNVANALGVLFFYIFYRTVVLSYRKQKKDYEDRLKIERAEAEERRKMRELEREMEGIEGDDEEGEQGKGEENAYLKMAKQFMKSGARVRRAQNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGEVITIASTNRPDILDPALVRPGRFDRKIYIPKPGLIGRIEILKVHARKKPMAEDVDYMAVASMTDGMVGAELANIIEVAAINMMRDSRTEITTDDLLQAAQMEERGMLDRKERSSETWKQVAINEAAMAVVAVNFPDLKNIEFVTIAPRAGRELGYVRVKMDSVKFNQGMLTRQSLLDHITVQLAPRAADELWFGSGQLSTIWAETADNARSAARTFVLGGLSEKYHGMSNFWVSDRINEIDSEAMQIVNSCYERAKEILEQNRTLMDALVNELVEKKSLTKQEFFHLVELHGSLKPMPPSILDIRVAKCREFQKLIGSGKETSLSSHA

SEQ ID NO: 3687 - protein, 887 aa, Glycine max
MASHCFLRFPPSLNPKYKRLPKPRYYPSISSRIQTPKPDNDDDNDKTPNDNRFDFLKLSVTLTVISASLPQPAAAAAAATRKVKKRSPKKQSAKKAEGLSPEELKTWTSGLPVVSDRLPYSEIIELKKSGKLKHIIKPNSAKLRQRGEAVLVVLDDSRVLRTVLPSLESHSKFWDSWDELKIDSVCVNAYTPPIKSPELPTSLLANIWVPPFVQKFITYVFEERQTKPKKESKKAAEYREMRMQLQREKEEELRKSREERETMERNTRARKKEEERRKKREIRKRKYKESLRQASDRNERMAYFWSDLANNSNVANALGVLFFYIFYRTVVLSYRKQKKDYEDRLKIERAEAEERRKMRELEREMEGIEGDDEEGEQGKGEENAYLKMAKQFMKSGARVRRAQNKRLPQYLERGVDVKFSDVAGLGKIRLELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVSLDGFEGRGEVITIASTNRPDILDPALVRPGRFDRKIYIPKPGLIGRIEILKVHARKKPMAEDVDYMAVASMTDGMVGAELANIIEVAAINMMRDSRTEITTDDLLQAAQMEERGMLDRKERSTETWKQVAINEAAMAVVAVNFPDLKNIEFVTIAPRAGRELGYVRVKMDSVKFNQGMLTRQSLLDHITVQLAPRAADELWFGSGQLSTIWAETADNARSAARTFVLGGLSEKYHGMSNFWVSDRINEIDSEAMRIVNSCYERAKEILEQNRTLMDALVNELVEKKSLTKQEFVRLVELHGFLKPMPLSILDIRVAKCREFQKLIDSGKETTSLSSHA

SEQ ID NO: 3688 - protein, 500 aa, Gossypium hirsutum
MAMQFMKSGARVRRAQNKRLPQYLERGVDVKFSDVAGLGKIRLELEEIVKFFTHGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGNVITIASTNRPDILDPALVRPGRFDRKIFIPKPGLIGRMEILQVHARKKPMAEDVDYMAVASMTDGMVGAELANIVEVAAINMIRDGRTEITTDDLLQAAQIEERGMLDRKERSPETWKQVAINEAAMAVVAVNFPDLRNIEFVTIAPRAGRELGYVRMKMDHIKFTKGMLSRQSLLDHITVQLAPRAADELWFGEGQLSTIWSETADNARSAARMFVLGGLSEKHHGLSNFWVADRINEIDSEALQIVNICYERAKEILQQNRKLMDAVVDELVEKKSLTKQEFFGLVELHGSLQPMPPSIVDVRVAKRTQFQEMMMNPNVKVTGSSSS

SEQ ID NO: 3689 - protein, 865 aa, Solanum phureja
MACNSILNSPFLPSFPSKNKPHYRKNTIPVIISCNSHKPRTEEDKKIRINQLGLLNLSVTLTVISASLVRPANAAKVSEKRKKSEALTPQELKKWSQGLPTVSNRLPYTEILDLKREGKLKHIIKPPNVGLKQRPEVVLAVLEDSKVVRIVLPSVESDPRFWAEWDELKVDGLCMNAYTPPLKKPELPSPYLGFLSNIPAWLFSFMKAKPQSKKALELKRMREELKRRQNQELAKIRNERERMEKAMKMQKKMEESKRKRELKRMRYEESLRQASRSSHDMAMVWESLASDSNVSTALGLVFFYIFYRTVVFSYRRQKKDYDDRLKIEKADAEEKKKLRELEREMEGIEGVDDDEEEGRKGEENPYMKMAMQFMKSGARVRRARNTKLPQYLERGIDVKFSDVAGLGKIREELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGKGEVITIASTNRPDILDPALVRPGRFDRKIYIPKPGLIGRIEILKVHARKKPMAPDVDYMAVASMTDGMVGAELANIVEVAAINMMRDARTEITTDDLIQAAQIEERGMLDRKERSPEMWKQVAINEAAMAVVAVNFPDLRNIEFLTIAPRAGRDLGYVRMKMDHVKFKEGIRQSLLDHITVQIAPRAADELWYGEHQFSTIWAETADNARSAARTFVLGGLSDKHYGLSDFWVADRINDIDSEALRILHMCYDRAKEILHQNRNLMDAVVDILVEKKSLTKEGFFKLVELHGSLQPMPPSVVDLRSAKRLEFQDTLTKQKEIISQGRN

SEQ ID NO: 3690 - protein, 349 aa, Flaveria ramosissima
SDILDLRREGKLKHVVKPSGKGLKERPVVVLAVLEDSRVVRLVVPSVESDPKFWKVWDELEIDSICVQAYTPPVKTPDVPRPFLGFLSRFPLWMYSLVKPKPVSKKVLELRKQREELKKSKINEMLSMKKKTAQMEKAARAQKKMEERKKKMEAQKLNSEQAMLEARLKYYRMSNMWKELARDSNVTLGIGLLFFVIFYQTVVLSYKKQKKDYEDRLKIEKAEAEEKRKMKELERGMAGFEDDDDEGEGKSGEENPYMKMAQQFMKSGARVRRAQNPKNAKLSQYLERGVDVKFSDVAGLGKIRLELEEIVKFFTHGEIYRRRGVKIPGVYFFVGPRSGKDIVSKSSCW

SEQ ID NO: 3691 - protein, 886 aa, Cucumis sativus
MACERFLTLSSPFSSARLGTLKPRTWRRPHPSISSQISTPSDSPTDEHNDSKKKNKLNFLQISVTLSILSTSLPMSSALAAAASKEVKERRRGPKRSSAKKAESLSPQELLSWSQGLPAISNRIPYTELLDLKREGKVKHVIKNPNGFLRLRSELVMVILEDSRVLRTVLPSVESNRRFWVLWNELGIDSVCVNAYTPPIKPPELPTPYLGFLARVPFFMFYFGQPKKESKRVAQLRRLRDEVKMETTTELTKMRQENEKIEKAMKMQKKQEERRIKRETRRKKQVESLREARKISENMGMIWEELANSPNVAFALGLVFFVIFYRTVVLSYRRQKKDYEDRLKIEEAEAEERKKMLELETDLEVTEGEDDDIEQGKGEQNPYLKMATQFMKSGARVRRAHGKRLPQYLEKGVNVKFEDVAGLGKIRLELEEIVKFFTQGEMYRRRGVKIPGGILLSGPPGVGKTLLAKAVAGEAGVNFFSISASQFVEIYVGVGASRVRALYQEAKENAPSVVFIDELDAVGRERGLIKGSGGQERDATLNQLLVCLDGFEGRGEVITIASTNRSDILDPALVRPGRFDRKIYIPKPGLIGRMEILKVHARKKPMAEDVDYMAVASMTDGMVGAELANIVEVAALNMIREGRTEITTDDLLQAAQIEERGLLDRKERSPDTWKQVAINEAAMAVVAVNFPDLENIEFVTIAPRSGRELGYVRMKMNAMKYNEGMLTRQSLLDHITVQLAPRAADELWHGEDQLSTIWAETADNARSAARTFVLGGLSEKHHGVSNFWVADRINDIDLEALRILSVCYERAKEILQQNRKLMDAVVDGLIQKKSLSKQEFLRLVKLHGSIKPMSPSIIDLRIAKRAKFDEEMKKNQKKIPVGSNSS

SEQ ID NO: 3692 - protein, 279 aa, Flaveria ramosissima
MAEDVDYAAVAAMTDGMVGAELANIVEVAAINMMRDGRTEITTDDLLQAAQIEERGMLDKKDRSPEMWKQVAINEAAMAVVAMNFRDLSNIEFINIAPRAGRELGYVRMKMDHIKFKEGLLSRQSLLDHITVQLAPRAADEIWHGESQLSTIWAETADNARSAARALVLGGLSDKYYGVSNFWVADRINDIDSEAIRILNVCYGRAKEILEKNRKLMDAVVDKLVEKKSLNKQEFLNLVELHGCIQPGPPSILDIRALKQAQMQSVMMKHKEEANQVVT

SEQ ID NO: 3693 - protein, 865 aa, Solanum lycopersicum
MACNSILNSPFLPSFPPKNKPHYRKNTIPVIISCNSHKPRTEEEKKIRISQLGLLNLSVTLTVISASLVRPANAAKVSEKRKKSEALTPQELKKWSQGLPTVSNRLPYTEILDLKREGKLKHIIKPPNVGLKQRPEVVLAVLEDSKVVRIVLPSVESDPRFWAEWDELKVDGLCMNAYTPPLKKPELPSPYLGFLSNIPAWLLSFMKAKPQSKKALELKRMREELKRRQKQELAKIQNERERMAKAMKMQKKMEESKRKRELKRMRYEESLRQANRSSRDMAMVWESLASDSNVSTALGLVFFYIFYRTVVFSYRRQKKDYDDRLKIEKADAEEKKKLRELEREMEGIEGVDDDEEEGRKGEDNPYMKMAMQFMKSGARVRRARNTKLPQYLERGIDVKFSDVAGLGKIREELEEIVKFFTHGEMYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGKGEVITIASTNRPDILDPALVRPGRFDRKIYIPKPGLIGRIEILKVHARKKPMAPDVDYMAVASMTDGMVGAELANIVEIAAINMMRDARTEITTDDLIQAAQIEERGMLDRKERSPEMWKQVAINEAAMAVVAVNFPDLRNIEFLTVAPRAGRDLGYVRMKMDHVKFKEGIRQSLLDHITVQIAPRAADELWYGEHQFSTIWAETADNARSAARTFVLGGLSDKHYGLSDFWVADRINDIDSEALHVLHMCYDRAKEILHQNRNLMDAVVDILVEKKSLTKEGFFKLVELHGSLQPMPPSVVDLRSAKRLEFQDTLTKHKEIISQGRN

SEQ ID NO: 3694 - protein, 532 aa, Cucumis melo
MQELERELEDTEGEADDIEQGKGEQNPYLKMAMQFMKSGARVRRVHGKRLPQYLEKGVNVKFEDVAGLGKIRLELEEIVKFFTQGEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGEVITIASTNRPDILDPALVRPGRFDRKIYIPKPGLIGRLEILKVHARKKPMAEDVDYMAVASMTDGMVGAELANIVEVAALNMIREGRTEITTDDLLQAAQIEERGMLDRKERSPDTWKQVAINEAAMAVVGVNFPDLGNIEFVTIAPRAGRELGYVRMKMNAITFNEGMFTRQSLLNRITVQLAPRAADELWHGEDQLSTIWAETADSARSAARTLVLGGFSEKHHGVSNFWVADRINNIDLEALRILSFCYERAKEILQQNRKLMDAVVDGLIRKKSLSKQEFLHLVKLHGSIKPMSPSIIDLRIAKRAKFDEEMMKKNQKKIPVGSNSS

SEQ ID NO: 3695 - protein, 508 aa, Fagus grandifolia
RGEQNPYLKMAMQFMKSGARVRRAHNKRLPQYLERGVDVKFTDVAGLGKIRLELEEIVKFFTHGEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGEVITIASTNRPDILDPALVRPGRFDRKIYIPKPGLIGRIEILKVHARKKPMAEDVDYMAVASMTDGMVGAELANIVEVAAINMMRDGRTEITTDDMLQAAQMEERGMLDRKERSPETWKQVAINEAAMAVVAVNFPDLKNIEFLTIAPRAGRELGYVRMKMDPIKFNEGMLTRQSLLDHITVQLAPRAADEIWYGEGQLSTIWSETADNARSAARTFVLGGLSEKHHGLSEFWVADRINEIDVEALRIVNMCYERAKEILQQNQKLMDAVVDELVQKKSLTKQEFLHLVELHGSLKPMPPSILDIRTARRAQFQEMMMNQNEVTVESKL

SEQ ID NO: 3696 - protein, 562 aa, Helianthus annuus
LELRKQREELKKSRINETMSVKKKMAQMEKAARAQKKTEERKKKMEEQKLNSEQAMIEARLKYYRMSNMWKELARDSNVTLGIGLLFFVIFCQTVVLSYKKQKKDYEDRLKIEKAEAEEKRKMKELERGMAGLEDEDDDGEGKSGEENPYMKMAQQFMKSGARVRRAQNSKNVKLSQYMERGVDVKFSDVAGLGKIRLELEEIVKFFTHGEIYRRRGVKIPGGILLCGPPGVGKTLLAKAVAGEAGVNFFSISASQFVEIYVGVGASRVRALYQEARDCAPSVVFIDELDAVGRERGLIKGSGGQERDATLNQLLVCLDGFEGRGNVITIASTNRPDILDPALVRPGRFDRKIFIPKPGLIGRLEILKVHARKKPMAEDVDYAAVAAMTDGMVGAELANIVEVAAINMMRDGRTEITTDDLLQAAQIEERGMLDKKERSPEMWKQVAINEAAMAVVAINFHDLSNIEFINIAPRAGRELGYVRMKMDHIKFKEGLLSRQSLLDHITVQLAPRAADEMWHGEGQLSTIWAETADNARSAARAFVLGGLSDKYYGVFISGLQIG

SEQ ID NO: 3697 - protein, 873 aa, Elaeis guineensis
MELASSSSLFFSQLSVRPTPPRIRFCSKKRSNSPKSLIACHLIGPEESDDKETKKSRIGLLQLSVTLTVISSSLPQSPAQAKVAEKKRPAKKSTEALSPEELKSWSRGLPTVGDRIPYTEILNLKEEGKLKHIVKLPSVNLKQRTDPVLVILEDSRVLRTVLPTIERDDKFWESWDRLQLNSVCINAHTPPIRKPEVPSPYLGWLAKFPMSFLKPKPKSKRVLELEKARKELAERRKTELAMVRQEREEMEKALRAQKKADERRRRLEVRKAKHEESLRQARKNYRQMALVWADIARDKNVATAIGALMFYIFYRTVVLSYRKQQKDYEDRLKIEKAEAEERKKMRELERELVGLEGSGEDESEEKGEQNPYLKMAKKFMQSGARVRRANSKRLPQYMERGVDVKFSDVAGLGNIRLELEEIVKFFTLGEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGDVITIAATNRPDILDPALVRPGRFDRKIYIPKPSLIGRVEILKVHARKKPMADDVDYVAVASMTEGMVGAELANIVELAAINMMRDGRSEITTDDLLQAAQIEERGMLDKKDRSPEMWKRLAINEAAMAVVAVNFPDIKNIEFVTIAPRAGRELGYVRVKMDHMKFKEGMLSRQSLLDHVTVQIAPRAADEIWYGENQLSTIWAETADNARSAARSFVLGGLSEKYYGLSDFWVADRINEIDLEALHVLNDCYERAKEILRRNRVLMDSVVNRLVDKKSLTKQEFFNLVREHGHLEPMPRSIVDIRNSKRLQFQQMMMAQKESAHGSRV

SEQ ID NO: 3698 - protein, 175 aa, Ambrosia trifida
MTDGMVGAELANIVEVAAINMMRDGRTEITTDDLLQAAQIEERGMLDKKERSPEMWKQVAINEAAMAVVAMNFSDLSNIEFINIAPRAGRELGYVRMKMDNIKFKEGLLSRQSLLDHITVQLAPRAADEMWHGEGQLSTIWAETADNARSAARAFVLGGLSDKYYGVSDSGWQIE

SEQ ID NO: 3699 - protein, 852 aa, Musa acuminata
MELAASSSLLFSSLPLAPSPPKAPFRSIPRKCFVPRNSLSVTMTVISSSLPLPRAHAGVTEKKPRPKRPAETLSPEELKSWSRGLPTVGDRIPYTEILTLRDEGKLRHIVKPPSVTLKLRPNLVLVVLDDSRVLRAVLPAAERDERFWESWDRLELDSFCINAYTPPVRKPEVPTPYLGWLVNIPGHFLSMEKPKPKSKRVLELENARKELAERRREELARVRAEREAMEKIMKAQKKAEERKRRKQIKKAKYEESLRQARKNYQRMAYMWDDMARDKNVATAIGFVIFYVFYRTVVLNYRKQQKDYEDRLKIEKAEAEERKKMRQLEREMAGLEGPGEDESEERGDEQNPYMKMAMKFMQSGARVRRANSKVPQYLERGVDVKFSDVAGLGKIRLELEEIVKFFTLGEMYRRRGIKIPGGILLCGPPGVGKTLLAKAVAGEAGVNFFSISASQFVEIYVGVGASRVRALYQEAKENAPAVVFIDELDAVGRERGLIKGSGGQERDATLNQLLVCLDGFEGRGNVITIAATNRPDILDPALVRPGRFDRKIFIPKPSLIGRIEILKVHARKKPMADDVDYMAVASMTNGMVGAELANIIEIAAINMIRDGRSEITTDDLLQAAQIEERGMLDKKDRRPEMWKRLALNEAAMAIVAVNFPDLKNIEFITIAPRAGRELGYVRVKMDHIKFTKGMLSRQSLIDHITVQIAPRAADEIWFGENQLSTIWAETADNARSAARSFVLGGLSEKYHGLSNFWVADRINDIDLEAQRLLNNCYDRAKEILRRNKELMDVIVDQLVQKKSLTKQEFFRLVEEYGHVDQMPKNIIDIRKTKLLQFQQMMMAGKERAQGSLV

SEQ ID NO: 3700 - protein, 345 aa, Ambrosia trifida
MKMAKQFMKSGARVRRAQNTKNTKLSQYMERGVDVKFSDVAGLGKIRLELEEIVRFFTHGEVYRRRGVKIPGGILLCGPPGVGKTLLAKAVAGEAGVNFFSISASQFVEIYVGVGASRVRALYQEARDSAPSVVFIDELDAVGRERGLIKGSGGQERDATLNQLLVCLDGFEGRGNVITIASTNRPDILDPALVRPGRFDRKIFIPKPGLIGRVEILKVHARKKPMAEDVDYDAVAAMTDGMVGAELANIVEVAAINMMRDGRTEITTDDLLQAAQIEERGMLDKKDRSPEMWKQVAINEAAMAVVATNFPDLSNIEFINIAPRAGRELGYVRMKWTRSNLRKGC

SEQ ID NO: 3701 - protein, 307 aa, Silene vulgaris
MRELEKQMEGLEGEDEEEGKPGEDDAYMKMAMQFMRSGARVRRARNRRLPQYLERDVDVKFSDVAGLGKIRLELEEIVKFFTHAEMYRRRGVKIPGGILLCGPPGVGKTLLAKAVAGEAGVNFFSISASQFVEIYVGVGASRVRALYQEAKENAPSVVFIDELDAVGRERGLIKGSGGQERDATLNQLLVSLDGFEGRGDVITIASTNRPDILDPALVRPGRFDRKIHIPRPSLQGRIEILQVHARKKSMAEDVDYASVANMTDGMVGAELANIIEVAAINMLRDGRNEITTDDLLQAAQMEERGNA

SEQ ID NO: 3702 - protein, 526 aa, Aristolochia fimbriata
MRKLEKETQGIEDNAEDIEEGEGEENPYMKMATQFMRSGARVRRARSRRPPQYLDQSVDVKFSDVAGLGKIRLELEEVVKFFTQGEMYRRRGVRIPGGILLCGPPGVGKTLLAKAVAGEAGVNFFSISASQFVEIYVGVGASRVRALYQEAKENAPSVVFIDELDAVGRERGLIKGSGGQERDATLNQLLVCLDGFEGRGEVITIAATNRPDILDPALVRPGRFDRKIYIPKPSLVGRIEILKVHARKKPMAEDVDYMAVASMTRGMVGAELANIIEVAAISMMRDGRSEITTDDLLQAVQIEERGMLDRKERTPEMWKQLAINEAAMAVVAVNFPDMKNIEFVTIAPRAGRELGYVRVRMDHIKFQEGMLSRQSVLDHITVQVAPRAADEIWYGEEQLSTIWAETADNARSAARSFVLGGLSEKNYGLSNFWVADHINEIDLEAMRILSLCYQRAKEILQRNRKLMDAVVDELTLKRNLTKHEFSRLVEAYGSLEPEPPNIIDIRISKRAKFQEMMMGKKETAAH

SEQ ID NO: 3703 - protein, 472 aa, Cirsium arvense
EYLERDVDVKFTDVAGLGKIRLELEEIVKFFTHGEIYRRRGVKIPGGILLCGPPGVGKTLLAKAVAGEAGVNFFSISASQFVEIYVGVGASRVRALYQEARENAPSVVFIDELDAVGRERGLIKGSGGQERDATLNQLLVCLDGFEGRGNVITIASTNRPDILDAALVRPGRFDRKIFIPKPGLIGRVEILKVHARKKPMAHDVDYVAVAGMTEGMVGAELANIVEVAAINMMREGRTEITTDDLLQSAQIEERGMLDKKDRSPEIWKQVAINEAAMAVVAVNFQDLKNIEFITIAPRAGRELGYVRVKMDYIKLEQGFLSRQSILDHITVQLAPRAADEIWYGEGQLSTIWAEAADIARSAARALVIGGLSDSNYGVPISWDTDRINDIDTEALRILNMCYERTKKILEQNRKLMDAVVDALVEKRSMNKQEFMNLVELHGCIEPSPPSILDIRANKRAQMQSMIAQGSSS

SEQ ID NO: 3704 - protein, 878 aa, Aquilegia formosa
MDCFCTLSSSSSRFPSSSSSSILPVKSFPRSKRLFPSSISCNSKEFEEENEEKTKKIGLNLLQFSVTLTIVSSSFPLQSAMAAKVSSEKKRAAKKPAEALSPEELKSWFKGLPIVNDRIPYTEVLNLKEEGILKHIVKLPTAKLKQRPDSVLIVLEDSRVLRTVLPVIERDDKFWKSWDELELDSLCINAYTPPIKKPEIPSPYLGVLSKISTYLLSFAKGKPLSKRAQEIRRARNELQARTNFQLAKLRKDGERMERVIRAQMRREERKKKKELGKTHYREKLLIARKHYEYMARYWIRMSRDDNVATALGCLFFYIFYRTVILNYKRQQKDYEDRLKIEKAEAEERKKMRELERQFEGGESVDDENEEGKTEDNPYLKMAMQFMKSGARVRRAHSKKLPQYQERGLDVKFSDVAGLGKIRLELEEVVKFFTHGEMYRRRGVKIPGGILLCGPPGVGKTLLAKAVAGEAGVNFFSISASQFVEIYVGVGASRVRALYSEAKENAPSVVFIDELDAVGRERGLIKGSGGQERDATLNQLLVCLDGFEGRGEVITIAATNRPDILDPALVRPGRFDRKIYIPKPGFVGRAEILKVHARKKPMAEDVDYMAVASMAVGMVGADLANIIEVAAINMMREGRSEITTDDLLQAAYIEERGTLEKKDRSIDMWKQLALNEASMAVVAVNFPDTKNIEFITISPRAGREMGYVRFKIDYVKFKEGLLSRQSLLDHITVQLAPRAADEIWYGEDKLSTIWAETADNARSAARSFVLGGLSEKHHGLSEFWVADRLNEIDVEALRILNMCYVRAKEILQKNRNLMDAMVNELIEKKNLTKQEFFHLVELHGCLEPLPPSIVEIRDAKRRQLQAALMGKETPQGSSI

SEQ ID NO: 3705 - protein, 664 aa, Papaver somniferum
MSFMKTKPLSKRALEIQMARKELQMRKKFELARVKNEGEMMEKALRMQKKTEERERRKEIRRIEQEESLRRSKESYERMALVWANMAHDQTIAGFLGVFFFYLFYRVVVLNYRQQQKDYEDRLKIEKADREERQKMRRLEKEMEGTEGEEDEVEGKDGDKNPYMKMANQFMKSGARVRRARHRRLPQFQDRGVDVKFTDVAGLGKIRLELEEVVKFFTHGEMYRRRGVKIPGGILLCGPPGVGKTLLAKAVAGEAGVNFFSISASQFVEIYVGVGASRVRALYQEARENAPSVVFIDEIDAVGRERGLIKGSGGQERDATLNQLLVCLDGFEGRGNVITIAATNRPDILDPALVRPGRFDRKIYIPKPGQIGRIEILKVHARKKPIAEDVDYMAVASMAEGMVGAELANIIEVAAINMMRDERTEITTDDLLQAVQIEERGTLDRKDRSLEMWKQLALNEVAMAVASVNFPDLKNVEFVTISPRAGREMGYVRVKMDHLKFSEGMLSRQSLLDHITVQLAPRAADEIWYGKDQLSTIWAETGDNARSAARSLVLGGLTDKHYGLSDFWVAERLDDIDLEALQILNTCYQRVKEILKRNQTLVNVMVDELVRKKTLTKQEFFRLVDLHGSLEPIQPTILDIRAANRKKLQEKMMHQMKVSQQSSM

SEQ ID NO: 3706 - protein, 872 aa, Cirsium arvense
MAAQCIPASSLFSSISLSRRLQSRRIRYSVNVNSSIRCEKCNLETEEESKSRLNALNLLQISVTLTIISASLPQPVLAAKVSQKKRSPKKVEALTPQEWRKWSQGLPVVANRIPYTDILELKRDGKLKHIVKPPGKGLKERPVVVLAVLEDSKVVRLVVPSLESDQKFWEAWDALEIDSMCIQAYTPPVKMPDVPRPFLGFLLKVPMWMYSFVKPKPVSKKVLELRKAREELKKSRSNEMLSRKKEMVNKEKAMRAQKKMEERKKKLEAQKFRTEQSINIARAKYYRMSNMWRELSEDPNVTLGVGLLFFFLFYKTVILNYKKQRKDYEDRLKIEKVEAEEKRKMKDLERGMGGDEEDEEEEGKQGEDNPYMKMAAQFMKSGARVRRAQRAKRSEYLERDVDVKFTDVAGLGKIRLELEEIVKFFTHGEIYRRRGVKIPGGILLCGPPGVGKTLLAKAVAGEAGVNFFSISASQFVEIYVGVGASRVRALYQEARESAPSVVFIDELDAVGRERGLIKGSGGQERDATLNQLLVSLDGFEGRGNVITIASTNRPDILDPALVRPGRFDRKIYIPKPGLIGRIEILKVHARKKPMAEDVDYAAVAGMAEGMVGAELANIVEVAAINMMREGRTEITTDDLLQSAQIEERGMLDKKDRSPEIWRQVAINEAAMAVVAMNFHDLKNIEFINIAPRAGRELGYVRVKMDYIKFEQGFMSRQSMLDHITVQLAPRAADEIWHGEGQLSTIWAEAADIARSAARALVLGGLTDNYYGVPIAWAPDRINDIDTEALRILNTSYERAKKILEQNRKLMDAVVDALVEKRSLNKQEFMNLVELHGCIQPSLPSILDIRAKKRAQMQSITVKHKEEANPAST

SEQ ID NO: 3707 - protein, 252 aa, Brassica napus
MPLEEKQKYPLEPGTVQGYGQAFIFSEDQKLDWCNMFALGVHPPSIRNPKLWPSKPARFSESLKGYSKEIRKLCKRLLTYIAISLGLKKERFEEMFGEAVQAVRMNYYPPCSSPDLVLGLSPHSDGSALTVLQQSKDSCVGLQILKDNTWVPVLPLPNALVINIGDTVEVLTNGKYKSVEHRAVTNRERERLTIVTFYAPNYEVEIEPMGELVDDETNPCKYRSYNHGDYSYHYVSNKLQGKKSLDFAKILN

SEQ ID NO: 3708 - protein, 317 aa, Brassica napus
LHLHHHIPVVDLSKLSKPHTDDDFLFEILKLSQACEDWGFFQVINHGIEVGVVEDIEKVAKEFFEMPLEEKKKYPMEPGTVQGYGQAFIFSEDQKLDWCNMFALGVHPPSIRNPKLWPSKPARFSENLEGYSKEIRKLCKRLLKYIAISLDLKEERFEEMFGEAVQAVRMNYYPPCSRPDLVMGLSPHSDGSALTVLQQSKNSRVGLQILKDNTWVPVLPLPNALVINIGDTIEVLTNGKYKSVEHRAVTNRERERLTIVTFYAPNYEVKIEPMGELVDDETNPCKYRSYNHGDYSYHYVSNKLQGKKSLDFAKILN

SEQ ID NO: 3709 - protein, 382 aa, Trigonella foenum-graecum
MDELTTNIQEESDEFRLPTKQELEEEALSPPDLSNLQRRIKEIVRVLSNFAALRQDGATRKDYVDQLKTDIRSYYGYNEFLIGALVEMFPVVELMELIEAFEKPRPICLRTNTLKTRRRDLADVLINRGVNLDPLSKWSKVGLVVYDSQVPIGATPEYMAGFYMLQSASSFLPVMALAPQEKERIVDMAAAPGGKTTYIAALMKNSGIIFANEMKVPRLKSLTANLHRMGVSNTVVCNYDGRELPKVMGFNSVDRVLLDAPCSGTGVISKDESVKTSKNLEDIKKCAHLQKELLLAAVDMVDSYSKSGGYVVYSTCSIMVAENEAVIDYVLKRRDVKLVPCGLDFGRPGFTKFREQRFHPSLDKTRRFYPHVHNMDGFLLQS

SEQ ID NO: 3710 - protein, 614 aa, Glycine max
MAPARKKPSKPSKSPKNPRKTHPKHDSTSESEEDTPPQLQPEQLELGDDNSDSASELSSDGDDPLADDFLQGTDDDEEKGSGSESGLESGSDSDSDDGDIEKKSRAIDEEKAKEEEDADAEMQLNINQESDEFRLPTKEELDEEALRPPDLSNLQRRTKEIVRVLSNFKALRQDGSTRKEYVEQLKKDLCTYYGYNEFLIGALVEMFPVVELMELIEAFEKPRPICLRTNTLKTRRRDLADVLINRGVNLDPLSKWSKVGLVVYDSQVPIGATPEYMAGFYMLQSASSFLPVMALAPQEKERVVDMAAAPGGKTTYIAALMKNTGIIFANEMKVPRLKSLTANLHRMGVSNTVVCNYDGKELPKVLGVNAVDRVLLDAPCSGTGVISKDESVKTSKSLEDIQKCAHLQKELILAAIDMVDANSKSGGYVVYSTCSIMVAENESVIDYALKKRDVKLVPCGLDFGRPGFTKFREQRFHPSLEKTRRFYPHVQNMDGFFVAKLKKMSSSKPGAISSETAEKEDTTSFVEEKEKSSDGIKENGNVSSESEKGKKRKFPSKPSNGLKSNGKESSESEPKKRNKRQFPSKEEISKAREDKRNALREKRRKGGKQQKNKK

SEQ ID NO: 3711 - protein, 611 aa, Cajanus cajan
MAPPRKKPSKPRKSPKNPKRTEPKHDSSDESEEEMPPQQLELGDDGADSDSASELSSDGDDPLADDFLQGSDDEEKASGSDSGSGSGSDSDDDDIEKKSRAIDEEKAREEEDAEAEMQLNINQESDEFRLPTKEELEEETLRPPDLTNLQRRIKEIVRVLSNFKALRQEGSTRKDYVEQLKKDISTYYGYNEFLIGALVEMFPVVELMELIEAFEKPRPVCLRTNTLKTRRRDLADVLINRGVNLDPLSKWSKVGLVVYDSQVPIGATPEYMAGFYMLQSASSFLPVMALAPQEKERVVDMAAAPGGKTTYIAALMKNTGIIFANEMKVPRLKSLTANLHRLGVSNTVVCNYDGKELPKVLGVNAVDRVLLDAPCSGTGVISKDESVKTSKSLEDIQKCAHVQKELILAAIDMVDANSKSGGYVVYSTCSIMVAENEAVIDYALKKRDVKLVPCGLDFGRPGFIRFREQRFHPSLEKTRRFYPHVHNMDGFFVAKLKKMSSSKPGAKPSETAEEEETTTSVKEKEKSTDGIKENGNVSSEPESKKMKKRKFPSKPSNGLKEKGKESSESEPKKRMKRQFPSKEEISKAREEKRNALREKKRKGSKKQQKQK

SEQ ID NO: 3712 - protein, 603 aa, Medicago truncatula
MAVPPSATPASLYVGDLHPDLSDSQLHDAFSDFKTLASVRICRDSSSGKSLCYGYVNFLSPHDAIRAIEVKNHSTLNGKAIRVMWSRRDPDARKSCIGNVFVKNLAESIDNSGLEDMFKKFGNILSSKVVMSEDGKSKGYGFVQFETEESANAAIERLNGYLVGDKQIYVGKFVKKSDRISSGPDTRYTNLYMKNLDLDISETLLREKFSSFGKIISLAVAKDSNGMSKGFGFVNFDNPEDAKRAMETMNGLQLGSKILYVARAQKKAEREQILHQQFEEKRKEQVLKYKGSNIYVKNIDDNVSDEGLRDHFSVCGTITSAKIMRDDKGISKGFGFVCFSTPEEANKAVNSFHGFMFHGKPLYVSLAQRKEDRQAQLQLQYAQQIAGLAGPSTAIVPGGYPPFYYTATGVVSHAPPRAGLVYQPMALRPGWRANGSAPPARSFQQSPTPVVSNNNTRQHRQNRGRMNGHAVSQGNTHSGTYMPQAQQASQSAISSRESSTQQRTGQAKYVPSGRHREMEKGSGLSSSGGSLGPEVLHSMLANATPEQQKEILGEHLYMLVQKIKPNLAAKITGMLLEMDNAELLVLIDHQSLFLPRWKKLSKC

SEQ ID NO: 3713 - protein, 552 aa, Glycine max
MLATFLTSTPLLSESWQLCTTAAAAAPRSFVTEQRGGGVVYVAFPGVEMVAASTDSSWRNFVALDSIGDMPLFSARRLNKEGDEPVMVHAGMLNLFSIFFEPFQKQMLAIMGDTNTKFIVITGHSIGGATASLCALWLLSYLHQISSFMSVSVLCITFGSPMLGNGSFSRAILRERWGATHYGEGSAHVWFHPFGSYLFVSSEGAVCVDGANAVIKMMHLMFASGSLACSIEDHLKYGEYVKNLSLQFLNQNNSMQGSIHDSSYEAGLELAVQSSGLASQESEIEPAKECLKMTRRMGPSPTKNAANLAITLSKFVPYRAEIEWYKAWCDQQVDQMGYYDLFKRRRSTSRMTMKVNMNRHKLARFWNNVIEKLETNELPHDLAVRAKWVNASHFYKLLVEPLDIAEYYGKGMHTTKGHYIQHGRERRYEIFDRWWKDGMANTEENNERRSKFASLTQDSCFWARVEEAREWLDSVRSESDTTKLAVLWDNIEKFEKYAMELVDNKEVSEDVLAKNSSYSIWLEDLRGLRELKAKVKRFSHHFNPFLDGEVIP

SEQ ID NO: 3714 - protein, 317 aa, Glycine max
MHTKSDSEVTSNSMEQSSPSRSPPRRPLYYVQSPSNHDVEKMSYGSSPMGSPHHHFHYYLSSPIHHSRESSTSRFSASLKNPRSNFSSSSSWKKLHPHPNPDAGLDDDDDDDDGDDDLNHFPRNLRLYFCFFLLFLLFFTLFSLILWGTSKSYKPRIIVKSIVFENLNVQSGNDGTGVPTDMLSLNSTVRILYRNPATFFGVHVTSTPLHLSYYQLAIASGQMQKFYQSRKSQRKLAVVVLGHQIPLYGGVSVLGNTKEHLENVALPLKLTFVVRSRAFILGRLVKSKFYRRITCSVTLHGNKLGKHLNLTDSCVYK

SEQ ID NO: 3715 - protein, 311 aa, Phaseolus coccineus
MHTKSDSEVTSNSMEQSSPARSPPRRPLYYVQSPSNHDVEKMSYGSSPMGSPHHHFHYYLSSPIHHSRESSTSRFSASLKNPRNFSSNWKKLHPHPQHDADPDDDADDGDDLDRSSRNLRLYFCFFLLFLMLFTLFSIILWGASRSYKPRVIVKSIVFENLNVQSGNDGSGVPTDMLSLNSTVRMVYRNPATFFGVHVTSTPFQLSYYQLAIASGQMHKFYESRKSERKLSVVVFGHQIPLYGGVSVLGNTKEHLQNVALPLNLTFTVRSRAFILGRLVRSKFYRRVRCSVTLHGNKLGKPLHLTDSCVYK

SEQ ID NO: 3716 - protein, 308 aa, Cajanus cajan
MHRKSDSEVTSNSMEQSSSPPRSPPPRPLYYVQSPSNHDVEKMSYGSSPMGSPHHHFHYYTSSPIHHSRESSTSLKNPRHFSSSWKKLHPHPHHDAAAAADEDEEDDLLQQSSRNLRLYLCFFLLFVMLFTLFSVILWGASKGYKPRVTVKSIVLENLNVQSGNDGSGVPTDMLSLNSTVRIVYRNPATFFGVHVTCTPLLLSYYQLALASAQVHKFYQSRKSQRKLAVVVLGHQVPLYGGVSVLGNTKEHLNNVALPLNLTFVVRSRAFILGRLVKSKFYRRIRCSVTLHGNKLGKHLNLTDSCVYK

SEQ ID NO: 3717 - protein, 201 aa, Raphanus sativus
MTTIAGGSFGATSSRISILTPTLSSSSLFPPLTLHQSGNKKDSQLRCAVQESSTSAVATEKKEKGKEKEDSTVEVPAKKPKPAAAKAAVAKPLGEMMEEDVIPPLKAILEAQDDISEIDLSFQDDKLEGFFFKKGIQYSFWAFFPSGNLTGAKGFSISSYGSGPSTVEPFLVDERKPTANHVVFWVEKRLAAQGIIPVWNQ

SEQ ID NO: 3718 - protein, 202 aa, Eutrema parvulum
MTTIVGGSFGATSSRISTPIPTLSSSSLFPPLTLQQSSNKKDNQLRCVVQESSSTSAVATEKKEKDKEKEDSTVEVPAKKPKPAAAKAAVAKPLREMMEEDVIPPLISILEAQDDISEIDLAFQDDKLEGFFFKKGIQYSFWAFFPTGNLTGAKGFSISSYGSGPSTVEPFLVDERKPTANHVVFWVEKRLAAQGIIPVWNQ

SEQ ID NO: 3719 - protein, 199 aa, Arabidopsis thaliana
MATIAGGSFGVPSSRISITTPTLSSSSLLPPLTLQSGTRKDNLLRCALQESSTSAVATEKKNKEEGEESTVAVPAKKPKPAAKAAAVAKPLRQMMEEDVIPPLQAILESQDDISDIDLSFQDDKLEGFFLKKSIPYSFWAFFPTGNLTGAKGFSISSHGSGPSTVEPFLVDERKPTANHVVFWVEKRLAAQGIIPVWNQ

SEQ ID NO: 3720 - protein, 321 aa, Cajanus cajan
MFLLKTWRKTAFGVFGYLNFTKAGFLDHSKKFKPEDMEIRIPGKNCIVTGANSGIGYATAEGLANRGATVYLVCRNKEKGEAALSDIRTKTGNLNVYLEICDLSSVNEIKSFASRFSEKNVPVHVLVNNGGLLEQNRVTTSEGLELNFAVNVLGTYTMTELMVPLLEKASPDARVITVSSGGMYTSPLTKDLQYSESNFNGVEQYARNKRVQVALTEKWAETYKNKGIGFYSMHPGWAETPGVAKSLPSFSESFSGKLRTSEEGADTVIWLTLQPKEKLVSGAFYFDRAEAPKHLTFACTRDSHALIDSIVDSLNSMASFV

SEQ ID NO: 3721 - protein, 665 aa, Brassica rapa
MAARTLHALSTSPLFLLLLFFAASSPTKAQQPYVNNHQLDCENRDFDNITNGFTCNGPRSCRSYLTFWSLPPYNTPNSIATLLNASAAEIQTLNNLTSLTTVIPTRRLVVIPTTCSCSGGGGFYQHNATYRLSGERQETYFSIANDTYQALSTCQAMMSQNPYGERNLTAGLNLLVPLRCACPTANQTAAGFRYLLTYLVAQGDSVSAIAEMFRSSTPAVSSGNELTSDNIYFFTPLLVPLRTEPTRIVITPPSPTPPVATPPQSPPVDPPGGSSSSHKWIYIGVGIGAGLLLLISILSLYFCYYKRRSKTSSLIEQNKLTDSSTKQSLPTTSTNQWSIALSNSSDTTSGLKSAIESLTLYRFSDLQSATSNFSEENKIKGSVYKATINGDDAAVKVIKGDVSSSEISLLKKLNHSNIIRLSGFCIREGASYLVYEYSENGSVSDWLHSSNKKKSLTWRQRVEICRDIAEALDYLHNYVTPPHIHKNLESNNVLLDSNFKAKISNFGVARILDEGDLDLQLTRHVEGTQGYLAPEYVENGVITPKLDVFAFGVVVLELLSGKEAVTTVDKEEKEEMLLCREINNVLGGENVREKLKEFMDSSLGDEYPLELAFTMAQLAKSCVAPDINSRPSIAQVLTTLLMIVSSSIDWEPSHDLLHDSGSLGN

SEQ ID NO: 3722 - protein, 252 aa, Brassica rapa
MPLEEKKKYPMEPGTVQGYGQAFIFSEDQKLDWCNMFALGVHPPSIRNPKLWPSKPARFSENLEGYSKEIRKLCKRLLKYIAISLDLKEERFKEMFGEAVQAVRMNYYPPCSRPDLVMGLSPHSDGSALTVLQQSKDSCVGLQILKDNTWVPVLPLPNALVINIGDTVEVLTNGKYKSVEHRAVTNRERERLTIVTFYAPNYEVKIEPMGELVDDETNPCKYRSYNHGDYSYHYVSNKLQGKKSLDFAKILN

SEQ ID NO: 3723 - protein, 363 aa, Raphanus sativus
MAPLPISSIRVGKIDDVQELIKTKPNKVPERFIREANERGVLVSHKTHLHHHIPVVDLSKLSKPHTHDDFLFEILKLSQACEDWGFFQVINHGIEGGVVEGIEKVAKEFFEMPLVEKKKYPMEPGTVQGYGQAFIFSEDQKLDWCNMFALGVHPPSIRNPKLWPSKPARFSENLEGYSKEIRKLCKRLLKYIAISLDLKEEKFEEMFGEAVQAVRMNYYPPCSRPDLVLGLSPHSDGSALTVLQQSKNSCVGLQILKDNTWVPVLPLPNALVINIGDTIEVLTNGKYKSVEHRAVTNRERERLTIVTFYAPNYEVKIEPMGELVDDETNPCKYRSYNHGDYSYHYVSNKLQGKKSLDFAKILN

SEQ ID NO: 3724 - protein, 363 aa, Eutrema parvulum
MAPLPISSIRVGKIEDVQELIKSKPNKVPERFIREANERGVLMSLKTHLHHRIPVIDLSKLSKPHTHDDFLFEILNLSQACEDWGFFQVINHGIEVDVVGDIEKVAKEFFEMPLEEKRKYPMEPGTVQGYGQAFIFSEDQKLDWCNMFALGVHPPSIRNPKLWPSKPARFSESLEDYSKEIRKLCKRLLKYIAISLGLQEERFEEMFGEAVQAVRMNYYPPCSSPDLVLGLSPHSDGSALTVLQQSKNSCVGLQILKDNTWVPVLPLPNALVINIGDTVEVLTNGKYKSVEHRAVTNRERERLTIVTFYAPNYEVKIEPMGELVDDESNPCKYRSYNHGDYSYHYVSNKLQGKKSLDFAKILN

SEQ ID NO: 3725 - protein, 363 aa, Brassica rapa
MAPLPISSIRVGKIEDVQELIKSKPNKVPERFIRDANERGGLVSLKTHLHQPIPVIDLSKLSKPHTNDDFVFEILKLSQACEDWGFFQVINHGLEVDVVDDIEKVAKEFFEMPLEEKQKYPMEPGTVQGYGQAFIFSEDQKLDWCNMFALGVHPPSIRNPKLWPSKPARFSESLKGYSKEISKLCKRLLTYIAISLGLKKETFEEMFGEAVQAVRMNYYPPCSSPDLVLGLSPHSDGSALTVLQQSKDSCVGLQILKDNTWVPVLPLPNALVINIGDTVEVLTNGKYKSVEHRAVTNRERERLTIVTFYAPNYEVEIEPMGELVDDETNPCKYRSYNHGDYSYHYISNKLQGKKSLDFAKILN

SEQ ID NO: 3726 - protein, 364 aa, Arabidopsis lyrata
MAPLPISSIRVGQIDDVQELIKSKPNKVPERFIREEYERGVVVSSLKTHHLHHQIPVIDLSKLSKPHNDDFFFEILKLSQACEDWGFFQVINHGIEVEVVEDVEKVAKEFFDMPLEEKKKYPMEPGTVQGYGQAFIFSEDQKLDWCNMFALGVHPPQIRNPKLWPSKPARFSESLEGYSKEIRELCKRLLKYIALSLGLKEERFEEMFGEAVQAVRMNYYPPCSSPDLVLGLSPHSDGSALTVLQQSKNSCVGLQILKDNTWVPVKPLPNALVINIGDTIEVLSNGKYKSVEHRAVTNREKERLTIVTFYAPNYEVKIEPMSELVNDETNPCKYRSYNHGDYSYHYVSNKLQGKKSLDFAKILN

SEQ ID NO: 3727 - protein, 364 aa, Arabidopsis thaliana
MAPLPISSIRVGKIDDVQELIKSKPNKVPERFIREEYERGVVVSSLKTHHLHHQIPVIDLSKLSKPDNDDFFFEILKLSQACEDWGFFQVINHGIEVEVVEDIEEVASEFFDMPLEEKKKYPMEPGTVQGYGQAFIFSEDQKLDWCNMFALGVHPPQIRNPKLWPSKPARFSESLEGYSKEIRELCKRLLKYIAISLGLKEERFEEMFGEAVQAVRMNYYPPCSSPDLVLGLSPHSDGSALTVLQQSKNSCVGLQILKDNTWVPVKPLPNALVINIGDTIEVLSNGKYKSVEHRAVTNREKERLTIVTFYAPNYEVEIEPMSELVDDETNPCKYRSYNHGDYSYHYVSNKLQGKKSLDFAKILN

SEQ ID NO: 3728 - protein, 240 aa, Gossypium raimondii
MASLQQASISLQPKLLSSSQHPRSLPSLNLSFSATFPSLKLSTTRPLHGGAKMSASAASSYATALADVAKSNNTLDATSSDVEKVEKIFSDPQVLQFFTNPTIDVLKKRQVLDEIVSSSELQPHTANFLNILVDAKRIDLIKEIVKEFELVYNELTDTELAVVSSVVKLESQHLAQIAKQVQKLTGAKNVRIKTMIDPSLVAGFTIRYGSSGSKLIDMSVKKQLEEIAAQLDLGDIQLAV

SEQ ID NO: 3729 - protein, 240 aa, Theobroma cacao
MASFQQTSISLQSKLLPSSQLPRALPSLNLSFSATFPSLKLSTTRPLQGGAKMSATAASSYALALADVAKSNNTLDSTSSDIEQVEKIFSDPQVIDFFANPTIDAIKKRQVLDDIVKSSGLQPHTANFLNILVDAKRIDIIKEIVKEFESVFNKLTDTELAVVSSVVPLESQHLAQIAKQVQKLTGAKNVRIKTAIDPSLVAGFTIRYGNSGSKLIDMSVKKQLEEIAAQLDLGDIQLAV

SEQ ID NO: 3730 - protein, 268 aa, Pteridium aquilinum
TTTNSSTHPKNSVRGDPRRSKPKLPDYQWLFQQTSISLQSKLLPFFPNFPRALPSLNLSFSATFPSLKLSTTRPLQGGAKMSATAASSYALALADVAKSNNTLDSTSSDIEQVEKIFSDPQVIDFFANPTIDAIKKRQVLDDIVKSSGLQPHTANFLNILVDAKRIDIIKEIVKEFESVFNKLTDTELAVVSSVVPLESQHLAQIAKQVQKLTGAKNVRIKTAIDPSLVAGFTIRYGNSGSKLIDMSVKKQLEEIAAQLDLGDIQLAV

SEQ ID NO: 3731 - protein, 350 aa, Trigonella foenum-graecum
MASASTTITSSFLSTPSSLTEKPSSFNQTFSLGFKPKHSFSVSASASPSPPPSYDLNSFKFAPIKESIVAREMTRRYMTDMVTHADTDVVIVGAGSAGLSCAYELSKNPNVKIAIIEQSVSPGGGAWLGGQLFSAMVVRKPAHHFLDELEIEYDEQDDYVVIKHAALFTSTIMSKLLARPNVKLFNAVAAEDLIVKNGRVGGVVTNWALVSMNHDTQSCMDPNVMESKVVVSSCGHDGPFGATGVKRLKSIGLIDTVPGMKALDMNTAEDAIVRLTREVVPGMIVTGMEVAEIDGAPRMGPTFGAMMISGQKAAHLALRALGLPNAVDQAGNIHPELVLAAAESAEVAEA

SEQ ID NO: 3732 - protein, 349 aa, Cicer arietinum
MASVSTITSSFLYTNASTPSSKSLSFNTTLNLGVQRKFSVSASVAAANSPPPYDLNSFKFDPIKESIVSREMTRRYMTDMVTHADTDVVIVGAGSAGLTCAYELSKNPNVNIAIIEQSVSPGGGAWLGGQLFSAMVVRKPAHLFLNELGIDYDEKDNYVVIKHAALFTSTIMSKLLARPNVKLFNAVAAEDLIVKNGRVGGVVTNWALVSMNHDTQSCMDPNVMEAKVVVSSCGHDGPFGATGVKRLKSIGLIDTVPGMKALDMNTAEDAIVRLTREVVPGMIVTGMEVAEIDGAPRMGPTFGAMMISGQKAAHLALKSLGLPNAVDYATNIHPELVLAAADSDETADA

SEQ ID NO: 3733 - protein, 345 aa, Glycine max
MASSTITSSFLTSPPSSLFNKSSSPSFHATPTLRPLAPRASMSASAPPYDFGSFRFDPIRESIVSREMTRRYMIDMVTHADTDVVIVGAGSAGLSCAYELSKNPSINIAIVEQSVSPGGGAWLGGQLFSAMVVRKPAHLFLDELNVEYDEQDNYVVIKHAALFTSTIMSKLLARPNVKLFNAVAAEDLIVKNGRVGGVVTNWALVSLNHDTQSCMDPNVMEAKVVVSSCGHDGPFGATGVKRLKSIGLIDSVPGMKALDMNKAEDAIVRLTREVVPGMIVTGMEVAEIDGAPRMGPTFGAMMISGQKAAHLALRSLGLPNALDSVGNVHPELVLAAAESAEIAEA

SEQ ID NO: 3734 - protein, 348 aa, Phaseolus coccineus
MASTTTSSLLSLTTLSPPSSSLFSTKPTHATPIPRFHAPRASMSAAPSPAYDLSSFRFQPIKESIVSREMTRRYMTDMVTHADTDVVIVGAGSAGLSCAYELSKNPAINIAIIEQSVSPGGGAWLGGQLFSAMIVRKPAHMFLDELGLEYDEQDNYVVIKHAALFTSTIMSKLLARPNVKLFNAVAAEDLIVKDGKVGGVVTNWALVSMNHDTQSCMDPNVMEAKVVVSSCGHDGPFGATGVKRLKSIGLIDNVPGMKALDMNKAEDAIVRLTREIVPGMIVTGMEVAEIDGAPRMGPTFGAMMISGQKAAHLALRSLGLPNALESVGNVHPELVLAAAAESAETADA

SEQ ID NO: 3735 - protein, 358 aa, Theobroma cacao
MASSVATTLTSSTKLYRNTSLFESSFHGVPITPLSFHLKAKSSPRNASVSMSAASSPPPYDLNNFRFDPIKESIVSREMTRRYMMDMITHADTDVVVVGAGSAGLSCAYELSKNPSVQVAIVEQSVSPGGGAWLGGQLFSAMVVRKPAHRFLDELGIEYDEQDDYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGSPRMGPTFGAMMISGQKAAHLALQSLGLPNALDGTYVGNIHPELILAAADSAETADA

SEQ ID NO: 3736 - protein, 297 aa, Actinidia deliciosa
MATMTSTLTLSLSSKSKPAFLDSSSHGAALPSRSLLRPAKAGPQNFSVSMSASSPPPYDLRSFKFQPIKESIVSREMTRRYMTDMITYADTDVVVVGAGSAGLTCAYELSKNPSVQVAIIEQSVSPGGGAWLGGQLFSAMVVRKPAHLFLDELDIEYDEQDNYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREVVPGMIVTGMEVARN

SEQ ID NO: 3737 - protein, 356 aa, Actinidia deliciosa
MATMTSTLTSSLSSKPKASFLDSSAHGTALPARSVLRPAKAGHQNFSVSMSASSPPPYDLRSFKFEPIKESIVSREMTRRYMTDMITYADTDVVVVGAGSAGLTCAYELSKNPSVQVAIIEQSVSPGGGAWLGGQLFSAMVVRKPAHLFLDELDIEYDEQDNYVVIKHAALFTSTIMSKLLARPNVKLFNAVAAEDLIVKEGRVGGVVTNWALVSMNHDTQSCMDPNVMEAKVVVSSCGHDGPFGATGVKRLKSIGMIDSVPGMKALDMNTAEDAIVRLTREIVPGMIVTGMEVAEIDGAPRMGPTFGAMMISGQKAAHLALQSLGLPNALDGTYVGSIHPELILASADGAETVDA

SEQ ID NO: 3738 - protein, 356 aa, Citrus sinensis
MAAMASTAFAPSVSSTTNKLFDSSFHGAPMSPSLLRLQPIKSSRPNNLSISASASPPYDLNTFKFDPIKESIVSREMTRRYMTDMITYADTDVVVVGAGSAGLSCAYELSKNPNIQIAIIEQSVSPGGGAWLGGQLFSAMVVRKPAHIFLDELGIDYDEQDNYVVIKHAALFTSTIMSKLLARPNVKLFNAVAAEDLIVKGGRVGGVVTNWALVSMNHDTQSCMDPNVMEAKVVVSSCGHDGPFGATGVKRLKSIGMIEEVPGMKALDMNSAEDAIVRLTREVVPGMIVTGMEVAEIDGAPRMGPTFGAMMISGQKAAHLALKSLGQPNALDGTYVGGVHPELILAAADSAETADA

SEQ ID NO: 3739 - protein, 581 aa, Cicer arietinum
MAAATSSCSTAISSSSKTLTKTTSTTFPPTNLSFSKLHPQPVRARRCIAVGSALGARMVSAPPAARPALLDFDTSIFKKERVNLAGQDEYIVKGGRDLFHLLPDAFKGIKQIGVIGWGSQGPAQAQNLRDSLAEAKSDIVVKVGLRKGSHSFNEAREAGFSEDNGTLGDIWETISGSDLVLLLISDSAQADNYEKIFSHMKPNSILGLSHGFLLGHLQSIGLDFPKHFSVIAVCPKGMGPSVRRLYVQGKAINGAGINSSFGVHQDVDGRATDVALGWSIALGSPFTFATTLEQEYKSDIFGERGILLGAVHGIVESLFRRYTENGMSEDLAYKNTVESITGIISKTISTKGMLAVYNALSEDGKRDFEKAYSASYYPCMDILYECYEDVASGSEIRSVVLAGRRFYEKEGLAAFPMGKIDQTRMWKVGERVRSTRPAGDLGPLYPFTAGVFVALMMAQIEILRKKGHSYSEIINESVIESVDSLNPFMHARGVSFMVDNCSTTARLGSRKWAPRFDYILTQQALVAVDNGAPINRDLISNFMSDPVHGAIEVCAELRPTVDISVPADADFVRPELRQSSN

SEQ ID NO: 3740 - protein, 581 aa, Glycyrrhiza uralensis
MAAAASSSCYTAVSASSKTLAKPVAKSFSPTNLSFSKLSFQPARARRCIAVGGALGARMVSAPPVTLPASLDFETSIFKKERINLAGHDEYIVKGGRDLFHLLPDAFKGIKQIGVIGWGSQGPAQAQNLRDSLAEAKSDIVVKIGLRKGSRSFNEARAAGFSEENGTLGDIWETIQGSDLVLLLISDSAQADNYEKIFSHMKPNSILGLSHGFLLGHLQSMGLDFPKHFSVIAVCPKGMGPSVRRLYVQGKEINGAGINSSFAVHQDVDGRATDVALGWSVALGSPFTFATTLEQEYKSDIFGERGILLGAVHGVVESLFRRYTENGMSEDLAYKNTVESITGIISKTISTKGMLAVYNALSEDGKREFEKAYSASYYPCMDILYECYEDVASGSEIRSVVLAGRRFYEKEGLPAFPMGKIDQTRMWKVGERVRSTRPAGDLGPLYPFTAGVFVALMMAQIEILRKKGHSYSEIINESVIESVDSLNPFMHARGVSFMVDNCSTTARLGSRKWAPRFDYILTQQALVAVDNGAPINQDLLSNFLSDPVHGAIEVCAELRPTVDISVPPDADFVRPELRQSS

SEQ ID NO: 3741 - protein, 586 aa, Glycine max
MAAAMTSCSSAIAAASETLAKPASTRTFSATNLALQSSSSKLGFKSLRLRRCAAASGSALGARMVSVPAVKAPALLDFDTKVFKKEKINLAGHDEYIVKGGRDLFHLLPDAFKGIKQIGVIGWGSQGPAQAQNLRDSLAEAKSDIVVKIGLRKGSRSFAEARAAGFSEENGTLGDIWETVSGSDLVMLLISDSAQADNYEKILSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGVVESLFRRYTENGMNEDLAYKNTVESITGIISKTISTKGMLAVYNALSEDEKREFEKAYSASFYPCMEILYECYEDVASGSEIRSVVLAGRRFYEKEGLPAFPMGNIDQTRMWKVGERVRSTRPAGDQGPLYPFTAGVFVALMMAQIEILRKKGHSYSEIINESVIEAVDSLNPFMHARGVSFMVDNCSTTARLGSRKWAPRFDYILTQQAMVAVDNGTPINRDLISNFLSDPVHGAIKVCAELRPTVDISVPPDADFVRPELRSSN

SEQ ID NO: 3742 - protein, 587 aa, Trigonella foenum-graecum
MAATTSFSPAISASSEIQPKPITTRTFTTSNLALQSSSSKLPFKPLSLHRHTSIVASSLAAQMVSAPPATKLPASLDFDTSLFKKEKVNLAGHEEFIVRGGRDLFHLLPDAFKGIKQIGVIGWGSQGPAQAQNLRDSLTEAKSDIVVKVGLRKGSSSFAEARDAGFSEENGTLGDIWETISGSDLVLLLISDSAQADNYEKIFSHMKPNSILGLSHGFLLGHLQSLGFDFPKNISVIAVCPKGMGPSVRRLYVQGKEINGAGINSSFAVHQDVVGRATNVALGWSVALGSPFTFATTLEQEYKSDIFGERGILLGAVHGIVESLFRRYTESGMAEDVAYKNTVESITGIISRTISTKGMLAVYNALSDDGKKEFEKAYSASFYPCMEILYECYEDVASGSEIRSVVLAGRRFYEKEGLPAFPMGKIDQTRMWKVGERVRSTRPAGDQGPLYPFTAGVFVALMMAQIEILRRKGHSYSEIINESVIESVDSLNPFMHARGVSFMVDNCSTTARLGSRKWAPRFDYILTQQTFVAVDNGAPINRDLITNFISDPVHGAIEVCAELRPTVDISVPADADFVRPELRQSNN

SEQ ID NO: 3743 - protein, 583 aa, Cicer arietinum
MATTTSSYPAISATSEILLNPITTRSFTNTNLALQSSFPKLGFKTLTHRRSTGSALAARMVSAPAITLPDSLNFDTSLFKKEKVNLAGHDEFIVRGGRDLFHLLPDAFKGIKQIGVIGWGSQGPAQAQNLRDSLAEAKSDIVVKVGLRKGSSSFAEARAAGFSEENGTLGDIWETVSSSDLVLLLISDSAQADNYEKIFSHMKPNSILGLSHGFLLGHLQSLGLDFPKNISVIAVCPKGMGPSVRRLYVQGKEINGAGINSSFAVHQDVDGRATNVALGWSVALGSPFTFATTLEQEYKSDIFGERGILLGAVHGIVESLFRRYTESGMAEDLAYKNTVESITGIISKTISTKGMLAVYNALSEDGKKEFEKAYSASYYPCMEILYECYEDVASGSEIRSVVLAGRRFYEKEGLPAFPMGKIDQTRMWKVGERVRSTRPAGDQGPLCPFTAGVFVALMMAQIEILRRKGHSYSEIINESVIESVDSLNPFMHARGVSFMVDNCSTTARLGSRKWAPRFDYILTQQTFVEVDNGAPINRDLISNFITDPVHGAIEVCAELRPTLDISVPPDADFVRPELRQSNN

SEQ ID NO: 3744 - protein, 580 aa, Vigna unguiculata
MAAAAATSCSSAISAASETLAKPSSRSFSATSLALQSSSSKLNFKSLKLNRCGALGARMVAAPVKAPVQLDFDTKVFKKEKINLAGHDEYIVRGGRDLFHFLPDAFKGIKQIGVIGWGSQGPAQAQNLRDSLAEAKSDIVVKIGLRKGSRSFAEARAAGFTEENGTLGDIWETVSGSDLVMLLISDSAQADNYEKIFSHMKPNSILGLSHGFLLGHLQSIGLDFPKNISVIAVCPKGMGPSVRRLYVQGKEINGAGINASFAVHQDVDGRATDVALGWSVALGSPFTFATTLEQEYKSDIFGERGILLGAVHGVVESLFRRYTDNGMDEDLAYKNTVESITGIISKTISTKGMLAVYNALSEDEKREFEKAYSASYYPCMDILYECYEDVASGSEIRSVVLAGRRFYEKEGLPAFPMGNIDQTRMWKVGERVRSTRPAGDQGPLYAFTAGVFVALMMAQIEILRKKGHSYSEIINESVIEAVDSLNPFMHARGVSFMVDNCSTTARLGSRKWAPRFDYILTQQALVAVDNGSPVNQDLLSNFLSDPVHGAIEVCAKLRPTVDISVPADADFVRPELRHSN

SEQ ID NO: 3745 - protein, 586 aa, Glycine max
MAAATTSYSSAIAASSDTLAKPASTRTFSATNLALQSSSSKLGFKSLKLHRCAAAAGSALGARMVSAPAVKAPALLDFDTKVFKKEKINLAGHDEYIVKGGRDLFHLLPDAFKGIKQIGVIGWGSQGPAQAQNLRDSLAEAKSDIVVKIGLRKGSRSFAEARAAGFSEENGTLGDIWETVSGSDLVMLLISDSAQADNYEKILSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGVVESLFRRYTDNGMNEDLAYKNTVESITGIISKTISTKGMLAVYNALSEDEKREFEKAYSASYYPCMEILYECYEDVASGSEIRSVVLAGRRFYEKEGLPAFPMGNIDQTRMWKVGERVRSTRAAGDQGPLYPFTAGVFVALMMAQIEILRKKGHSYSEIINESVIEAVDSLNPFMHARGVSFMVDNCSTTARLGSRKWAPRFDYILTQQAMVAVDNGTPVNRDLISNFLSDPVHGAIKVCAELRPTVDISVPPDADFVRPELRSSN

SEQ ID NO: 3746 - protein, 582 aa, Phaseolus coccineus
MAAATTSCSSAIYAASETLAKPSSRSFSATSLALQSSSSKLAIKSLRLSGCGSALGARMVAAPAVKAPALLDFDSTVFKKEKINLAGHDEYIVRGGRDLFHLLPDAFKGIKQIGVIGWGSQGPAQAQNLRDSLAEAKSNIVVKIGLRKGSRSFAEARAAGFTEESGTLGDIWETVSGSDLVMLLISDSAQADNYEKIFSHMKPNSILGLSHGFLLGHLQSIGLDFPKNISVIAVCPKGMGPSVRRLYVQGKEINGAGINASFAVHQDVDGRATDVALAWSVALGSPFTFATTLEQEYKSDIFGERGILLGAVHGVVESLFRRYTEMGMDEDLAYKNTVESITGIISRTISTKGMLAVYNALSEDEKRIFEKAYSASYYPCMDILYECYEDVASGSEIRSVVLAGRRFYEKEGLAAFPMGNIDQTRMWKVGERVRSTRPAGDQGPLYPFTAGVFVALMMAQIEILRKKGHSYSEIINESVIEAVDSLNPFMHARGVSFMVDNCSTTARLGSRKWAPRFDYILTQQALVAVDNGTPVNQDLLGNFLSDPVHRAIEVCAKLRPTVDISVPADADFVRPELRHASN

SEQ ID NO: 3747 - protein, 588 aa, Malus domestica
MAAATSSFSPALSPAPQSSSASKTHVAPSSLGFSSAVSKSLSPLRAKATRGGNNVSGGGSALGARMVSMPSIKPPPSLDFDTSVFTKEKINLAGHNEYIVRGGRDLFHLLPDAFKGIKQIGVIGWGSQGPAQAQNLRDSLVEAKSDIVVKIGLRKGSRSFAEARAAGFTEENGTLGDIWETISGSDLVLLLISDSAQADNYEKVFSHMKPNSILGLSHGFLLGHLQSVGLDFPKNFSVIAVCPKGMGPSVRRLYVQGKEINGAGINSSFAVHQDVDGRATDVALGWSVALGSPFTFATTLEQEYKSDIFGERGILLGAVHGIVESLFRRYTENGMSEDLAYKNTVECITGIVSRTISAKGMLEIYNSLSEDGKKEFEAAYSASFYPCMDILYECYEDVASGSEIRSVVLAGRRFYEKEGLPAFPMGKIDQTRMWKVGERVRSTRPAGDLGPLHPFTAGVFVALMMAQIEVLRKKGHSYSEIINESVIESVDSLNPFMHARGVSFMVDNCSTTARLGSRKWAPRFDYILTQQALVSVDNGAPINRDLISNFMSDPVHGAIKVCAELRPTVDISVTADADFVRPELRQSN

SEQ ID NO: 3748 - protein, 223 aa, Phaseolus coccineus
MAAATTSCSSAIYAASETLAKPSSRSFSATSLALQSSSSKLAIKSLRLSGCGSALGARMVAAPAVKAPALLDFDSTVFKKEKINLAGHDEYIVRGGRDLFHLLPDAFKGIKQIGVIGWGSQGPAQAQNLRDSLAEAKSNIVVKIGLRKGSRSFAEARAAGFTEESGTLGDIWETVSGSDLVMLLISDSAQADNYEKIFSHMKPNSILGLSHGFSSWAFAVNWT

SEQ ID NO: 3749 - protein, 581 aa, Arachis hypogaea
MAAAAASSNTIALAAAKPLTKAPTPTVFNGLAFSVNNLTPRPLAARHVNGAALAAKMVSSAPAVSLPASLDFNTSIFKKEKISLAGHDEYIVKGGRDLFHLLPDAFKGIKQIGVIGWGSQGPAQAQNLRDSLAEAKSDIVVKIGLRKGSSSFNEARAAGFSEENGTLGDIWDTISGSDLVLLLISDAAQADSYEKIFSHMKPGSILGLSHGFLLGHLQSLGIDFPKHFSVIAVCPKGMGPSVRRLYVQGKEINGAGINSSFAVHQDVDGRATDIALAWSVALGSPFTFATTLEMEYRSDIFGERGILLGAVHGIVESLFRRYTENGMSEDLAYKNTVESITGIISKIISTKGMLAVYNSLSEDEKREFETAYSASYYPCMEILYECYEDVASCSEIRSVVLAGRRFYEKEGLPAFPMGKIDQTRMWKVGQRVRSTRPAGDLGPLYPFTAGVYVALMMAQIEILRKKGHSYSEIINESVIESVDSLNPFMHARGVSFMVDNCSTTARLGSRKWAPRFDYILTQQALVAVDSGAPTNRDLISNFLSDPVHGAIEVCAELRPTVDISVPPDADFVRPELRQSGN

SEQ ID NO: 3750 - protein, 575 aa, Cajanus cajan
MSASAASSALCAPSRTFRAKPVARASIAVRNLAFSKKLRFGLNPVAMAARMVAAPAVTPPPPSLDFETSVFKKEKIHLAGHDEYIVKGGRDLFPLLPGAFKGIKQIGVIGWGSQGPAQAQNLRDSLAEAKSDIVVKVGLRKGSRSFNEARAAGFSEENGTLGDIWETISGSDLVLLLISDSAQADNYEKIFSHMKPNSILGLSHGFLLGHLQSMGLDFPKEFSVIAVCPKGMGPSVRRLYVQGKEINGAGINSSFAVHQDIDGRATDIALAWSVALGSPFTFATTLEMEYRSDIFGERGILLGAVHGTVESLFRRYTEHGMSEDLAYNNTVESITGTISKIISTKGMLAVYNALSEDEKKEFEKAYSASYYPCMDILYECYEDIAAGSEIRSVVLAGRRFYEKEGLPAFPMGKIDQTRMWRVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDNGAPINQDLISNFLSDPVHGAIEVCAELRPTVDISVPPDADFVRPELRQSSN

SEQ ID NO: 3751 - protein, 584 aa, Humulus lupulus
MAAAATSSFSPAISAPSSSPSSQTLLTPKSLGFVSVACKSLRSLKTAASRADNVATGSALGARMVSAPAIKSPVSLDFDTSVFKKEKVNLAGHEEYIVRGGRDLFHLLPDAFKGIKQIGVIGWGSQGPAQAQNLRDSLAEAKSDIVVKIGLRKGSRSFAEARAAGFTEESGTLGDIYETISSSDLVMLLISDSAQADNFEKIFSHMKPNSILGLSHGFLLGHLQSVGMDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTENGMAEDLAYKNTVECITGIISRTISTKGMLSVYNSLSAEGKKDFETAYSASFYPCMDILYECYEDVASCSEIRSVVLAGRRFYEKEGLPAFPMGNIDQTRMWKVGEKVRSTRPAGDLGPLYPFTAGVYVALMMAQIEILRKKGHSYSEIINESVIESVDSLNPFMHARGVAFMVDNCSTTARLGSRKWAPRFDYILTQQALVAVDNGTPINQDLISNFLSDPVHGAIEVCAQLRPTVDISVPADADFVRPELRN

SEQ ID NO: 3752 - protein, 586 aa, Fagus grandifolia
MAAATSSSFAQVPLSSSISKTLKPVSKPFTLGFAGSFCKGLNPLRAAAISGVGFSGGSTLGAKMVSVPAIKPLTCLNFDTKIFNKEKVNLAGHEEYIVRGGRDLFPLLPEAFKGIKQIGVIGWGSQGPAQAQNLRDSLAEAKSDIVVKIGLRKGSRSFAEARGAGFTEENGTLGDIWETISGSDLVLLLISDSAQADNYEKVFSHMKPNSILGLSHGFLLGHLQSVGLDFPKDISVIAVCPKGMGPSVRRLYVQGKEINGAGINSSFAVHQDVDGRATDVALGWSVALGSPFAFATTLEQEYKSDIFGERGILLGAVHGIVESLFRRYTENGMSEDLAYKNTVECITGIISRTISTKGMLAVYNSLSEEGKRVFESAYSASYYPCMDILYECYEDVASGSEIRSVVLAGRRFYEKDGLPAFPMGKIDQTRMWKVGERVRSARPAGDLGPLYPFTAGVYVALMMAQIEILRKKGHSYSEIINESVIESVDSLNPFMHARGVSFMVDNCSTTARLGSRKWAPRFDYILTQQALVAVDNGSPINQDLISNFLSDPVHGAIEVCAQLRPTVDISVPADADFVRPELRSGN

SEQ ID NO: 3753 - protein, 583 aa, Cannabis sativa
MAAAATSSFSPAISAPSSSPSTQNHLIPKPLGFVSVACKSLRSLKTAASRADNVATGSALGARMVSAPAIKSPISLDFDTSVFKKEKVNLAGHEEYIVKGGRDLFHLLPDAFKGIKQIGVIGWGSQGPAQAQNLRDSLTEAKSDIVVKIGLRKGSRSFAEARAAGFTEESGTLGDIYETISSSDLVMLLISDSAQADNFEKIFSHMKPNSILGLSHGFLLGHLQSVGLDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTENGMAEDLAYKNTVECITGNISRTISTKGMLAVYNSLSEEGKKDFETAYSASFYPCMDILYECYEDVASCSEIRSVVLAGRRFYEKEGLPAFPMGNIDQTRMWKVGEKVRSARPAGDLGPLYPFTAGVYVALMMAQIEILRKKGHSYSEIINESVIESVDSLNPFMHARGVAFMVDNCSTTARLGSRKWAPRFDYILTQQALVAVDNGSPINQDLISNFQSDPVHGAIEVCAQLRPTVDISVPENADFVRPELR

SEQ ID NO: 3754 - protein, 138 aa, Humulus lupulus
AAAATSSFSPAISAPSSSPSSQTLLTPKSLGFVSVACKSLRSLKTAASRADNVATGSALGARMVSAPAIKSPVSLDFDTSVFKKEKVNLAGHEEYIVRGGRDLFHLLPDAFKGIKQIGVIGLGFPGTCSSSEFERLSC

SEQ ID NO: 3755 - protein, 587 aa, Rosa hybrid cultivar
MSAATSSFSPALTATPPSSSKAHAAAPSTLAFSSAVSKSLNPLRLRAASRAAAVGRGSALGARMVSMPTIKAPLSLDFDTSVFNKEKVNLAGHDEYIVKGGRDLFHLLPDAFKGIKQIGVIGWGSQGPAQAQNLRDSLAEAKSNIVVKIGLRKGSRSFNEARAAGFTEENGTLGDIWETISESDLVLLLISDSAQADNYEKIFSHMKPNSILGLSHGFLLGHLQSEGLDFPKNISVIAVCPKGMGPSVRRLYVQGKEINGAGINSSFAVHQDVDGRATDVALGWSVALGSPFTFVTTLEQEYKSDIFGERGILLGAVHGIVESLFRRYTDSGMSEDSAYKNTVECVTGIVSRTISTKGMLEIYSSLSEADKKEFETAYSASYYPCMDILYECYEDVASGSEIRSVVLAGRRFYEKDGLPAFPMGKIDQTRMWKVGERVRSTRPAGDLGPLHPFTAGVFVALMMAQIEVLRKKGHSYSEIINESVIESVDSLNPFMHARGVSFMVDNCSTTARLGSRKWAPRFDYILTQQALVAVDNGTPINQDLISNFMSDPVHGAIEVCAQLRPTVDISVPADADFVRPELRQSSN

SEQ ID NO: 3756 - protein, 588 aa, Vitis vinifera
MAATTSFAAAVPSASSSLTKTLKSDSTNLSPNLGFLSSKAFQSLRARVLPASSVGGTGSALAARMVSTPLIKPPALLDFETSVFKKEKVSLAGHDEYIVRGGRDLFHLLPDAFKGIKQIGVIGWGSQGPAQAQNLRDSLVEAKSNIVVKIGLRKGSKSFAEARAAGFTEENGTLGDIYETISGSDLVMLLISDSAQADNYEKIFSHMKPNSILGLSHGFLLGHLQSLGLDFPKNISVIAVCPKGMGPSVRRLYVQGKEVNGAGINSSFAVQQDVDGRATDVALGWSVALGSPFTFATTLEQEYKSDIFGERGILLGAVHGIVESLFRRYTEHGTSEDLAYKNTVECITGIISKTISTQGMLAVYNALSEDGKKEFEAAYSASYYPCMDILYECYEDVASGSEIRSVVLAGRRFYEKDGLPAFPMGKIDQTRMWKVGERVRSVRPAGDLGPLCPFTAGVYVALMMAQIEILRKKGHSYSEIINESVIESVDSLNPFMHARGVSFMVDNCSTTARLGSRKWAPRFDYIITQQALVAVDNGVPINRDLISNFLSDPVHGAIEVCAQLRPTVDISVPADADFVRPELRQSSN

SEQ ID NO: 3757 - protein, 577 aa, Vigna unguiculata
MSATASSTSLCATSRTFYAKPVLARTFVALPTRAFSKLAFQFRPLSMAALGARNVAAPAVAPPPSLDFETSVFQKEKINLAGHDEYIVKGGRDLFPLLPAAFKGIKQIGVIGWGSQGPAQAQNLRDSLADAKSDIVVKVGLRKGSRSFNEARSAGFSEENGTLGDMWETISGSDLVLLLISDSAQADNYEKIFSYMKPNSILGLSHGFLLGHLQSMGLDFPKHFSVIAVCPKGMGPSVRRLYVQGKEINGAGINSSFAVHQDVDGRATDVALAWSVALGSPFTFATTLEMEYRSDIFGERGILLGAVHGVVESLFRRYTEHGMNEDLAYNNTVESITGTISRIISTKGMLAVYNTLSEDGKREFEKAYSASYYPCMDILYECYEDIAVGSEIRSVVLAGRRFYEKEGLPAFPMGKIDQTRMWKVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDNGAPINQDLISNFLSDQVHGAIEVCAQLRPTVDISVPPDADFVRPELRQSTN

SEQ ID NO: 3758 - protein, 586 aa, Sesamum indicum
MAAAAPTSFSTTTATTSSKALKPSSNAPALSLSFLSSSSPSLRSLRASRAGSPASGSALAARMVSAPAIKPPALLDFETSVFTKEKINLAGHDEYIVRGGRNLFKLLPDAFKGIKQIGVIGWGSQGPAQAQNLRDSLAEVKSDIVVKIGLRKGSRSFAEARAAGFTEENGTLGDIWETVSSSDLVLLLISDAAQADNYEKVFSHMKPNSILGLSHGFLLGHLQSMGLDFPKNISVIAVCPKGMGPSVRRLYVQGKEINGAGINSSFGVHQDVDGRATDVALGWSIALGSPFTFATTLEQEYRSDIFGERGILLGAVHGVVESLFRRYTENGMSEDLAYKNTVECITGIVSKTISTKGMLAVYNALSEDAKKEFETAYSASFYPCMDILYECYEDVASGSEIRSVVLAGRRFYEKEGLPAFPMGKIDQTRMWKVGERVRATRPAGDLGPLYPFTAGVFVALMMAQIEILRKKGHSYSEIINESVIEAVDSLNPFMHARGVSFMVDNCSTTARLGSRKWAPRFDYILTQQALVAVDNDTPINQDLISNFLSDPVHGAIEVCAQLRPTVDISVPPDADFVRPELRQSGN

SEQ ID NO: 3759 - protein, 576 aa, Glycine max
MSATASLCATSRTTFSSSKPVARRSCFVAVPKIAFPKLRFKPVAMATLGARMVAAAPTVTPPASLDFETSVFKKEKINLAGHDEYIVKGGRDLFPLLQGAFKGIKQIGVIGWGSQGPAQAQNLRDSLADAKSDIVVKVGLRKGSRSFNEARAAGFSEENGTLGDIWETISGSDLVLLLISDAAQADNYEKIFSHMKPNSILGLSHGFLLGHLQSIGLDFPKHFSVIAVCPKGMGPSVRRLYVQGKEINGAGINSSFAVHQDVDGRATDVALAWSVALGSPFTFATSLEMEYRSDIFGERGILLGAVHGIVESLFRRYTEHGMSEDLAYNNTVESITGTISKIISTKGMLAVYNALSEDEKREFEKAYSASYYPCMDILYECYEDIAAGSEIRSVVLAGRRFYEKEGLPAFPMGKIDQTRMWKVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDNGAPINQDLISNFLSDQVHGAIEVCAQLRPTVDISVPPDADFVRPELRQSSN

SEQ ID NO: 3760 - protein, 588 aa, Prunus persica
MAAATSSFSPALSALQLSSASKTHEAPSSLGFSSVVSKTLNPLIAKATRGVNSVSGGGSALGARMVSMPTVKPPVSLDFETSVFKKEKINLAGHDEFIVRGGRDLFHLLPDAFKGIKQIGVIGWGSQGPAQAQNLRDSLAEAKSDIVVKIGLRKGSRSFAEARASGFSEENGTLGDIWETVSGSDLVLLLISDSAQADNYEKVFSHMKPNSILGLSHGFLLGHLQSVGLDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTENGTSEDLAYKNTVECVTGIVSRTISTKGMLEIYNSLSEDGKKEFETAYSASYYPCMDILYECYEDVASGSEIRSVVLAGRRFYEKDGLPAFPMGKIDQTRMWKVGERVRATRPAGDLGPLYPFTAGVFVALMMAQIEVLRKKGHSYSEIINESVIESVDSLNPFMHARGVAFMVDNCSTTARLGSRKWAPRFDYILTQQALVSVDNGAPINQDLISNFMSDPVHGAIKVCAELRPTVDISVPADADFVRPELRQSSN

SEQ ID NO: 3761 - protein, 577 aa, Phaseolus coccineus
MSATASSTSLCATSRTFSAKPVLARTFVALPKRAFSKLAFQFRPLSMAALGVRNVATPAVVPLPSLDFETSVFQKEKVNLAGHDEYIVKGGRDLFPLLPAAFKGIKQIGVIGWGSQGPAQAQNLRDSLADAKSDIVVKVGLRKGSRSFNEARVAGFSEENGTLGDIWETISGSDLVLLLISDSAQADNYEKIFSYLKPNSILGLSHGFLLGHLQSIGLDFPKHFSVIAVCPKGMGPSVRRLYVQGKEINGAGINSSFAVHQDVDGRATDVALAWSVALGSPFTFATTLEMEYRSDIFGERGILLGAVHGVVESLFRRYTEHGMNEDLAYNNTVECITGTISRIISTKGMIAVYNALSEDGKREFEKAYSASYYPCMDILYECYEDIAAGSEIRSVVLAGRRFYEKEGLPAFPMGKIDQTRMWKVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDNGAPINQDLISNFLSDQVHGAIEVCAQLRPTVDISVPPDADFVRPELRQSTN

SEQ ID NO: 3762 - protein, 590 aa, Platanus occidentalis
MAAAPSFSPSVASPTSSSKTLKPVAKTLGSTLGFLSSSSKSFKPLLARVSTSNTPSSTGGSALGARMVSMPAMKPMTTLDFETSVFKKEKVTLAGHDEFIVRGGRDLFHFLPDAFKGIKQIGVIGWGSQGPAQAQNLRDSLAVAKSDIVVKIGLRKGSRSFSEARAAGFTEENGTLGDIWETVSGSDLVLLLISDAAQADNYEKVFSHMKPNSILGLSHGFLLGHLQSLGLDFPKNIGVIAVCPKGMGPSVRRLYVQGKEINGAGINSSFGVHQDVDGRATDVALGWSVALGSPFTFATTLEQEYKSDIFGERGILLGAVHGIVESLFRRYTENGMSEDLAYKNTVECITGIISKTISTKGMLAVYNALSEGGKKEFEAAYSASFYPCMDILYECYEDVASGSEIRSVVLAGRRFYEKDGLPAFPMGKIDQTRMWKVGERVRSTRPEGDLGPLHPFTAGVYVALMMAQIEILRKKGHSYSEIINESVIESVDSLNPFMHARGVSFMVDNCSTTARLGSRKWAPRFDYILTQQALVAVDNGTPVNQDLISNFVSDPVHGAIEVCAQLRPTVDISVPPDADFVRPELRQSSN

SEQ ID NO: 3763 - protein, 588 aa, Triphysaria pusilla
MAAAAPTSFSTSTPTSSKALTPSSRAPTISLGFLSSASPSLKPLRAAADSRAASPASGSALAARMVSAPTMKPPAALDFDTSVFSKEKINLAGHDEYIVRGGRNLFKLLPDAFKGIKQVGVIGWGSQGPAQAQNLRDSLAEAKSDIVVKIGLRKGSSSFAEARAAGFTEENGTLGDIYETVSSSDLVLLLISDSAQADNYEKLFSSMKPNSILGLSHGFLLGHLQSIGLDFPKNISVIAVCPKGMGPSVRRLYVQGKEINGAGINSSFAVHQDVDGRATDVALGWSVALGSPFTFATTLESEYKSDIFGERGILLGAVHGVVESLFRRYTENGMSEDLAYKNTVESITGIISKTISTKGMLAVYNALSEDDKKDFEAAYSASFYPCMDILYECYEDVASGSEIRSVVLAGRRFYEKEGLPAFPMGKIDQTRMWKVGERVRATRPAGDLGPLYPFTAGVFVALMMAQIEILRKKGHSYSEIINESVIESVDSLNPFMHARGVSFMVDNCSTTARLGSRKWAPRFDYILTQQALVAVDNAAPINQDLISNFLSDPVHGAIKVCAELRPTVDISVPADADFVRPELRQSGN

SEQ ID NO: 3764 - protein, 587 aa, Catharanthus roseus
MAAAAATSISVSTAPAATKTLKHPTKTSVHNLSFLSSSTPSLKHLAARAASFTTSCGSAVAARMVSTPAAVKPPTNLDFETSVFKKEKINLAGHEEYIVRGGRDLFNLLPDAFKGIKQIGVIGWGSQGPAQAQNLRDSLAETKSDILVKIGLRKGSRSFAEARAAGFSEENGTLGDIYETISGSDLVLLLISDAAQADNYEQVFSHMKPNSILGLSHGFLLGHLQSMGLDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTENGMAEELAYKNTVECITGIISKTISTKGMLAVYNALTEEEKKEFETAYSASFYPCMDILYECYEDVATGSEIRSVVLAGRRFYEKEGLPAFPMGKIDQTRMWKVGERVRSVRPTGDLGPLCPFTAGVYVALMMAQIEILRKKGHSYSEIINESVIESVDSLNPFMHARGVAFMVDNCSTTARLGSRKWAPRFDYILTQQAMVAVDNKTPINRDLISNFLSDPVHGAIEVCAQLRPTVDISVPADADFVRPELRQSS

SEQ ID NO: 3765 - protein, 592 aa, Eucalyptus grandis
MAAATSFSPSLSAAASSKSLKALANPSPAGLSLSLGFLSSSSGSSRALRAAAAAAAGNGAGGSALGARMVSVPAVKPLAPLDFETSVFKKEKVTLAGHDEYIVRGGRDLFPLLPDAFKGIKQIGVIGWGSQGPAQAQNLRDSLAEAKSNIVVKIGLRKGSRSFAEARAAGFSEENGTLGDIWETISGSDLVLLLISDAAQADNYEKVFSHMKPNSILGLSHGFLLGHLQSMGLDFPKNISVIAVCPKGMGPSVRRLYVQGKEINGAGINSSFGVHQDVDGRATDIALGWSVALGSPFTFATTLEQEYKSDIFGERGILLGAVHGVVESLFRRYTENGMSEDLAYNNTVECITGIISKTISTKGMLAVYNSLSDEGKKEFEKAYSASYYPCMDILYECYEDVASGSEIRSVVLAGRRFYEKDGLPAFPMGKIDQTRMWKVGERVRAARPAGDLGPLYPFTAGVFVALMMAQIEILRKKGHSYSEIINESVIESVDSLNPFMHARGVSFMVDNCSTTARLGSRKWAPRFDYILTQQALVAVDNGAPVNHDLISNFFSDPVHGAIGVCAQLRPTVDISVPANADFVRPELRQSAN

SEQ ID NO: 3766 - protein, 589 aa, Amsonia hubrichtii
MAAPAATSFSVSTTRGPKTLKHETKTSVHNLSFLSSSTPSLKPLEARAASVAVSASSNGSAVAARMVSTPAAVKPQTSLDFDTSVFKKEKVNLAGHEEYIVRGGRDLFKLLPDAFKGIKQIGVIGWGSQGPAQAQNLRDSLAEAKSDIVVKIGLRKGSRSFAEARLAGFSEEKGTLGDIYETISGSDLVLLLISDAAQADNYEKVFSHMKPNSILGLSHGFLLGHLQSMGLDFPKNISVIAVCPKGMGPSVRRLYVQGKEVNGAGINSSFAVHQDVDGQATDVALGWSVALGSPFTFATTLEQEYKSDIFGERGILLGAVHGIVESLFRRYTENGMAEDLAYKNTVECITGIISKTISTKGMLAVYNSLTEEEKKEFETAYSASFYPCMDILYECYEDVATGSEIRSVVLAGRRFYEKEGLPAFPMGKIDQTRMWKVGERVRAVRPAGDLGPLYPFTAGVYVALMMAQIEILRKKGHSYSEIINESVIESVDSLNPFMHARGVAFMVDNCSTTARLGSRKWAPRFDYILTQQALVAVDNKTPVNRDLISNFLSDPVHGAIEVCAQLRPTVDISVPADADFVRPELRQSN

SEQ ID NO: 3767 - protein, 255 aa, Flaveria ramosissima
MSEELAYKNTVECITGIISKTISTQGMKAVYESLSEESKKEFLTAYSASYYPCMDILYECYEDVASGSEIRSVVLAGRRFYEKEGLPAFPMGKIDQTRMWKVGEQVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNGAPLNQDLISNFFEDPVHEAVKVCAELRPTVDISVPADADFVRPELRQSSN

SEQ ID NO: 3768 - protein, 587 aa, Cichorium intybus
MAAATTSFSTLAPTASSSAASASLKVAPKTLGFNVGFPSSKISSKSLKARSNGSSGSALGARMVSAPAITKPPTLLDFETSVFKKEKINLAGYDEYIVRGGRDLFHLLPDAFKGIKQIGVIGWGSQGPAQAQNLRDSLVEAKSDIVVKIGLRKGSSSFNEARSAGFSEENGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALAWSVALGSPFTFATTLEQEYKSDIFGERGILLGAVHGIVESLFRRYTEGGMSEDLAYKNTVECITGNISKTISTQGMKAVYESLTEEGKKEFLKAYSASYYPCMDILYECYEDVASGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYILTQQALVAVDNGSPLNQDLISNFFEDPVHEAVKVCAELRPTIDISVPVDADFVRPELRQASN

SEQ ID NO: 3769 - protein, 588 aa, Populus trichocarpa
MAAATSFSNTLTTPAPSKTLKPASSRSLLCNSNLGFSSSLSSKTFKPLKASSGNISAGVLGAKMVSSVPSVKPMISLDFETSVFKKEKVSLAGHDEYIVRGGRDLFHLLPDAFKGIKQIGVIGWGSQGPAQAQNLRDSLAEAKSDIKVKIGLRKGSRSFAEARGAGFTEENGTLGDIWETVSGSDLVLLLISDAAQADNYEKIFSHMKPNSILGLSHGFLLGHLQSTGLDFPKNISVIAVCPKGMGPSVRRLYVQGKEVNGAGINSSFAVHQDVDGRATDVALGWSVALGSPFTFATTLEQEYKSDIFGERGILLGAVHGIVESLFRRYTENGMSEDEAYKNTVECITGTISRTISTKGMLAVYNSLSAEGKKEFETAYSASFYPCMDILYECYEDVASGSEIRSVVLAGRRFYEKEGLPAFPMGKIDQTRMWKVGERVRAARPAGDLGPLHPFTAGVYVALMMAQIEILRKKGHSYSEIINESLIESVDSLNPFMHARGVSFMVDNCSTTARLGSRKWAPRFDYILTQQALVAVDNSTPINRDLISNFFSDPVHGAVEVCAQLRPTVDISVPADADFVRPELRQSSN

SEQ ID NO: 3770 - protein, 588 aa, Citrullus lanatus
MAAATYFSPSISASSTKTLKQAVALQPLAPSTLGFLSSSSSGSNALKAVGIGAANAVGSALGARMVSVPAIKSLPSLDFDTSVFKKEKVNLAGHDEYIVRGGRDLFPLLPEAFKGIKKIGVIGWGSQAPAQAQNLRDSLAEAKSDIVVKIGLRKGSRSFAEARAVGFSEENGTLGDIYETISESDLVMLLISDSAQADNYEKIFSHMKPNSILGLSHGFLLGHLQSSGLDFPKNISVIAVCPKGMGPSVRRLYVQGKEINGAGINSSFAVHQDVDGRATDVALGWSVALGSPFTFATTLEQEYRSDIFGERGILLGAVHGIVESLFRRYTENGMAEDLAYKNTVESITGIISKTISTKGMLAVYNSFSPDEKKEFERAYSASYYPCMDILYECYEDVASGSEIRSVVLAGRRFYEKEGLPAFPMGNIDQTRMWKVGERVRQSRPAGDLGPLYPFTAGVYVALMMAQIEILRKKGHSYSEIINESVIESVDSLNPFMHARGVSFMVDNCSTTARLGSRKWAPRFDYILTQQALVAIDNGSAINQDLISNFLSDPVHGAIEVCAQLRPTVDISVPADADFVRPELRQSSN

SEQ ID NO: 3771 - protein, 588 aa, Triphysaria pusilla
MAAAAPTSFSTSTPTTTSKSLKPSSRTPAISFGFLSSSSPSLKPLRAAADSRAASPASGSALAARMVSATSIKSPTALDFDTSVFTKEKINLAGHEEYIVRGGRNLFKFLPDAFKGIKQIGVIGWGSQGPAQAQNLRDSLVEAKSDIVVKIGLRKGSSSFAEARAAGFTEENGTLGDIYETVSSSDLVLLLISDSAQADNYEKLFSSMKPNSILGLSHGFLLGHLQSIGLDFPKNISVIAVCPKGMGPSVRRLYVQGKEINGAGINASFAVHQDVDGRATDVALGWSVALGSPFTFATTLESEYKSDIFGERGILLGAVHGVVESLFRRYTENGMREDLAYKNTVESITGIISKTISTKGMLAVYNSLSEDDKKDFEAAYSASFYPCMDILYECYEDVASGSEIRSVVLAGRRFYEKEGLPAFPMGKIDQTRMWKVGEKVRATRPAGDLGPLYPFTAGVFVALMMAQIEILRKKGHSYSEIINESVIESVDSLNPFMHARGVSFMVDNCSTTARLGSRKWAPRFDYILTQQALVAVDNGTPINQDLISNFLSDPVHGAIEVCAQLRPTVDISVPADADFVRPELRQSN

SEQ ID NO: 3772 - protein, 585 aa, Brassica juncea
MAAATSSIAPSLSCPSPKTLRSSKATTFAFPNIGFLSSTSKSLRSLTATVAGNGTGSSLSARMVASSAVRAPMSLDFETSVFKKEKVSLAGHEEYIVRGGRDLFKHLPDAFKGIKQIGVIGWGSQGPAQAQNLRDSLVEAKSDIVVKIGLRKGSRSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGNISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3773 - protein, 583 aa, Platanus occidentalis
SPSVASSPSCKTLKPEAKTLGFRVGFISSSSKTLKPLLALVSTSNACSTAGGGSALGARMVSMPAIKPITTLDFDTSVFKKEKVSLAGHEEYIVRGGRDLFHLLPDAFKGIKQIGVIGWGSQGPAQAQNLRDSLTVANSDIVVKIGLRKGSASAAEARAAGFTEENGTLGDIWETVSSSDLVLLLISDAAQADNYEKIFSHMKPNSILGLSHGFLLGHLQSLGLDFPKNISVIAVCPKGMGPSVRRLYVQGKEINGAGINSSFAVHQDVDGRATDVALGWSVALGSPFTFATTLEQEYKSDIFGERGILLGAVHGVVESLFRRYTENKMSEDLAYKNTVECITGIISKTISTKGMLAVYNSLSEDGKKEFEAVYSASYYPCMDILYECYEDVASGSEIRSVVLAGRRFYEKDGLPAFPMGKIDQTRMWKVGERVRSTRPQGDLGPLHPFTAGVFVALMMAQIEVLRKKGHSYSEIINESVIESVDSLNPFMHARGVSFMVDNCSTTARLGSRKWAPRFDYILTQQALVAVDKGAPVNQDLISNFLSDPVHGAIEVCAQLRPTVDISVTADADFVRPELRQSSN

SEQ ID NO: 3774 - protein, 586 aa, Helianthus annuus
MTTAAATTFSSVAPTTSSSPSPTLKTLGFTTTFLSSKTSFKSLHARVFPSNMTSVSAMGARMVASPTITKSPASLDFETSVFKKEKVNLAGHEEYIVRGGRDLFHLLPDAFKGIKQIGVIGWGSQGPAQAQNLRDSLAEAKSDIVVKIGLRKGSSSFAEARAAGFSEENGTLGDIYDTISGSDLVLLLISDSAQADNYEKIFSHMKPNSILGLSHGFLLGHLQSIGLDFPKNFSVVAVCPKGMGPSVRRLYVQGKEINGAGINASFAVHQDVDGRATDVALGWSVALGSPFTFATTLEQEYKSDIFGERGILLGAVHGIVESLFRRYTEQGMTEDLAYKNTVECITGVISKTISTKGMKAVYESLSEEGKKDFLIAYSASYYPCMEILYECYEDVASGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYNLTQQALVAVDNGAPVNQDLVKSFFEDPVHDAVKVCAELRPTVDISVPADADFVRPELRQSNN

SEQ ID NO: 3775 - protein, 581 aa, Euphorbia peplus
MSAATSFSATLSSPSPSKSLKCPPKSLSSSSGLGFTPVSHKPFKPLKASNGGGGSALGARMVSMPAAVKPLISLDFETSVFNKEKVSLAGHQEYIVRGGRDLFHLLPDAFKGIKQIGVIGWGSQGPAQAQNLRDSLAEAKSDIVVKIGLRRGSRSFAEARAAGFTEESGTLGDIWETVSGSDLVLLLISDAAQADNYEKVFSHMKPNSILGLSHGFLLGHLQSSGLDFPKNISVVAVCPKGMGPSVRRLYVQGKEVNGAGINASFAVHQDVDGRATDVALGWSVALGSPFTFATTLEQEYKSDIFGERGILLGAVHGIVESLFRRYTENGMGEEEAYKNTVEGITGNISKTISTQGMLAVYNSLSEEGKKEFEIAYSASFYPCMEILYECYEDVASGNEIRSVVLAGRRFYEKEGLPAFPMGNIDQTRMWKVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDNGTPVNRDLISNFLSDPVHGAIEVCAQLRPTVDISIPADADFVRPELR

SEQ ID NO: 3776 - protein, 588 aa, Lactuca sativa
MAAAATTSFSTLAPTASSSAASASLKLAPQTLGFNVGFLSSKTSSKSLKARSNGSSGSALGARMVSAPAITKPPTLLDFETSVFKKEKINLAGYDEYIVRGGRDLFHLLPDAFKGIKQIGVIGWGSQGPAQAQNLRDSLVEAKSDIVVKIGLRKGSSSFNEARGAGFSEENGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALAWSVALGSPFTFATTLEQEYKSDIFGERGILLGAVHGIVESLFRRYTEGGMSEDLAYKNTVECITGNISKTISTQGMKAVYESLTEEGKKEFLTAYSASYYPCMDILYECYEDVASGSEIRSVVLAGRRFYEKEGLPAFPMGKIDQTRMWKVGERVRASRPAGDLGPLYPFTAGVYVALMMAQIEVLRKKGHSYSEIINESLIESVDSLNPFMHARGVSFMVDNCSTTARLGSRKWAPRFDYILTQQALVAVDNGSPLNQDLISNFFEDPVHEAVKVCAELRPTIDISVPVDADFVRPELRQASN

SEQ ID NO: 3777 - protein, 591 aa, Mimulus guttatus
MAAAAPTSFSATTAATTSSKTLTPQTKSPSISLGFLSSSSPSLKPLRATAAASRTGSRASGSASAARMVSVQTVRPPASQDFETSVFSKEKINLAGYDEYIVRGGRHLFKLLPDAFKGIKQIGVIGWGSQGPAQAQNLRDSLAEANSDIVVKIGLRKGSSSFAEARAVGFTEENGTLGDIYETISNSDLVLLLISDSAQADNYEKVFSHMKPNSILGLSHGFLLGHLQSMGLDFPKNISVIAVCPKGMGPSVRRLYVQGKEINGAGINASFGVHQDADGRATDVALGWSVALGSPFTFATTLEQEYKSDIFGERGILLGAVHGIVESLFRRYTENGMAEDLAYKNTVESITGIISKTISTKGMLAVYNALNEDEKKEFEAAYSASYYPCMDILYECYEDVASGSEIRSVVLAGRRFYDKEGLPSFPMGKIDQTRMWRVGERVRATRPAGDLGPLYPFTAGVFVALMMAQIEILRKKGHSYSEIINESVIESVDSLNPFMHARGVSFMVDNCSTTARLGSRKWAPRFDYILTQQALVAVDNNAPINRDLISNFLSDPVHGAIEVCAELRPTVDISVPADADFVRPELRQSAN

SEQ ID NO: 3778 - protein, 588 aa, Quercus alba
MSAATSSFAPAAAISAPSSSISKALIPVSKPFCLGFATSFSKGLKALRATSGVTGSTGSSLGAKMVSVPAIKAPTLLDFDTKVFNKEKVNLAGHDEYIVRGGRDLFPLLPEAFKGIKQIGVIGWGSQGPAQAQNLRDSLVEAKSDIVVKIGLRKGSRSFAEARAAGFTEESGTLGDIYETVSGSDLVLLLISDSAQADNYLKIFSHMKPNSILGLSHGFLLGHLQSEGLDFPKNMSVIAVCPKGMGPSVRRLYVQGKEINGAGINSSFAVHQDVDGRATDVALGWSVALGSPFTFATTLEQEYKSDIFGERGILLGAVHGIVESLFRRYTENGMSEDLAYKNTVECITGIISKTISTKGMLAVYNSLSEEDKRVFETAYSASYYPCMDILYECYEDVASGSEIRSVVLAGRRFYEKDGLPAFPMGKIDQTRMWKVGERVRSARPAGDLGPLYPFTAGVYVALMMAQIEILRKKGHSYSEIINESVIESVDSLNPFMHARGVSFMVDNCSTTARLGSRKWAPRFDYILTQQALVAVDSGVPINQDLISNFLSDPVHGAIGVCAQLRPTVDISVPADADFVRPELRASGN

SEQ ID NO: 3779 - protein, 588 aa, Cucumis melo
MAAATHFAPSISASSTKTLKQAAALQPLSPSSLGFLSSSSSGLYALKAVGICGANGVGSALGARMVSVPAIKPLTSLDFDTSVFKKEKVNLAGHDEYIVRGGRDLFPLLPEAFKGIKKIGVIGWGSQAPAQAQNLRDSLAEAKSDIVVKIGLRKGSRSFAEARAVGFSEENGTLGDIYETISESDLVMLLISDSAQADNYEKIFSHMKPNSILGLSHGFLLGHLQSLGLDFPKNISVIAVCPKGMGPSVRRLYVQGKEVNGAGINSSFAVHQDVDGRATDVALGWSIALGSPFTFATTLEQEYRSDIFGERGILLGAVHGIVESLFRRYTENGMAEELAYKNTVESITGIISRTISTKGMLAVYNSFSPDEKKEFERAYSASYYPCMDILYECYEDVASGSEIRSVVLAGRRFYEKEGLPAFPMGNIDQTRMWKVGERVRQSRPAGDLGPLYPFTAGVYVALMMAQIEILRKKGHSYSEIINESVIESVDSLNPFMHARGVSFMVDNCSTTARLGSRKWAPRFDYILTQQALVAIDNGSAINQDLISNFLSDPVHGAIEVCAQLRPTVDISVPADADFVRPELRQSSN

SEQ ID NO: 3780 - protein, 586 aa, Helianthus annuus
MTTAAATTFSSVAPTTSSSPSPTLKTLGFTTTFLSSKTSFKSLHARVFPSNMTSVSAMGARMVASPTITKSPASLDFETSVFKKEKVNLAGHEEYIVRGGRDLFHLLPDAFKGIKQIGVIGWGSQGPAQAQNLRDSLAEAKSDIVVKIGLRKGSSSFAEARAAGFSEENGTLGDIYDTISGSDLVLLLISDSAQADNYEKIFSHMKPNSILGLSHGFLLGHLQSIGLDFPKNFSVVAVCPKGMGPSVRRLYVQGREINGAGINASFAVHQDVDGRATDVALGWSVALGSPFTFATTLEQEYKSDIFGERGILLGAVHGIVESLFRRYTEQGMTEDLAYKNTVECITGVISKTISTKGMKAVYESLSEDGKKDFLIAYSASYYPCMEILYECYEDVASGSEIRSVVLAGRRFYEKEGLPAFPMGKIDQTRMWKVGERVRATRPTGDLGPLYPFTAGVYVALMMAQIEVLRKKGHSYSEIINESLIESVDSLNPFMHARGVSFMVDNCSTTARLGSRKWAPRFDYNLTQQALVAVDNGAPVNQDLVKSFFEDPVHDAVKVCAELRPTVDISVPADADFVRPELRQSNN

SEQ ID NO: 3781 - protein, 589 aa, Raphanus sativus
MAAATSSIAPSLSCPSPSSSSKTLRSSKATTFAFPNIGSLSSASKSLRSLTATAAGNGIGSSLSARMVASSAVRAPMSLDFETSVFKKEKVSLAGHEEYIVRGGRDLFKHLPDAFKGIKQIGVIGWGSQGPAQAQNLRDSLVEAKSDIVVKIGLRKGSRSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGNISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3782 - protein, 588 aa, Castanea mollissima
MSAATSSFAPAAAISAPSSSISKTLNPVSKPFSLGFATSFSKGLKALRATSGVTGSTGSSLGAKMVSVPAIKPPTLLDFDTKVFNKEKVNLAGHDEYIVRGGRDLFPLLPEAFKGIKQIGVIGWGSQGPAQAQNLRDSLVEAKSDIVVKIGLRKGSRSFAEARAAGFTEESGTLGDIYETVSGSDLVLLLISDSAQADNYEKIFSHMKPSSILGLSHGFLLGHLQSIGLDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTENGMSEDLAYKNTVECITGIISKTISTKGMLAVYNSLSEEDKRVFETAYSASYYPCMDILYECYEDVASGSEIRSVVLAGRRFYEKDGLPAFPMGKIDQTRMWKVGERVRSSRPAGDLGPLYPFTAGVYVSLMMAQIEILRKKGHSYSEIINESVIESVDSLNPFMHARGVSFMVDNCSTTARLGSRKWAPRFDYILTQQALVAVDSGVPINQDLISNFLSDPVHGAIGICAQLRPTVDISVPADADFVRPELRASGS

SEQ ID NO: 3783 - protein, 586 aa, Arnica chamissonis
MAAATTTFSTLAPATSSSAAAAPLKIAPKTLGFKSGFLSSKTTSKSLKARSNGGSGSALGARMVSAPAISRPTLLDFETSIFKKEKINLAGHDEYIVRGGRDLFHLLPDAFKGIKQIGVIGWGSQGPAQAQNLRDSLAEAKSDIVVKIGLRKGSSSFNEARAAGFSEETGTLGDIYETISSSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALGWSVALGSPFTFATTLEQEYKSDIFGERGILLGAVHGIVESLFRRYTEGGMSEVLAYKNTVECITGIISRTISSQGMKAVYESLTEEGKKEFLTAYSASFYPCMEILYECYEDVASGSEIRSVVLAGRRFYEKEGLPAFPMGKIDQTRMWKVGEQVRAVRPAGDLGPLYPFTAGVYVALMMAQIEVLRKKGHSYSEIINESLIESVDSLNPFMHARGVSFMVDNCSTTARLGSRKWAPRFDYILTQQALVAIDNGAPLNQDLISNFFEDPVHEAVKVCAELRPTVDISVPADADFVRPELRQSSN

SEQ ID NO: 3784 - protein, 584 aa, Flaveria ramosissima
MSTATTTFSTVAPTTSSSPSLKISPKTLGFNVGFSLSKTSTKSLKARSNGSCGSAIGARMVSAPAISKPPMLLDFETSVFKKEKINLAGHDEYIVRGGRDLFHLLPEAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSVGLDFPKNISVVAVCPKGMGPSVRRLYVQGKEVNGAGINASFAVHQDVDGRATDVALAWSVALGSPFTFATTLEQEYRSDIFGERGILLGAVHGIVESLFRRYTEGGMSEDLAYKNTVECITGIISKIISTQGMKAVYESLTEEGKKEFLTAYSASYYPCMDILYECYEDVATGSEIRSVVLAGRRFYEKEGLPAFPMGKIDQTRMWKVGERVRAARSAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNQDLISNFFEDPVHEAVKVCAELRPTVDISVPADADFVRPELRQASN

SEQ ID NO: 3785 - protein, 591 aa, Tabernaemontana elegans
MAAAAPTTPFSASTTPLSKTLNQHTKNLAHNLSFISSSTPSLHALMARASGPVSGTSHGGAVAACMVSTPSAVAKVQPLTLDFVTSVFKKEKVNLAGHEEYIVRGGRDLFKLLPDAFKGIKQIGVIGWGSQGPAQAQNLRDSLAEAKSDIVVKVGLRKGSRSFVEARAAGFSEEDGTLGDIYETISGSDLVLLLISDAAQADNYENVFSHMKPNSILGLSHGFLLGHLQSMGLDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTEKGMAEDLAYKNTVECITGIISKTISTKGMLAVYNSLTAEGKKEFETAYSASYYPCMDILYECYEDVAAGSEIRSVVLAGRRFYEKEGLPAFPMGKIDQTRMWKVGERVRASRSAGDLGPLYPFTAGVYVALMMAQIEILRKKGHSYSEIINESVIESVDSLNPFMHARGVSFMVDNCSTTARVGSRKWAPRFDYILTQQALVAVDNKTPINRDLISNFLSDPVHGAIEVCAQLRPTVDISVPQDADFVRPELRQSN

SEQ ID NO: 3786 - protein, 582 aa, Aquilegia formosa
MAAATSASISSSLYVSKTLKPTSPQTNLGFISKSSKTLKPLFSKISRTNLSSNGSGAVVRAQMVSVPATKPTICLDFETSVFNKEKVTLAGHDEFIVRGGRDLFHLLPDAFKGIKQIGVIGWGSQGPAQAQNLRDSLAEAKSDIVVKIGLRKGSSSFAEARASGFSEENGTLGDIWQTISGSDLVLLLISDAAQADNYERIFSHMKPNSILGLSHGFLLGHLQSAGLDFPKNISVIAVCPKGMGPSVRRLYVQGKEINGAGINASFAVHQDVDGRATDVALGWSVALGSPFTFATTLEQEYKSDIFGERGILLGAVHGVVESLFRRYTENGMPEDAAYKNTVESITGIISRTISTKGMLAVYNSLSEDGKKEFQTAYSASYYPCMDILYECYEDVASGNEIRSVVLAGRRFYEKDGLPAFPMGKIDQTRMWKVGESVRSTRPQGDLGPLHPFTAGVFVALMMAQIEVLRKKGHSYSEIINESVIESVDSLNPFMHARGVAFMVDNCSTTARLGSRKWAPRFDYILTQQALVAVDKDTSINQDLISNFLSDPIHGAIEVCAQLRPTVDISVPEDADFVRPELR

SEQ ID NO: 3787 - protein, 590 aa, Vinca minor
MAASASAATSLSVSTAPATKILKYQTTSVHNLSFLSSSTPSLKPLAARAASTAVSVSSHGGSFAARMVSTPAAVKPLTSLDFETSVFKKEKVTLAGHEEYIVRGGRDLFHLLPDAFKGIKQIGVIGWGSQGPAQAQNLRDSLTEAKSDIVVKIGLRKGSRSFAEARAVGFSEENGTLGEIYETISGSDLVLLLISDAAQADNYEKVFSHMKPNSILGLSHGFLLGHLQSMGTNFPKNISVIAVCPKGMGPSVRRLYVQGKQINGAGINASFAVHQDVDGRATDVALGWSVALGSPFTFATTLEQEYKSDIFGERGILLGAVHGIVESLFRRYTENGMAEDLAYKNTVECITGIISKTISTKGMLAVYNALTEEGKKEFEAVYSASYYPCMDILYECYEDVATGSEIRSVVLAGRRFYEKEGLPAFPMGKIDQTRMWKVGERVRAVRPAGDLGPLYPFTAGVYVALMMAQIEILRKKGHSYSEIINESVIESVDSLNPFMHARGVAFMVDNCSTTARLGSRKWAPRFDYILTQQALVAVDNKTPINRDLISNFLSDPVHGAIEVCAQLRPTVDISVPQDADFVRPELRQSN

SEQ ID NO: 3788 - protein, 589 aa, Brassica napus
MAAATSSIAPSLSCPSASSSSKALRSSKVSTFAFPNIGFISSASKSLRSLTATVSGNGTGSSLSARMVASAAVRAPLSLDFETSVFKKEKVSLAGHEEYIVRGGRDLFKHLPDAFKGIKQIGVIGWGSQGPAQAQNLRDSLVEAKSDIVVKIGLRKGSKSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGNISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIEVCAQLRPTVDISVPEDADFVRPELRQSN

SEQ ID NO: 3789 - protein, 589 aa, Populus trichocarpa
MAAAATSFSTTLTTPTPSKTLKSAPSRSLLCNSNLGFSSSVSSKTFKPLKASNGNVTGGVLGAKMVSSVPSVKPLISLDFETSVFKKEKVSLAGHDEYIVRGGRDLFHLLPDAFKGIKQIGVLGWGSQGPAQAQNLRDSLAEAKSDIKVKIGLRKGSRSFAEARAAGFTEENGTLGDIWETVSGSDLVLLLISDAAQADNYEKVFSHMKPNSILGLSHGFLLGHLQSMGLDFPKNISVIAVCPKGMGPSVRRLYVQGKEVNGAGINSSFAVHQDVDGRATDVALGWSVALGSPFTFATTLEQEYRSDIFGERGILLGAVHGIVESLFRRYTENGMSEDEAYKNTVECITGIISRTISTKGMLAVYNSLTPEGKKEFETAYSASFYPCMDILYECYEDVASGSEIRSVVLAGRRFYEKEGLPDFPMGKIDQTRMWKVGERVRATRPAGDLGPLHPFTAGVYVALMMAQIEILRKKGHSYSEIINESLIESVDSLNPFMHARGVSFMVDNCSTTARLGSRKWAPRFDYIVTQQALVAVDNGTPINRDLISNFFSDPVHGAVEVCAQLRPTVDISVPPDADFVRPELRQSSN

SEQ ID NO: 3790 - protein, 587 aa, Chelidonium majus
ATSFTPTVASPSSCSSKTLKPVHTSLGFNLGFLSSSSKTLKPLVARVSSNNNNAVGSSLASRMMVSVPAVKPLTTLDFETSVFNKEKVTLAGHDEYIVKGGRDLFHLLPDAFKGIKQIGVIGWGSQGPAQAQNLRDSLVEAKSDIVVKIGLRKGSRSFAEARAAGFTEETGTLGDIYETISGSDLVLLLISDAAQADNYEKIFSHMKPNSILGLSHGFLLGHLQSLGLDFPKNISVIAVCPKGMGPSVRRLYVQGKEINGAGINASFAVHQDVDGRATDVALGWSVALGSPFSFATTLEQEYKSDIFGERGILLGAVHGVVESLFRRYTENGMNEDLAYKNTVECITGITSKTISTEGMLAVYNSLSEEGKKDFQTAYSASYYPCMEILYECYEDVACGSEIRSVVLAGRRFYEKEGLPAFPMGKIDQTRMWRVGERVRSTRPAGDLGPLYPFTAGIFIALMMAQIEVLRKKGHSYSEIINESVIESVDSLNPFMHARGVSFMVDNCSTTARLGSRKWAPRFDYILTQQALVAVDNNSPINQDLISNFLSDPIHGAIEVCAQLRPTVDISVPANADFVRPELRQSSN

SEQ ID NO: 3791 - protein, 593 aa, Solanum tuberosum
MAAAAATSFSITTSTPPSSSSSTKSLKPSLVGNLGFLSSSTPSLKPLRAQAAISSGSSNSGGGALAARMVAAPATVKAPASFDFETSVFKKEKVTLAGNDEYIVRGGRDLFKYLPDAFKGIKQIGVIGWGSQGPAQAQNLRDSLAEIKSDIVVKIGLRKGSSSFAEARTAGFTEESGTLGDIYETISGSDLVLLLISDAAQADNYEKVFSHMKPNSILGLSHGFLLGHLQSMDLDFPKNISVIAVCPKGMGPSVRRLYVQGKEVNGAGINSSFAVHQDIDGRATDVALGWSVALGSPFTFATTLEQEYKSDIFGERGILLGAVHGVVESLFRRYTENGMNEELAYKNTVECITGVISKTISTKGMLAVYNSLTEEGKREFEAAYSASFYPCMEILYECYEDVATGSEIRSVVLAGRRFYEKEGLPAFPMGKIDQTRMWKVGERVRATRPAGDLGPLYPFTAGVFVALMMAQIEVLRKKGHSYSEIINESVIESVDSLNPFMHARGVSFMVDNCSTTARLGSRKWAPRFDYNLTQQALVAVDNNAPINQDLISNFLADPVHGAIKVCAELRPTVDISVTADADFVRPELRQSGN

SEQ ID NO: 3792 - protein, 422 aa, Cleome gynandra
TLIWSLFCSFRRHVTVFAQQNGVGYFLHCSSPLLYFSFFLQKPSILQSQNCNASYNRVSLLFSKPLRPLMAAVARNVGSGSSVGARMVAAPAIKTPVTLDFETSVFKKEKISLAGHDEYIVRGGRDLFKLLPDAFKGIKQIGVIGWGSQGPAQAQNLRDSLAEAKSDIVVKIGLRKGSGSFDEARAAGFTEENGTLGDIWETISSSDLVLLLISDAAQADSYEKIFSHMKPNSILGLSHGFLLGHLQSMGLDFPKNISVVAVCPKGMGPSVRRLYVQGKEINGAGINSSFAVHQDVDGRATDVALGWSVALGSPFTFATTLEQEYKSDIFGERGILLGAVHGIVEALFRRYTDNGMSEDLAYKNTVECITGTISRTISTQGMLAVYNSLSEEEQKDFRDCLQCFLLSLYGHPLRMLRGRSNW

SEQ ID NO: 3793 - protein, 533 aa, Ambrosia trifida
MVSAPAISKPPTLLDFDTSVFKKEKINLAGHDEYIVRGGRDLFHLLPDAFKGIKQIGVIGWGSQGPAQAQNLRDSLAEAKSDIVVKIGLRKGSSSFNEARAAGFSEESGTLGDIYETISGSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALAWSVALGSPFTFATTLEQEYKSDIFGERGILLGAVHGIVESLFRRYTEDGMSEELAYKNTVECITGIISKIISTQGMKAVYESLDEEGKKEFLTAYSASYYPCMDILYECYEDVATGSEIRSVVLAGRRFYEKEGLPAFPMGKIDQTRMWKVGEQVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNKAPVNQDLISNFFEDPVHDAVKVCAELRPTVDISVPADADFADLSCVKVATEYESQALV

SEQ ID NO: 3794 - protein, 382 aa, Ambrosia trifida
MKPNSILGLSHGFLLGHLQSAGLDFPKNISVVAVCPKGMGPSVRRLYVQGKEVNGAGINASFAVHQDVDGRATDVALAWSVALGSPFTFATTLEQEYKSDIFGERGILLGAVHGIVESLFRRYTEDGMSEELAYKNTVECITGIISKIISTKGMKAVYESLDEEGKKEFLTAYSTSYYPCMDILYECYEDVATGSEIRSVVLAGRRFYEKEGLPAFPMGKIDQTRMWKVGEQVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNKAPVNQDLISNFFEDPVHDAVKVCAELRPTVDISVPADADFVRPELRQGSN

SEQ ID NO: 3795 - protein, 131 aa, Flaveria ramosissima
MATATTTFSTVAPTTSSSASLKISPKTLGFNVGFPSSKTSTKSLKARSNGGCGSAIGARMVSAPVISKPPMLLDFETSVFKKEKINLAGHDEYIVRGGRDLFHLLPEAFKGIKQIGVIGWGSRGSCSSSES

SEQ ID NO: 3796 - protein, 585 aa, Gossypium raimondii
MAATTFSSSFSTPSLNSSSRTHKTLTTPNLGFLASVSRSLRSLKATRLTTDNACGSAMASRMVSIPAVQTHISLDFETSVFKKEKVSLAGQDEYIVRGGRDLFKLLPDAFKGIKQIGVIGWGSQGPAQAQNLRDSLADAKSDIIVKVGLRKGSRSFDEARAAGFSEENGTLGDIWETISGSDLVLLLISDAAQADNYEKIFSYMKPNSILGLSHGFLLGHLQSKGLDFPKNISVIAVCPKGMGPSVRRLYVQGREINGAGINSSFGVHQDVDGRATDVALGWSVALGSPFTFATTLEQEYKSDIFGERGILLGAVHGIVESLFRRYTENGMSEDLAYKNTVECITGIISKTISTQGMLAVYNSLSEEGKREFETAYSASYYPCMDILYECYEDVASGSEIRSVVLAGQRFYEKDGLPAFPMGKIDQTRMWKVGERVQKARPSGDLGPLYPFTAGVYVALMMAQIEILRKKGHSYSEIINESVIEAVDSLNPFMHARGVSFMVDNCSTTARLGSRKWAPRFDYILTQQALVAVDKGTPINQDLLSNFLSDPVHGAIEVCAQLRPTVDISVTPDADFVRPELRQSGN

SEQ ID NO: 3797 - protein, 584 aa, Ricinus communis
MSATASFSATLPKPTPFLSTPKSISSSSSLSTLGFLSIRSKSFKSLRANGGGGSAVGACSMVSMPAVKPLISLDFETTVFKKEKISLAGHDEYIVRGGRDLFKLLPDAFKGIKQIGVIGWGSQGPAQAQNLRDSLGEAKSDIVVKIGLRKGSRSFAEARSAGFTEENGTLGDIWETVSGSDLVLLLISDAAQADNYEKVFSHMKPNSILGLSHGFLLGHLQSMGLDFPKNISVIAVCPKGMGPSVRRLYVQGKEINGAGINSSFAVHQDVDGRATDVALGWSVALGSPFTFATTLEQEYKSDIFGERGILLGAVHGIVESLFRRYTENGMSEDEAYKNTVECITGIISKTISTQGMLAVYNSLSEEGKKQFETAYSASYYPCMDILYECYEDVACGSEIRSVVLAGRRFYERDGLPAFPMGKIDQTRMWKVGERVRSTRAAGDLGPLDPFTAGVYVALMMAQIEILRKKGHSYSEIINESVIESVDSLNPFMHARGVSFMVDNCSTTARLGSRKWAPRFDYILTQQAMVSVDNGTPVKCDLISNFMSDPVHGAIEVCAQLRPTVDISVPPDADFVRPELRQSSN

SEQ ID NO: 3798 - protein, 591 aa, Arabidopsis thaliana
MAAATSSIAPSLSCPSPSSSSKTLWSSKARTLALPNIGFLSSSSKSLRSLTATVAGNGATGSSLAARMVSSSAVKAPVSLDFETSVFKKEKVSLAGYEEYIVRGGRDLFKHLPDAFKGIKQIGVIGWGSQGPAQAQNLRDSLVEAKSDIVVKIGLRKGSRSFEEARAAGFTEESGTLGDIWETIAGSDLVLLLISDAAQADNYEKIFSHMKPNSILGLSHGFLLGHLQSSGLDFPKNISVVAVCPKGMGPSVRRLYVQGKEINGAGINASFAVHQDVDGRAADVALGWSVALGSPFTFATTLEQEYRSDIFGERGILLGAVHGIVESLFRRYTENGMSEDLAYKNTVECITGTISRTISTQGMLAVYNSLSEEGKKDFETAYSASFYPCMEILYECYEDVQSGSEIRSVVLAGRRFYEKEGLPAFPMGNIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYILTQQALVAVDSGAAINRDLISNFFSDPVHGAIEVCAQLRPTVDISVPADADFVRPELRQSSN

SEQ ID NO: 3799 - protein, 589 aa, Brassica napus
MAAATSSIAPSLSCPSPSSSSKSLRSSKATTFAFPNIGSLSSTSKSLRSLTATVAGNGAGSSLSARMVASSAVRAPMSLDFETSVFKKEKVSLAGHEEYIVRGGRDLFKHLPDAFKGIKQIGVIGWGSQGPAQAQNLRDSLVEAKSDIVVKIGLRKGSRSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLTEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3800 - protein, 588 aa, Cucumis sativus
MAAATTHFAPSISASSAKTLKHAAALHPLAPSSLSFLSSSSSGLNALKAVGISAANGIGSALGARMVSVPAIKPLISLDFDTSVFKKEKVNLAGHDEYIVRGGRDLFPLLPEAFKGIKKIGVIGWGSQAPAQAQNLRDSLAEAKSDIVVKIGLRKGSRSFAEARAVGFSEENGTLGDIYETISESDLVMLLISDSAQADNYEKIFSHMKPNSILGLSHGFLLGHLQSSGLDFPKNISVIAVCPKGMGPSVRRLYVQGKEVNGAGINSSFAVHQDVDGRATDVALGWSIALGSPFTFATTLEQEYRSDIFGERGILLGAVHGIVESLFRRYTENGMAEELAYKNTVESITGIISRTISTKGMLAVYNSFSPDEKKEFERAYSASYYPCMDILYECYEDVASGSEIRSVVLAGRRFYEKEGLPAFPMGNIDQTRMWKVGERVRQSRPAGDLGPLYPFTAGVYVALMMAQIEILRKKGHSYSEIINESVIESVDSLNPFMHARGVSFMVDNCSTTARLGSRKWAPRFDYILTQQALVAIDNGSAVNQDLISNFLSDPVHGAIEVCAQLRPTVDISVPADADFVRPELRQSN

SEQ ID NO: 3801 - protein, 585 aa, Plantago ovata
MVAATTTSFSTTATSKALKSTTTNNKAIPHSLGFLSSSSPSMKSLRAAVYSSRASGSSMSAAASMVSAPSTVKAPATFDFDTSVFSKEKINLAGHDEYIVRGGRNLFKLLPDAFKGIKQIGVIGWGSQGPAQAQNLRDSLSEINSDIVVKIGLRKGSRSFAEARGAGFTEENGTLGDIYETISTSDLVLLLISDSAQADNYEKIFSHMKPNSILGLSHGFLLGHLQSMGHDFPKDISVIAVCPKGMGPSVRRLYVQGKEVNGAGINASFAVHQDVDGRATDVALGWSVALGSPFTFATTLEQEYKSDIFGERGILLGAVHGIVESLFRRYTENGMAEELAYKNTVESITGVISKTISTQGMLAVYNALSEEGKRDFEAAYSASYYPCMDILYECYEDVASGSEIRSVVLAGRRFYEKDGLPAFPMGKIDQTRMWKVGERVRATRPAGDMGPLYPFTAGVFVALMMAQIEVLRKKGHSYSEIINESVIESVDSLNPFMHARGVAFMVDNCSTTARLGSRKWAPRFDYVLTQQALVAVDSKAPINQDLISNFMSDPVHGAIDVCAQLRPTVDISVPADADFVRPELR

SEQ ID NO: 3802 - protein, 593 aa, Solanum tuberosum
MAAAAATSFSITTSTPPSSSSSTKSLKPSLVGNLGFLSSSTPSLKPLRAQAAVSSGSSNSGGGALAVRMVAAPATVKAPASFDFETSVFKKEKVTLAGNDEYIVRGGRDLFKYLPDAFKGIKQIGVIGWGSQGPAQAQNLRDSLAEIKSDIVVKIGLRKGSSSFAEARTAGFTEENGTLGDIYETISGSDLVLLLISDAAQADNYEKVFSHMKPNSILGLSHGFLLGHLQSMGLDFPKNISVIAVCPKGMGPSVRRLYVQGKEVNGAGINSSFAVHQDIDGRATDVALGWSVALGSPFTFATTLEQEYKSDIFGERGILLGAVHGVVESLFRRYTENGMNEELAYKNTVECITGVISKTISTKGMLAVYNSLTEEGKREFEAAYSASFYPCMEILYECYEDVATGSEIRSVVLAGRRFYEKEGLPAFPMGKIDQTRMWKVGERVRATRPAGDLGPLYPFTAGVFVALMMAQIEVLRKKGHSYSEIINESVIESVDSLNPFMHARGVSFMVDNCSTTARLGSRKWAPRFDYNLTQQALVAVDNNAPINRDLISNFLADPVHGAIKVCAELRPTVDISVTADADFVRPELRQSGN

SEQ ID NO: 3803 - protein, 582 aa, Panicum virgatum
MAAQTSAASTLAFGHHKTLAAAAVPKILPAAASVSFPATQPACLLSASAARRRDVAAMVSAPPAVGTAMPSLDFETTVFKKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSGSDLVLLLISDAAQADNYEKIFSYMKPNSILGLSHGFLLGHLQSLGLDFPKNISVIAVCPKGMGPSVRRLYVQGKEVNGAGINSSFAVHQDVDGRATDVALAWSIALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILFECYEDVASGSEIRSVVLAGRRFYEKEGLPAFPMGNIDQTRMWKVGEKVRSTRPEGDLGPLHPFTAGVYIALMMAQIEILRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSS

SEQ ID NO: 3804 - protein, 584 aa, Setaria italica
MAAHTSAASTLAFGHPKTLAAAAAAGPKTLPAAASVSFPATQPACLLSASATRRRDVAAMVAAPSAVGTAMPSLDFETSVFKKEKVSLAGHEEYIVRGGRNLFPLLPEAFKGVKQIGVIGWGSQGPAQAQNLRDSLAEAKSDIVVKIGLRKGSKSFEEARAAGFTEENGTLGDIWETVSGSDLVLLLISDAAQADNYEKIFSHMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVESITGIVSKTISKKGMLEVYNSLSEEGKKEFNKAYSASFYPCMDILYECYEDVASGSEIRSVVLAGRRFYEKEGLPAFPMGNIDQTRMWKVGEKVRSTRPEGDLGPLHPFTAGVYIALMMAQIEILRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSS

SEQ ID NO: 3805 - protein, 584 aa, Panicum virgatum
MAAQTSAASTLAFGRHKTLAAAAAAGPKPLPAPGSVSFPAAQPACLLSASAARRRDVSAMVSAPPAVGTAMPSLDFETSVFRKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSGSDLVLLLISDAAQADNYEKIFSHMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRSTRPEGDLGPLHPFTAGVYIALMMAQIEILRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSN

SEQ ID NO: 3806 - protein, 487 aa, Flaveria ramosissima
MVSAPAISKPPMLLDFETSVFKKEKINLAGHDEYIVRGGRDLFHLLPEAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSVGLDFPKNISVVAVCPKGMGPSVRRLYVQGKEVNGAGINASFAVHQDVDGRATDVALAWSVALGSPFTFATTLEQEYRSDIFGERGILLGAVHGIVESLFRRYTEGGMSEDLAYKNTVECITGIISKIISTQGMKAVYESLTEEGKKEFLTAYSASYYPCMDILYECYEDVATGSEIRSVVLAGRRFYEKEGLPAFPMGKIDQTRMWKVGERVRAARPAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNLGPNQQLL

SEQ ID NO: 3807 - protein, 589 aa, Brassica rapa
MAAATSSIAPSLSCPSPSSSSKSLRSSKATTFAFPNIGSLSSTSKSLRSLTATVAGNGAGSSLSARMVASSAVRAPMSLDFETSVFKKEKVSLAGHEEYIVRGGRDLFKHLPDAFKGIKQIGVIGWGSQGPAQAQNLRDSLVEAKSDIVVKIGLRKGSRSFEEARAVGFTEETGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLTEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3808 - protein, 588 aa, Theobroma cacao
MAAATSFSPSISTTPSHNSSSKTHKTLATPSTLGFLSSTSKSLSSLRATRLTSRNGCGSALASRMVSVPAVKPLTSLDFETSVFKREKISLAGHDEYIVRGGRDLFKLLPDAFKGIKQIGVIGWGSQGPAQAQNLRDSLAEAKSDIVVKIGLRKGSRSFAEARAAGFSEENGTLGDIWETISGSDLVLLLISDAAQADSHEKIFSHMKPNSILGLSHGFLLGHLQSKGLDFPKNISVIAVCPKGMGPSVRRLYVQGKEINGAGINSSFGVHQDVDGRATDVALGWSVALGSPFTFATTLEQEYKSDIFGERGILLGAVHGLVECLFRRYTENGMSEDLAYKNTVECVTGIMSKTISTQGMLSVYNSFSEEGKKEFEAAYSASYYPCMDILYECYEDVASGSEIRSVVLAGQRFYEKDGLPAFPMGKIDQTRMWKVGERVRKSRPAGDLGPLYPFTAGVYVALMMAQIEILRKKGHSYSEIINESVIEAVDSLNPFMHARGVSFMVDNCSTTARLGSRKWAPRFDYILTQQALVAVDKGTPINQDLISNFLSDPVHGAIEVCAQLRPTVDISVPPDADFVRPELRQSGN

SEQ ID NO: 3809 - protein, 589 aa, Brassica napus
MAAATSSIAPSLTCPSASSSSKALRSSKVSTFAFPNIGFTSSASKSLRSLSAAVSGNGTGSSLAARMVASSAVRAPISLDFETSVFKKEKVSLAGHEEYIVRGGRDLFKHLPDAFKGIKQIGVIGWGSQGPAQAQNLRDSLVEAKSDIVVKIGLRKGSKSFEEARAVGFTEESGTLGDIWETISGSDFVLLLISDAAQADNYEKIFSHMKPNSILGLSHGFLLGHLQSMGLDFPKNISVVAVCPKGMGPSVRRLYVQGKEVNGAGINASFAVHQDVDGRAADVALGWSVALGSPFTFATTLEQEYKSDIFGERGILLGAVHGIVESLFRRYTENGMSEDLAYKNTVECITGNISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIEVCAQLRPTVDISVPEDADFVRPELRQSN

SEQ ID NO: 3810 - protein, 590 aa, Flaveria ramosissima
MAAAAPTFSAAPTTQSPPSSSSSPTLKTAPQTLGFATTFLSSKTSFKSLQSRVLSFNGGSALGARMVAAPVISKSPVSLDFDTSVFKKEKVNLAGHEEYIVRGGRDLFHLLPDAFKGIKQIGVIGWGSQGPAQAQNLRDSLAEAKSDIVVKIGLRKGSSSFAEARAAGFSEENGTLGDIYETISGSDLVLLLISDSAQADNYEKIFSHMKPNSILGLSHGFLLGHLQSIGLDFPKNVSVVAVCPKGMGPSVRRLYVQGKEINGAGINASFAVHQDVDGRATDVALGWSVALGSPFTFATTLEQEYKSDIFGERGILLGAVHGIVESLFRRYTEQGMTEDLAYKNTVECITGVISKTISTKGMKAVYESLSEEGKKDFLIAYSASYYPCMEILYECYEDVASGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYNLTQQALVAVDNGTPVNQDLVKAFFEDPVHEAVKVCAELRPTVDISVPADADFVRPELRQSSN

SEQ ID NO: 3811 - protein, 584 aa, Tragopogon dubius
MAAATTSFSTLAPTASSSAASASLKVAPKTLGFNVGFLSSKTPSKSLKVRSNGGCGSALGARMVSAPAITKPPTLLDFETSVFKKEKINLAGYDEYIVRGGRDLFHLLPDAFKGIKQIGVIGWGSQGPAQAQNLRDSLVEAKSDIVVKIGLRKGSSSFNEARAAGFTEENGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALAWSVALGSPFTFATTLESEYRSDIFGERGILLGAVHGIVESLFRRYTEGGMTEELAYKNTVECITGNISRTISTQGMKAVYESLSEEGKKEFLTAYSASYYPCMDILYECYEDVASGSEIRSVVLAGRRFYEKEGLPAFPMGKIDQTRMWKVGERVRAVRPAGDLGPLYPFTAGVYVALMMAQIEVLRKKGHSYSEIINESLIESVDSLNPFMHARGVSFMVDNCSTTARLGSRKWAPRFDYVLTQQALVAVDNGSALNQDLISNFFEDPVHEAVKVCAELRPTVDISDADFVRPELRQASN

SEQ ID NO: 3812 - protein, 585 aa, Gossypium hirsutum
MAATTFSPSFSTPSVNSSSRAHKTLTNPNLGFLASVSRSLRSLKATRLTTDNACGSAMASRMVSVPAVQTHISLDFETFVFKKEKVSLAGQDEYIVRGGRDLFKLLPDAFKGIKQIGVIGWGSQGPAQAQNLRDSLADAKSDIIVKVGLRKGSRSFDEARAAGFSEENGTLGDIWETISGSDLVLLLISDAAQADNYEKIFSYMKPNSILGLSHGFLLGHLQSKGLDFPKNISVIAVCPKGMGPSVRRLYVQGREINGAGINSSFGVHQDVDGRATDVALGWSVALGSPFTFATTLEQEYKSDIFGERGILLGAVHGIVESLFRRYTENGMSEDLAYKNTVECITGIISKTISTQGMLAVYNSLSEEGKREFETAYSASYYPCMDILYECYEDVASGSEIRSVVLAGQRFYEKDGLPAFPMGKIDQTRMWKVGERVQKARPSGDLGPLYPFTAGVYVALMMAQIEILRKKGHSYSEIINESVIEAVDSLNPFMHARGVSFMVDNCSTTARLGSRKWAPRFDYILTQQALVAVDKGTPINQDLLSNFLSDPVHGAIEVCAQLRPTVDISVTPDADFVRPELRQSGN

SEQ ID NO: 3813 - protein, 585 aa, Gossypium hirsutum
MAATTFSSSFSTPSLNSSSRTHKTLTTPNLGFLASVSRSLRSLKATRLTTDNACGSAMASRMVSIPAVQTHISLDFETFVFKKEKVSLAGQDEYIVRGGRDLFKLLPDAFKGIKQIGVIGWGSQGPAQAQNLRDSLADAKSDIIVKVGLRKGSRSFDEARAAGFSEENGTLGDIWETISGSDLVLLLISDAAQADNYEKIFSYMKPNSILGLSHGFLLGHLQSKGLDFPKNISVIAVCPKGMGPSVRRLYVQGREINGAGINSSFGVHQDVDRRATDVALGWSVALGSPFTFATTLEQEYKSDIFGERGILLGAVHGIVESLFRRYTENGMSEDLAYKNIVECITGIISKTISTQGMLAVYNSLSEEGKREFETAYSASYYPCMDILYECYEDVASGSEIRSVVLAGQRFYEKDGLPAFPMGKIDQTRMWKVGERVRKARPSGDLGPLYPFTAGVYVALMMAQIEILRKKGHSYSEIINESVIEAVDSLNPFMHARGVSFMVDNCSTTARLGSRKWAPRFDYILTQQALVAVDKGTPINQDLLSNFLSDPVHGAIEVCAQLRPTVDISVTPDADFVRPELRQSGN

SEQ ID NO: 3814 - protein, 586 aa, Brassica napus
ATSSIAPSLSCPSPSSSSKALRSSKATTFAFPNIGSLSSTSKSLRSLTATVAGNGTGSSLSARMVASSAVRAPMSLDFETSVFKKEKVSLAGHEEYIVRGGRDLFKHLPDAFKGIKQIGVIGWGSQGPAQAQNLRDSLVEAKSDIVVKIGLRKGSRSFEEARAVGFTEETGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLSEEGKKDFEIAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3815 - protein, 343 aa, Brassica napus
MGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLTEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3816 - protein, 586 aa, Flaveria ramosissima
MATATATTTFSTVSPTTSSSPSLKISPKTLGCNVGFSLSKTSTKSLKARSNGGCGSAIGARMVSAPAISKPPMLLDFETSVFKKEKINLAGHDEYIVRGGRDLFHLLPEAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSVGLDFPKNISVVAVCPKGMGPSVRRLYVQGKEVNGAGINASFAVHQDVDGRATDVALAWSVALGSPFTFATTLEQEYRSDIFGERGILLGAVHGIVESLFRRYTEGGMSEDLAYKNTVECITGTISKIISTQGMKAVYESLTEEGKKEFLTAYSAAYYPCMDILYECYEDVATGSEIRSVVLAGRRFYEKEGLPAFPMGKIDQTRMWKVGERVRAARPAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNQDLISNFFEDPVHEAVKVCAELRPTVDISVPADADFVRPELRQASN

SEQ ID NO: 3817 - protein, 399 aa, Brassica rapa
MAAATSSIAPSLTCPSASSSSKALRSSKVSTFAFPNIGFTSSASKSLRSLSAAVSGNGTGSSLAARMVASSAVRAPISLDFETSVFKKEKVSLAGHEEYIVRGGRDLFKHLPDAFKGIKQIGVIGWGSQGPAQAQNLRDSLVEAKSDIVVKIGLRKGSKSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEVNGAGINASFAVHQDVDGRAADVALGWSVALGSPFTFATTLEQEYKSDIFGERGILLGAVHGIVESLFRRYTENGMSEDLAYKNTVECITGNISRTISTQGMLAVYNSLSEEVLKKISRLPTVHPSILVWRFSMSATRT

SEQ ID NO: 3818 - protein, 354 aa, Panicum virgatum
MPSLDFETSVFKKEKVSLAGHEEYIVRGGRDLFPLLPEAFKGIKQIGVIGWGSQGPAQAQNLRDSLVEAKSDIVVKIGLRKGSKSFEEARAAGFTEESGTLGDIWETISGSDLVLLLISDSAQADNYEKIFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGMVEALFRRYTEQGMDEDSAYKNTVESITGIISKTISKKGMLEVYNSLTEEGKKQFIEAYSAAYYPCMDILYECYEDVSSGSEIRSVVLAGRRFYEKERASCFSHGQY

SEQ ID NO: 3819 - protein, 588 aa, Helianthus annuus
MAAATTTTTFSTLAPTTSSATTTASLKAAPKTLGFNVGLFSSKTASKTLRARSNGGSGSALGARMVSAPAITKPTLLDFETSVFKKEKINLAGHDEYIVRGGRDLFHLLPDAFKGIKQIGVIGWGSQGPAQAQNLRDSLVEAKSDIVVKIGLRKGSSSFNEARAAGFTEESGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALGWTVALGSPFTFATTLEQEYRSDIFGERGILLGAVHGIVESLFRRYTEGGMSEELAYKNTVECITGIISKTISTQGMKAVYDSLTEEGKKEFLTAYSASYYPCMDILYECYEDVQSGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNQDLISNFFEDPVHEAVKVCAELRPTVDISVPADADFVRPELRQSSN

SEQ ID NO: 3820 - protein, 588 aa, Helianthus annuus
MAAATTTTTFSTLAPTTSSATTTASLKAAPKTLGFNVGLFSSKIASKTLRARSNGGSGSALGARMVSAPAITKPTLLDFETSVFKKEKINLAGHDEYIVRGGRDLFHLLPDAFKGIKQIGVIGWGSQGPAQAQNLRDSLVEAKSDIVVKIGLRKGSSSFNEARAAGFTEESGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALGWSVALGSPFTFATTLEQEYRSDIFGERGILLGAVHGIVESLFRRYTEGGMSEELAYKNTVECITGIISKTISTQGMKAVYDSLTEEGKKEFLTAYSASYYPCMDILYECYEDVQSGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYIVTQQALVAVDNGTPLNQDLISNFFEDPVHEAVKVCAELRPTVDISVPADADFVRPELRQSSN

SEQ ID NO: 3821 - protein, 594 aa, Arabidopsis lyrata
MAAATSSIAPSLSCPSPSSSSKTLRSSKARTLALPNIGFLSSSSKSLRSLTATVAGNGIGSATGSSLSARMVSSSAVKAPVSLDFETSVFKKEKVSLAGYEEYIVRGGRDLFKHLPDAFKGIKQIGVIGWGSQGPAQAQNLRDSLVEAKSDIVVKIGLRKGSRSFEEARAAGFTEETGTLGDIWETISGSDLVLLLISDAAQADNYEKIFSHMKPNSILGLSHGFLLGHLQSSGLDFPKNISVVAVCPKGMGPSVRRLYVQGKEINGAGINASFAVHQDVDGRAADVALGWSVALGSPFTFATTLEQEYRSDIFGERGILLGAVHGIVESLFRRYTENGMSEDLAYKNTVECITGTISRTISTQGMLAVYNSLSEEGKKDFETAYSASFYPCMEILYECYEDVQSGSEIRSVVLAGRRFYEKEGLPAFPMGNIDQTRMWKVGEGVRKSRPAGDLGPLYPFTAGVYVALMMAQIEILRKKGHSYSEIINESVIESVDSLNPFMHARGVSFMVDNCSTTARLGSRKWAPRFDYILTQQALVAVDSGAAINRDLISNFFSDPVHGAIEVCAQLRPTVDISVPADADFVRPELRQSSN

SEQ ID NO: 3822 - protein, 592 aa, Elaeis guineensis
  misc_feature (380)..(380): Xaa can be any naturally occurring amino acid
MAAATSFKPSSIAAASPAKTLKPAPKTLALGLGFSSSSSRSLRLLLSRMHMDAAAAGRGGAAALGARMVSVPSISKPAPSLDFETSVFKKEKITLAGQNEYIVRGGRDLFHLLPDAFKGIKQIGVIGWGSQGPAQAQNLRDSLAEAQSDIVVKIGLRKGSRSFEEARAAGFTEENGTLGDIWETISGSDLVLLLISDSAQADNYEKVFSHMKPNSILGLSHGFLLGHLQSLRLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEEKAYKNTVECITGIMSKTISTKGMLSVYNSLTEEEKKEFXAAYSASYYPCMDILYECYEDVACGSEIRSVVLAGRRFYEKEGLPAFPMGKIDQTRMWKVGERVRAARPEGDLGPLHPFTAGVYVALMMAQIEVLRKKGHSYSEIINESVIESVDSLNPFMHARGVSFMVDNCSTTARLGSRKWAPRFDYILTQQALVAVDKNAPINQDLLSNFFSDPVHGAIEVCAELRPTVDISVPPDADFVRPELRQTGN

SEQ ID NO: 3823 - protein, 588 aa, Helianthus annuus
MAAATTTTTFSTLAPTTSSSTTTASLKAAPKTLGFNVGLLSSKTASKTLRARSNGGSGSALGARMVSAPAITKPTLLDFETSVFKKEKINLAGHDEYIVRGGRDLFHLLPDAFKGIKQIGVIGWGSQGPAQAQNLRDSLVEAKSDIVVKIGLRKGSSSFNEARAAGFTEESGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALGWSVALGSPFTFATTLEQEYRSDIFGERGILLGAVHGIVESLFRRYTEGGMSEELAYKNTVECITGIISKTVSTQGMKAVYDSLTEEGKKEFLTAYSASYYPCMDILYECYEDVQSGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYIVTQQALVAVDNGTPLNQDLISNFFEDPVHEAVKVCAELRPTVDISVPADADFVRPELRQSSN

SEQ ID NO: 3824 - protein, 446 aa, Tabernaemontana elegans
MAAAAPTTPFSASTTPVSKTLKQHTKNLAHNLSFISSSTPSLHALMARASGPVSGTSHGGAVAACMVSTPSAVAKVQPLTLDFVTSVFKKEKVNLAGHEEYIVRGGRDLFKLLPDAFKGIKQIGVIGWGSQGPAQAQNLRDSLAEAKSDIVVKVGLRKGSRSFVEARAAGFSEEDGTLGDIYETISGSDLVLLLISDAAQADNYENVFSHMKPNSILGLSHGFLLGHLQSMGLDFPQNISVIAVCPKGMGPSVRRLYVQGKEINGAGINSSFAVHQDVDGRATDVALGWSVALGSPFTFATTLEQEYKSDIFGERGILLGAVHGIVESLFRRYTEKGMAEDLAYKNTVECITGIISKTISTKGMLAVYNSLTAEGKKEFETAYSASYYPCMDILYECYEDVATGSEIRSVVLAGRRFCEKEGLPAFPMGKIDQTRMWKVGERVRAS

SEQ ID NO: 3825 - protein, 254 aa, Tabernaemontana elegans
MAEDLAYKNTVECITGIISKTISTKGMLAVYNSLTSEGKKEFEAAYSASYYPCMDILYECYEDVASGSEIRSVVLAGRRFYEKEGLPAFPMGKIDQTRMWKVGERVRASRPAGDLGPLYPFTAGVYVALMMAQIEILRKKGHSYSEIINESVIESVDSLNPFMHARGVSFMVDNCSTTARVGSRKWAPRFDYILTQQALVAVDNKTPINRDLISNFLSDPVHGAIEVCAQLRPTVDISVPQDADFVRPELRQSN

SEQ ID NO: 3826 - protein, 589 aa, Brassica rapa
MAAATSSIAPSLSCPPSSSSSKALRSSKVSTFAFPNIGFTFSASKSLRSLTAAVSGNGTGSSLSARMVASSAVRAPLSLDFETSVFKKEKVSLAGHEEYIVRGGRDLFKHLPDAFKGIKQIGVIGWGSQGPAQAQNLRDSLVEAKSDIVVKIGLRKGSKSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEVNGAGINASFAVHQDVDGRAADVALGWSVALGSPFTFATTLEQEYKSDIFGERGILLGAVHGIVESLFRRYTENGMSEDLAYKNTVECITGNISRTISTQGMLAVYNSLSEEGKKDFVTAYSASFYPCMEILYECYEDVAAGSEIRSVVLAGRRFYDKEGLPAFPMGKIDQTRMWKVGERVRTSRPAGDLGPLYPFTAGVYVALMMAQIEILRKKGHSYSEIINESVIESVDSLNPFMHARGVSFMVDNCSTTARLGSRKWAPRFDYNLTQQALVVVDNGAPINKDLISNFFADPVHGAIEVCAQLRPTVDISVPEDADFVRPELRQSN

SEQ ID NO: 3827 - protein, 581 aa, Aristolochia fimbriata
MAAASTFSPCLAPSSSKILKSAPKSLSGVGFLSSSAKTLKPLLSSVSTGAAAPSRGAVGARMVSMPAIRHSTTLDFETSVFKKEKVTLAGQDEYIVKGGRDLFKLLPDAFKGIKQIGVIGWGSQGPAQAQNLRDSLAEVKSDIVVKIGLRKGSSSFAEARSAGFSEENGTLGDIWETVAGSDLVLLLISDAAQADNYEKVFSHMKPNSILGLSHGFLLGHLQSLGQDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMNEDLAYKNTVECITGIISRTISTQGMLAVYNSLSEEGKKEFQTAYSASYYPCMDILYECYEDVASGSEIRSVVLAGRRFYEKEGLPAFPMGKIDQTRMWKVGERVRSTRPQGDLGPLHPFTAGVYVALMMAQIEVLRKKGHSHSEIINESVIESVDSLNPFMHARGVSFMVDNCSTTARLGSRKWAPRFDYILTQQALVAVDKSTSINQDLLSNFFSDPVHGAIEVCAQLRPAVDISVPADADFVRPELR

SEQ ID NO: 3828 - protein, 576 aa, Euphorbia peplus
MAAAAATTFSGTLSSPSPSKCPAKSLSWSSGLGYTPVSEKKSLKALKASNGGARMIVSMPAVAKPLISLDFETSVFNKEKVSLAGHQEYIVRGGRDLFKLLPDAFKGINQIGVIGWGSQGPAQAQNLRDSLAEANSDIVVKIGLRKGSRSFAEARAAGFTEETGTLGDIWETVSGSDLVLLLISDAAQADNYEKVFSHMKPNSILGLSHGFLLGHLQSSGLDFPKNISVVAVCPKGMGPSVRRLYVQGKEVNGAGINASFAVHQDVDGRATDVALGWSVALGSPFTFATTLEQEYKSDIFGERGILLGAVHGIVESLFRRYTENGMGEEEAYKNTVEGITGNISKTISTQGMLAVYNSLSEEGKKEFEIAYSASFYPCMEILYECYEDVASGSEIRSVVLAGRRFYEKEGLPAFPMGNIDQTRMWKVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDSGTPVNRDLISNFLSDPVHGAIEVCAQLRPTVDISIPADADFVRPELR

SEQ ID NO: 3829 - protein, 579 aa, Unknown
  Sequence found in Organisms: Zea mays, Triticum aestivum
MAAATSSSTYLAIGRKTLNPAPSVATAATSVSFPATQHPCLVAASADRRRAVAAKVSSPSVIGTAMPSLDFETSVFKKEKVSLAGHEEYIVRGGRDLFPLLPEAFKGIKQIGVIGWGSQGPAQAQNLRDSLVEAKSDIVVKIGLRKGSKSFEEARAAGFTEESGTLGDIWETVSNSDLVLLLISDSAQADNYEKIFSHMKPNSILGLSHGFLLGHLQSLGFDFPKSISVIAVCPKGMGPSVRRLYVQGKEINGAGINASFAVHQDVDGRATDVALGWSVALGSPFTFATTLEQEYRSDIFGERGILLGAVHGMVEALFRRYTEQGMDEDSAYKNTVESITGIISKTISKKGMLEVYNSLTEEGKKQFIEAYSAAYYPCMDILYECYEDVSSGSEIRSVVLAGRRFYEKEGLPAFPMGKIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTVDKKAPINQDLISNFMSDPVHGAIEVCAQLRPTVDISVTADADFVRPELRQSS

SEQ ID NO: 3830 - protein, 585 aa, Aquilegia formosa
MAATTSFSSPLSSSCNKTLQTPHSKIPSFNLTFLSSSSSSFSTKTSLISHINNNAISPSSKMTVSTNPSINKPLKTLDFDTSVFNKEKISLAGNDEFIVRGGRDLFHLLPDAFKGIKQIGVIGWGSQGPAQAQNLRDSLAEARSDIVVKIGLRRGSRSFAEARSAGFTEESGTLGDIWETISESDLVLLLISDAAQADNYEKIFSYMKPNSILGLSHGFLLGHLQSSGLDFPKNISVVAVCPKGMGPSVRRLYVQGKEINGAGINASFAVHQDVDGRATDVALGWSVALGSPFTFATTLEQEYKSDIFGERGILLGAVHGIVESLFRRYTENGMNEELAYKNTVECITGIISRTISTEGMLAVYNSLTEDGKKEFHAAYSASYYPCMDILYECYEDVASGNEIRSVVLAGRRFYEKEGLPAFPMGNIDQTRMWKVGERVRSTRPKGDLGPLYPFTAGVFVALMMAQIEILRKKGHSYSEIINESVIESVDSLNPFMHARGVSFMVDNCSTTARLGSRKWAPRFDYVLTQQALVAVDQKTPINQDLISNFLSDPVHGAIEVCAQLRPTVDISVPADADFVRPELRQ

SEQ ID NO: 3831 - protein, 568 aa, Cirsium arvense
SSLKTPPKTLGFSLGFTSSKTSFKSLQTRVFSSSGSGSAIRARVVSAPEITTSPDLLDFETSVFKKEKINLAGYDEYIVRGGRDLFHLLPDAFKGIKQIGVIGWGSQGPAQAQNLRDSLAEAKSDIVVKIGLRKGSSSFAEARAAGFTEETGTLGDIYATISGSDLVLLLISDSAQADNYEKIFSHMKPNSILGLSHGFLLGHLQSTGLDFPKNVSVVAVCPKGMGPSVRRLYVQGKEINGAGINASFAVHQDVDGRATDVALGWSVALGSPFTFATTLEQEYKSDIFGERGILLGAVHGIVESLFRRYTENGMSEDLAYKNTVECITGIISRTISTKGMKAVYESLSEEGKKDFLKAYSASYYPCMDILYECYEDVASGSEIRSVVLAGRRFYEKEGLPAFPMGKIDQTRMWKVGERVRASRPAGDLGPLYPFTAGVYVALMMAQIEVLRKKGHSYSEIINESLIESVDSLNPFMHARGVSFMVDNCSTTARLGSRKWAPRFDYVLTQQALVAVDNDTPINQDLVANFFEDPVHEAVKVCAELRPTVDISVPADADFVRPELRQSSN

SEQ ID NO: 3832 - protein, 575 aa, Festuca arundinacea
MAAPTSSAPSTRPFSHPKTLAAAATLSASVAFPATHPSCALATRRRAVAAMVAAPAKVGAAMPSLDFDTAVFNKEKVSLAGHEEYIVRGGRNLFPLLPEAFKGVKQIGVIGWGSQGPAQAQNLRDSLTEAKSDIVVKIGLRKGSKSFEEARAAGFTEENGTLGDIWETVSGSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKTTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPQGDLGPLHPFTAGVYVALMMAQIEVLRKKGHSYSEIINESVIESVDSLNPFMHASGVAFMVDNCSTTARLGSRKWAPRFDYILTQQAFVTVDKDAPINQDLISNFFSDPVHGAIKVCAELRPTVDISVTADADFVRPELRQSA

SEQ ID NO: 3833 - protein, 593 aa, Arachis hypogaea
MAAATSFSATITANPETLAGPVSGRTLAVANANANGNVSFRQSLSSSSSKLSFGSLKCSRRNSTGALGACMVSAPAVKAPVSLDFDTSVFKKEKISLAGHDEYIVKGGRDLFHLLPDAFKGIKQIGVIGWGSQGPAQAQNLRDSLAEAKSDIVVKIGLRKGSRSFAEARAAGFSEENGTLGDIWETVSGSDLVLLLISDAAQADNYEKIFSYMKSNSILGLSHGFLLGHLQSLGLDFPKNISVIAVCPKGMGPSVRRLYVQGKDINGAGINSSFAVHQDVDGRATDVALGWSVALGSPFTFATTLEQEYKSDIFGERGILLGAVHGVVEALFRKYTENGVPEDLAYKNTVESITGIISKTISSKGMREVYYALDDTGKSIFEKAYSAAYYPCMEILYECYEDVASGSEIRSVVLAGRRFYEKEGLPAFPMGKIDQTRMWKVGERVRSTRPAGDLGPLDPITAGVFVALMMAQIEILRKKGHSYSEIINESLIEAVDSLNPFMHARGVSFMVDNCSTTARLGSRKWAPRFDYILTQQALVALEECAPINRDLISNFLSDPVHGAIEVCAQLRPTVDISVPPDADFVRPELRQSN

SEQ ID NO: 3834 - protein, 593 aa, Vinca minor
MAASAATSLSVSTTPATKTLISQTTSVVHNLSFLSSSTPSLKPLVARAASTSVSVSSHGGGAGAAASRMVSTPAAAVKPLTSLDFETSVFKKEKVSLAGHEEYIVRGGRDLFKLLPDAFKGIKQIGVIGWGSQGPAQAQNLRDSLAEAKSDIVVKIGLRKGSRSFAEARAAGFSEENGTLGEIYETISGSDLVLLLISDAAQADNYEEVFSHMKPNSILGLSHGFLLGHLQSIGTDFPKNISVIAVCPKGMGPSVRRLYVQGKEINGAGINASFAVHQDVNGRATDVALGWSVALGSPFTFATTLEQEYKSDIFGERGILLGAVHGIVESLFRRYTEKGMAEDLAYKNTVECITGIISKSISTKGMLSVYNALTEEEKKEFEAAYSASYYPCMDILYECYEDVATGSEIRSVVLAGRRFYEKEGLPAFPMGKIDQTRMWKVGERVRAVRPAGDLGPLHPFTAGVYVALMMAQIEILRKKGHSYSEIINESVIESVDSLNPFMHARGVAFMVDNCSTTARLGSRKWAPRFDYILTQQALVAVDNKTPVNGDLISNFLSDPVHGAIEVCAQLRPTVDISVPEDADFVRPELRQSN

SEQ ID NO: 3835 - protein, 609 aa, Arnica chamissonis
TDTKLSYLCSAVSPRPHHISRQWRRRPPLSQPWPLPPHRRQRRRLSRLLPKTLRFNVDFVSSKTSSKSLKARSNGGSGSALGARMVSAPAISITPTLLDFETSVFKKEKINLAGHDEYIVRGGRDLFHLLPDAFKGIKQIGVIGWGSQGPAQAQNLRDSLVEAKSDIVVKIGLRKGSSSFNEARAAGFSEETGTLGDIYETISGSDLVLLLISDSAQADNYEKIFSYMKPNSILGLSHGFLLGHLQSVGLDFPKNISVVAVCPKGMGPSVRRLYVQGKEINGAGINASFAVHQDVDGRATDVALAWSVALGSPFTFATTLEQEYKSDIFGERGILLGAVHGIVESLFRRYTEGGMSEDLAYKNTVECITGIISRTISTQGMKAVYESLTEEGKKEFLTAYSASFYPCMEILYECYEDVASGSEIRSVVLAGRRFHEKEGLPAFPMGKIDQTRMWKVGEQVRAVRPTGDLGPLHPFTAGVYVALMMAQIEVLRKKGHSYSEIINESLIESVDSLNPFMHARGVSFMVDNCSTTARLGSRKWAPRFDYILTQQALVAVDNGAPLNQDLISNFFEDPVHEAVKVCAELRPTVDISVPADADFVRPELRQGSN

SEQ ID NO: 3836 - protein, 158 aa, Elaeis guineensis
MVFFLGICNPLALISQNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEEMAYKNTVECITGIMSKTISTKGMLSVYNSLTEEEKKGI

SEQ ID NO: 3837 - protein, 586 aa, Brassica rapa
MAAATSSIAPPLSCPSLSSSLRSSKGTSFALPSISFVSSTSKSLRSLTATVPGNGTGSSLSARMVASSAVRAPVSLDFETSVFKKEKVSLAGYDEYIVRGGRDLFKHLPDAFKGVKQIGVIGWGSQGPAQAQNLRDSLVEAKSDIVVKIGLRKGSKSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVAPGWSVALGSPFTFATTLEQEYKSDIFGERGILLGAVHGIVESLFRRYTGNGMSEDLAYKNTVECITGTISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDSGAPINKDLISNFFADPVHGAIEVCAQLRPTVDISVPEDADFVRPELRQSS

SEQ ID NO: 3838 - protein, 579 aa, Sorghum bicolor
MAAATSSSTYLAIARKTLNPAPSVGTAAASVSFPATQPPCLLAASADRRRAVAAKVSSPSVIGTAMPSLDFETSVFKKEKVSLAGHEEYIVRGGRDLFPLLPEAFKGIKQIGVIGWGSQGPAQAQNLRDSLVEAKADVVVKIGLRKGSKSFEEARAAGFTEESGTLGDIWETVSSSDLVLLLISDSAQADNYEKIFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGMVEALFRRYTEQGMDEDSAYKNTVESITGIISKTISKKGMLEVYNSLTEEGKKQFIEAYSAAYYPCMDILYECYEDVSSGSEIRSVVLAGRRFYEKEGLPAFPMGNIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTVDKKAPINQDLISNFMSDPVHGAIEVCAQLRPTVDISVTADADFVRPELRQSS

SEQ ID NO: 3839 - protein, 591 aa, Capsicum annuum
MAAAATTSFSISTASSSSASSSKSLKPSLASNLGFLSSAPSLKPLRAKTAVSAGGSSSGGAMAAKMVSAPAAVVKAPASFDFETSVFKKEKVTLAGNDEYIVRGGRDLFKYLPDAFKGIKQIGVIGWGSQGPAQAQNLRDSLAEIKSDIVVKIGLRKGSSSFAEARAAGFTEENGSLGDIYETISGSDLVLLLISDAAQADNYEKVFSHMKPNSILGLSHGFLLGHLQSTGLDFPKNISVIAVCPKGMGPSVRRLYVQGKEINGAGINASFAVHQDIDGRATDVALGWSVALGSPFTFATTLEQEYRSDIFGERGILLGAVHGVVESLFRRYTENGMSEELAYKNTVECITGIISRTISTKGMLAVYNSFTEEGKRDFEAAYSASFYPCMEILYECYEDVAAGSEIRSVVLAGRRFYEKEGLPAFPMGKIDGTRMWKVGERVRATRPAGDLGPLYPFTAGVYVALMMAQIEVLRKKGHSYSEIINESVIESVDSLNPFMHARGVSFMVDNCSTTARLGSRKWAPRFDYNLTQQALVAVDNNAPINRDLISNFLADPVHGAIEVCAQLRPTVDISVPADADFVRPELRQSGN

SEQ ID NO: 3840 - protein, 581 aa, Oryza sativa
MAAATSTSSTALAHPKTLNPASKSAAAGSVSFPAAQPPCPLAASAGGRRRRGAVAAKVSSPQVIGATMPSLDFETSVFKKEKVSLAGHDEYIVRGGRNLFPLLPEAFKGIKQIGVIGWGSQGPAQAQNLRDSLAEAKSDIVVKIGLRKGSKSFEEARAAGFTEESGTLGDIWETISSSDLLLLLISDAAQADNYEEIFSHMKPNSILGLSHGFLLGHLQSVGLDFPKNISVVAVCPKGMGPSVRRLYVQGKEVNGAGINSSFAVHQDVDGRATDVALGWSVALGSPFTFATTLEQEYRSDIFGERGILLGAVHGIVEALFRRYTEHGLDEDSAYKNTVECITGIISKTISKKGMLEVYNSLTEEGKKQFIEAYSAAYYPCMDILYECYEDVSSGSEIRSVVLAGRRFYEKEGLPAFPMGNIDQTRMWKVGERVRSTRPAGDLGPLHPFTAGVYVALMMAQIEVLRKKGHSYSEIINESLIESVDSLNPFMHARGVAFMVDNCSTTARLGSRKWAPRFDYILTQQAFVTVDKNAPVNQDLISNFFSDPVHSAIEVCAQLRPTVDISVPADADFVRPELRQSS

SEQ ID NO: 3841 - protein, 593 aa, Eutrema parvulum
MAAATSSIAPSLSCPSPSSSSKTLRSSKARTLALPNIGFLSSTSKSLRSLTATVAGNGIGSATGSSLSARMVASSAVRTPVSLDFETSVFKKEKVSLAGYDEYIVRGGRDLFKHLPDAFKGIKQIGVIGWGSQGPAQAQNIRDSLVEAKSDIVVKIGLRKGSSSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPEDADFVRPELRQSN

SEQ ID NO: 3842 - protein, 566 aa, Elaeis guineensis
FSSSSSRSLRLLLSRMHMDAAAAGRGGAAALGARMVSVPSISKPAPSLDFETSVFKKEKITLAGQNEYIVRGGRDLFHLLPDAFKGIKQIGVIGWGSQGPAQAQNLRDSLAEAQSDIVVKIGLRKGSRSFEEARAAGFTEENGTLGDIWETISGSDLVLLLISDSAQADNYEKVFSHMKPNSILGLSHGFLLGHLQSLRLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEEKAYKNTVECITGIMSKTISTKGMLSVYNSLTEEEKKEFNAAYSASYYPCMDILYECYEDVACGSEIRSVVLAGRRFYEKEGLPAFPMGKIDQTRMWKVGERVRAARPEGDLGPLHPFTAGVYVALMMAQIEVLRKKGHSYSEIINESVIESVDSLNPFMHARGVSFMVDNCSTTARLGSRKWAPRFDYILTQQALVAVDKNAPINQDLLSNFFSDPVHGAIEVCAELRPTVDISVPPDAVFCASRIATNWQLRNGNRI

SEQ ID NO: 3843 - protein, 584 aa, Secale cereale
MAAPTSSAASTLAPFSHPKTLAAAAAASAISSVAFSPAASHPACALASSPSARRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPINQDLISNFMSDPVHGAIEVCAELRPTVDISVTADADFVRPELRQSA

SEQ ID NO: 3844 - protein, 567 aa, Brassica napus
SLRSSKATTFAFPNIGSLSSTSKSLRSLTATVAGNGTGSSLSARMVASSAVRAPMSLDFETSVFKKEKVSLAGHEEYIVRGGRDLFKHLPDAFKGIKQIGVIGWGSQGPAQAQNLRDSLVEAKSDIVVKIGLRKGSRSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAPINKDLISNFFADPVHGAIQVCAELRPTVDISVPQDADFVRPELRQSN

SEQ ID NO: 3845 - protein, 581 aa, Brachypodium distachyon
MAASTISFSHPKTLAAAAAVPKTLPIPTASSVAFPASHPAWVLSAARRRAVAAMVAAPTTTASVGAAMPSLDFDTSVFNKEKVSLAGHEEYIVRGGRNLFPLLHEAFKGVKQIGVIGWGSQGPAQAQNLRDSLAEAKSDIVVKIGLRKGSKSFEEARGAGFSEENGTLGDIWETISGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEALTYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRLTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVTADADFVRPELRQSS

SEQ ID NO: 3846 - protein, 589 aa, Papaver somniferum
MAAATSFSTSVAAPSKTLKPVHSSSSLGFKLGFLSSSSKTLKPLLLRVSNNNVSSSAVGSAVASTMSVSAPTKPLTTLDFETSVFNKEKVTLAGNDEYIVKGGRDLFHLLPEAFKGIKQIGVIGWGSQGPAQAQNLRDSLVEAKSDIVVKIGLRKGSASFAEARSVGFTEETGTLGDIYETVAGSDLVLLLISDAAQADNYEKIFSHMKPNSILGLSHGFLLGHLQSQGVDFPKNMSVIAVCPKGMGPSVRRLYVQGKEINGAGINASFAVHQDVDGRATDVALGWSVALGSPFTFATTLESEYKSDIFGERGILLGAVHGIVESLFRRYTENGMPEDLAYKNTVECITGIVSRTISTEGMLSVYNSLSEQGKKDFHAAYSASYYPCMDILYECYEDVASGNEIKSVVLAGRRFYEKEGLPAFPMGKIDQTRMWLVGEKVRATRPEGDLGPLYPFTAGVFVALMMAQIEVLRKKGHSYSEIINESVIEAVDSLNPFMHARGVSFMVDNCSTTARLGSRKWAPRFDYILTQQALVAVDNNAPINQDLISNFLCDPVHGAIEVCAQLRPTVDISVPVDADFVRVELRQSSN

SEQ ID NO: 3847 - protein, 586 aa, Brassica rapa
  misc_feature (309)..(309): Xaa can be any naturally occurring amino acid
  misc_feature (506)..(506): Xaa can be any naturally occurring amino acid
MAAATSSIAPPLSCPSLSSSLRSSKGTSFALPSISFVSSTSKSLRSLTATVPGNGTGSSLSARMVASSAVRAPVSLDFETSVFKKEKVSLAGYDEYIVRGGRDLFKHLPDAFKGVKQIGVIGWGSQGPAQAQNLRDSLVEAKSDIVVKIGLRKGSKSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGXRGILLGAVHGIVESLFRRYTGNGMSEDLAYKNTVECITGTISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDXCSTTARLGSRKWAPRFDYNLTQQALVAVDSGAPINKDLISNFFADPVHGAIEVCAQLRPTVDISVPEDADFVRPELRQSS

SEQ ID NO: 3848 - protein, 577 aa, Hordeum vulgare
MAAPTSSTLAPFPHPKTLAAAGGSSSISSSVAFSPAASHPACALTRRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEEDGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEESAYKSTVEGITGIISKTISKKGMLEVYNSLSAEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVTADADFVRPELRQSA

SEQ ID NO: 3849 - protein, 592 aa, Eschscholzia californica
MAAATSFSASLSSPPTCSSKTLKPVHTSLGFNLGFLSSSSKTLKPLLARVSTNNDNVSVSGSSLASRMMVSVPAIKPLTTLDFETSVFKKEKVTLAGNDEYIVKGGRDLFHLLPEAFKGIKQIGVIGWGSQGPAQAQNLRDSLVEAKSDIVVKIGLRKGSRSFAEARAAGFTEENGTLGEIYETVAGSDLVLLLISDAAQADNYEKIFSHMKPNSVLGLSHGFLLGHLQSMATDFPKNISVIAVCPKGMGPSVRRLYVQGKEINGAGINASFAVHQDVDGRATEVALGWSVALGSPFTFATTLEQEYKSDIFGERGILLGAVHGIVESLFRRYTENGMAEDLAYKNTVESITGIISRTISTEGMLAVYNSLSEQGKKDFQTAYSASYYPCMEILYECYEDVASGNEIRSVVLAGRRFYEKEGLPAFPMGNIDQTRMWKVGERVRSTRPEGDLGPLYPFTAGVFVALMMAQIEVLRRKGHSYSEIINESVIESVDSLNPFMHARGVSFMVDNCSTTARLGSRKWAPRFDYILTQQALVAVDNNTPINQDLISNFLSDPIHGAIEVCAQLRPTVDISVPANADFVRPELRQSSN

SEQ ID NO: 3850 - protein, 581 aa, Allium cepa
MAAAINTHSSSSIISLSTNRSLAKPLSTYNLAFSCVPRTLARHIRSNGGRSSVGACMVQSAPLVGQYPELDFDTSVFKKEKITLSGHDEYIVRGGRDLFHLLPDAFKGIKQIGVIGWGSQGPAQAQNLRDSLVEARSDIVVKIGLRKGSRSFEEARAVGFTEESGTLGEIWETVSTSDLVLLLISDAAQADNYEKVFSHMKPNSILGLSHGFLLGHLQSLGLDFPKNISVVAVCPKGMGPSVRRLYVQGKEVNGAGINASFAVHQDVDGRATDVALGWSVALGSPFTFATTLEQEYKSDIFGERGILLGAVHGIVESLFRRYTENGMSEELAYKNTVECITGTMSKTISTKGMLSVYNSLSEEGKKEFNAAYSSSYYPCMDILYECYEDVASGSEIRSVVLAGRRFQEKEGLPAFPMGKIDQTRMWKVGEKVRAVRPKGDLGPLHPFTAGVFVALMMAQIEVLRKKGHSYSEIINESVIEAVDSLNPFMHARGVSFMVDNCSTTARLGSRKWAPRFDYILMQQAYVAVDNASPVNQDLISSFLSDPVHGAIEVCARLRPSVDISVPVDADFVRPELRQALN

SEQ ID NO: 3851 - protein, 580 aa, Secale cereale
MAAPTSSAASTLAPFSHPKTLAAAAGSAISSSSVAFSPAASHPACALARRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPINQDLISNFMSDPVHGAIEVCAELRPTVDISVTADADFVRPELRQSA

SEQ ID NO: 3852 - protein, 579 aa, Saccharum officinarum
MAAATSSTTYLAIARKTLNPAPSVGTAAASVSFPATQPPCLLAASADRRGPVAAKVSSPSVIGTAMPSLDFETSVFKKEEVSLAGHEEYIVRGGRNLFPLLPEAFKGIKQIGVIGWGSQGPAQAQNLRDSLVEAKADVVVKIGLRKGSKSFDEARAAGFTEESGTLGDIWETVSSSDLVLLLISDSAQADNYEKIFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGMVEALFRRYTEQGMDEDSAYKNTVESITGIISKTISKKGMLEVYNSLTEEGKKQFIEAYSAAYYPCMDILYECYEDVSSGSEIRSVVLAGRRFYEKEGLPAFPMGNIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTVDKKAPINQDLISNFMSDPVHGAIEVCAQLRPTVDISVTADADFVRPELRQSS

SEQ ID NO: 3853 - protein, 124 aa, Flaveria ramosissima
MAAAAPTFSSAAPTTHSPPSSSSPTLKTASQTLGFATTFLSSKTSFKSLQTRLLSSNRGSGSALGARMVAAPVISKSPVSLDFDTSVFRKEKVNLAGHEEFIVREVEICFICCLMHLKGLSRLA

SEQ ID NO: 3854 - protein, 562 aa, Elaeis guineensis
GLGFSSSSSRSLRLLLSRMHMDAAAAGRGGAAALGARMVSVPSISKPAPSLDFETSVFKKEKITLAGQNEYIVRGGRDLFHLLPDAFKGIKQIGVIGWGSQGPAQAQNLRDSLAEAQSDIVVKIGLRKGSRSFEEARAAGFTEENGTLGDIWETISGSDLVLLLISDSAQADNYEKVFSHMKPNSILGLSHGFLLGHLQSLGLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEEMAYKNTVECITGIMSKTISTKGMLSVYNSLTEEEKKEFNAAYSASYYPCMDILYECYEDVACGSEICSVVLAGRRFYEKEGLPAFPMGKIDQTRMWKVGERVRAARPEGDLGPLHPFTAGVYVALMMAQIEVLRKKGHSYSEIINESVIESVDSLNPFMHARGVSFMVDNCSTTARLGSRKWAPRFDYILTQQALVAVDKNAPINQDLLSNFFSDPVHGAIEVCAELRPTVDISVPPDADFVRPELRQTGN

SEQ ID NO: 3855 - protein, 594 aa, Eutrema halophilum
MAAATSSIAPSLSCPSPSSSSKTLRSSKARALALPNIGFLSSASKSLRSLTATFAGNGIGSATGSSLSARMVASSAVRTPVSLDFETSVFQKEKVSLAGYEEYIVRGGRDLFKHLPDAFKGIKQIGVIGWGSQGPAQAQNLRDSLVEAKSDIVVKIGLRKGSRSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYRSDIFGERGILLGAVHGIVESLFRRYTENGMSEELAYKNTVECITGTISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDNGAAINRDLISNFFSDPVHGAIEVCAQLRPTVDISVPEDADFVRPELRQSSN

SEQ ID NO: 3856 - protein, 594 aa, Solanum lycopersicum
MAAAAATSFSITNSTHPSSSASSTKSLKPSLVGNLGFLSSSTPSLKPLRAQAAVSSGSSKSGGGALAARMVAAPATVKAPASFDFETSVFKKEKVTLAGNDEYIVRGGRDLFKYLPDAFKGIKQIGVIGWGSQGPAQAQNLRDSLAEIKSDIVVKIGLRKGSSSFAEARTAGFTEENGTLGDIYETISGSDLVLLLISDAAQADNYEKVFSHMKPNSILGLSHGFLLGHLQSMGLDFPKNISVIAVCPKGMGPSVRRLYVQGKEVNGAGINSSFAVHQDIDGRATDVALGWSVALGSPFTFATTLEQEYKSDIFGERGILLGAVHGVVESLFRRYTENGMNEELAYKNTVECITGVISKTISTKGMLAVYDSLTEEGKKEFEAAYSASFYPCMEILYECYEDVATGSEIRSVVLAGRRFYEKEGLPAFPMGKIDQTRMWKVGERVRATRPAGDLGPLYPFTAGVFVALMMAQIEVLRKKGHSYSEIINESVIESVDSLNPFMHARGVSFMVDNCSTTARLGSRKWAPRFDYNLTQQALVAVDNNTPINRDLISNFLADPVHGAIKVCAELRPTVDISVTADADFVRPELRQSVN

SEQ ID NO: 3857 - protein, 578 aa, Triticum aestivum
MAAPTSSAASTLAPFSHPKTLAAAAAAASSSVAFSPAASHPACALTRRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCIDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPINQDLISNFMSDPVHGAIEVCAELRPTVDISVTADADFVRPELRQSS

SEQ ID NO: 3858 - protein, 581 aa, Setaria italica
MAAATSSTTYLAITRKTLNPAASGAPGAAAASVSFPTAQAPCPLAASAGRRRAMTAKVSSPSVVGTAMPSLDFETSVFKKEKVSLAGHEEYIVRGGRDLFPLLPTAFKGIKQIGVIGWGSQGPAQAQNLRDSLVEAKSDIVVKIGLRKGSKSFEEARAAGFTEESGTLGDIWETVSGSDLVLLLISDSAQADNYGKIFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYRSDIFGERGILLGAVHGMVEALFRRYTEQGMDEDSAYKNTVESITGIISKTISKKGMLEVYNSLTEEGKKQFLEAYSAAYYPCMDILYECYEDVSSGSEIRSVVLAGRRFYEKEGLPAFPMGKIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTIDKKAPINQDLISNFMSDPVHGAIEVCAQLRPTVDISVTADADFVRPELRQSS

SEQ ID NO: 3859 - protein, 583 aa, Leymus cinereus x Leymus triticoides
  misc_feature (51)..(51): Xaa can be any naturally occurring amino acid
MAAPTSSTLAFSHTKTLAAAAVAGPKALPAGSVAFPAASHPACALAASPSXRRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARAAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVTADADFVRPELRQSA

SEQ ID NO: 3860 - protein, 583 aa, Triticum aestivum
MAAPTSSAASTLAPFAHPKTLAAAAAAASSISSVAFSPAASHPACALSASTRRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPINQDLISNFMSDPVHGAIEVCAELRPTVDISVTADADFVRPELRQSS

SEQ ID NO: 3861 - protein, 235 aa, Papaver somniferum
MAAATSFSTSVAAPSKTLKPVHSSSSLGFKLGFLSSSSKTLKPLLLRVSNNNVSSSAVGSAVASTMSVSAPTKPLTTLDFETSVFNKEKVTLAGNDEYIVKGGRDLFHLLPEAFKGIKQIGVIGWGSQGPAQAQNLRDSLVEAKSDIVVKIGLRKGSASFAEARSVGFTEETGTLGDIYETVAGSDLVLLLISDAAQADNYEKIFSHMKPNSILGLSHGFLLGHLQSQGLISPKI

SEQ ID NO: 3862 - protein, 587 aa, Musa acuminata
MSAAAFTPSAASVPLSKSLKPAAPKTLGFGSSLSAFKCLRRLLPRLDMDAAAGNGTALAARMVSSVPSIGRSAPSLDFETSVFKKEKVTLAGHDEYIVRGGRDLFPLLPDAFKGINQIGVIGWGSQGPAQAQNLRDSLAATKSDIVVKIGLRKGSSSFDEARAAGFTEENGTLGDIWETISGSDLLLLLISDAAQADNYEKVLSHMKPNSILGLSHGFLLGYLQSVGLDFPKDISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEELAYKNTVECITGIISKTISTKGMLAVYNALSEEGKKEFNAAYSASYYPCMDILYECYEDVACGSEIRSVVLAGRRFYEKDGLPAFPMGKIDQTRMWKVGEQVRAVRPEGDLGPLHPFTAGVYVALMMAQIEVLRKKGHSYSEIINESVIESVDSLNPFMHARGVSFMVDNCSTTARLGSRKWAPRFDYILTQQAFVTVDKESPLNQDLISNFLSDPVHGAIEVCAQLRPTVDISVPPDADFVRPELRQTSN

SEQ ID NO: 3863 - protein, 594 aa, Manihot esculenta
MAAAAATSSAIKSALSTPSLSPPSSSLNPNASRSSLGFTSSSSSTLKPLVSRVYTRQNAPSNGRSSLSVNMVSVPSITPTTSLDFDTSVFKKEKVTLAGHDEYIVRGGRDLFPLLPDAFKGIKQIGVIGWGSQGPAQAQNLRDSLAEAKSDIVVKIGLRKGSQSFAEARAAGFTEESGTLGDIWETIGGSDLVLLLISDAAQADNYEKIFSHMKPNSILGLSHGFLLGHLQSLGLDFPKNISVIAVCPKGMGPSVRRLYVQGKEINGAGINSSFAVHQDVDGRATDVALGWSVALGSPFTFATTLEQEYRSDIFGERGILLGAVHGVVECLFRRYTENGMHDDLAYKNTVECITGIISKTISTKGMLAVYNSLSEEGKKDFETAYSASFYPCMDILYECYEDVASGSEIRSVVLAGRRFYEKEGLPAFPMGKIDQTRMWKVGERVRETRPKGDLGPLYPFTAGVFVALMMAQIEVLRKKGHSYSEIINESLIEAVDSLNPFMHARGVSFMVDNCSTTARLGSRKWAPRFDYILAQQAFVAVDAGAPLNQDLISNFLSDPVHGAIEVCAQLRPTVDISVPPDADFVRPELRQSGN

SEQ ID NO: 3864 - protein, 584 aa, Artemisia annua
MAAATTAFSALTPATSSAASTASLKAAPKSLGFNVGGFTLGKRCTKSLKAGGGSALGAKMVSAPAAISRPPTLLDFETGVFNKEKINLAGYDEYIVRGGRDLFHLLPDAFKGIKQIGVIGWGSQGPAQAQNLRDSLVEAKSDIKVKIGLRKGSSSFNEARVAGFTEESGTLGDIYETIAESDLVLLLISDSAQADNYEKIFSYMKPNSILGLSHGFLLGHLQSVGSDFPKNISVVAVCPKGMGPSVRRLYVQGKEINGAGINASFAVHQDVDGRATDVALGWSVALGSPFTFATTLEQEYRSDIFGERGILLGAVHGIVESLFRRYTEDGMSEDLAYKNTVECITGNISRTISTQGMKAVYESLTEEGKKEFLTAYSASFYPCMEILYECYEDVASGSEIRSVVLAGRRFYEKEGLPAFPMGKIDQTRMWKVGERVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNGAPLNQDLISNFFEDPVHEAVKVCAELRPTVDISVPVDADFVRPELRQSN

SEQ ID NO: 3865 - protein, 588 aa, Musa acuminata
MAAAQPFTHSASLSTALKPAAPRTLGFGSSFSFAKSPSHLLRRIHTQAAPGGRVGGAALAARMVSSLPSIGGSVTSLDFESSVFKKEKVNLAGHDEYIVRGGRDLFHLLPDAFKGIRQIGVIGWGSQGPAQAQNLRDSLAAANSDIVVKIGLRKGSRSFDEARAAGFTEENGTLGDIWETVSGSDLLLLLISDAAQADNYEKVFSHMKPNSILGLSHGFLLGHLQTLGLDFPKNISVIAVCPKGMGPSVRRLYVQGKEINGAGINSSFGVHQDIDGRAADVALGWSVALGSPFTFATTLEQEYKSDIFGERGILLGAVHGIVESLFRRYTENGMSEELAYKNTVECITGIISKTISTKGMLAVYDALSEEGKKEFNAAYSASYYPCMDILYECYEDVACGSEIRSVVLAGRRFYEKEGLPAFPMGKIDQTRMWKVGEKVRAVRPEGDLGPLHPFTAGVYVALMMAQIEVLRKKGHSYSEIINESVIESVDSLNPFMHARGVSFMVDNCSTTARLGSRKWAPRFDYILTQQAFVGVDKKSPINQDLLSNFLSDPVHGAIEVCARLRPTVDISVPPDADFVRPELRQSSN

SEQ ID NO: 3866 - protein, 558 aa, Plantago ovata
IPHSLGFLSSSSPSMKSLRAAVYSSRASGSSMSAAASMVSAPSTVKAPATFDFDTSVFSKEKINLAGHDEYIVRGGRNLFKLLPDAFKGIKQIGVIGWGSQGPAQAQNLRDSLSEINSDIVVKIGLRKGSRSFAEARGAGFTEENGTLGDIYETISTSDLVLLLISDSAQADNYEKIFSHMKPNSILGLSHGFLLGHLQSMGHDFPKDISVIAVCPKGMGPSVRRLYVQGKEVNGAGINASFAVHQDVDGRATDVALGWSVALGSPFTFATTLEQEYKSDIFGERGILLGAVHGIVESLFRRYTENGMAEELAYKNTVESITGVISKTISTQGMLAVYNALSEEGKRDFEAAYSASYYPCMDILYECYEDVASGSEIRSVVLAGRRFYEKDGLPAFPMGKIDQTRMWKVGERVRATRPAGDMGPLYPFTAGVFVALMMAQIEVLRKKGHSYSEIINESVIESVDSLNPFMHARGVAFMVDNCSTTARLGSRKWAPRFDYVLTQQALVAVDSKAPINQDLISNFMSDPVHGAIDVCAQLRPTVDISVPADADFVRPELR

SEQ ID NO: 3867 - protein, 589 aa, Papaver somniferum
MAAATSFSPSVAAPSKTLKPVHSSSSLGFKLGFLCSSSKTLKPLLIRVSNNNVSSSAVGSAVASTMSVSAPTKPLTTLDFETSVFNKEKVTLAGNDEYIVRGGRDLFHLLPEAFKGIKQIGVIGWGSQGPAQAQNLRDSLVEAKSDIVVKIGLRKGSASIAEARSVGFTEETGTLGDIYETVAGSDLVLLLISDAAQADNYEKIFSHMKPTSILGLSHGFLLGHLQSQGVDFPKNMSVIAVCPKGMGPSVRRLYVQGKEINGAGINASFAVHQDVDGRATDVALGWSVALGSPFTFATTLESEYKSDIFGERGILLGAVHGIVEALFRRYTENGMAEDLAYKNTVECITGIVSRTISTEGMLSVYNSLSEQGKKDFHAAYSASYYPCMDILYECYEDVASGNEIKSVVLAGRRFYEKEGLPAFPMGKIDQTRMWLVGEKVRATRPEGDLGPLYPFTAGVFVALMMAQIEVLRKKGHSYSEIINESVIEAVDSLNPFMHARGVSFMVDNCSTTARLGSRKWAPRFDYILTQQALVAVDNNAPINQDLISNFLSDPVHGAIEVCAQLRPTVDISVPVDADFVRVELRQSSN

SEQ ID NO: 3868 - protein, 587 aa, Sorghum bicolor
MAASTLAFGHPKTLGAAAASAGAKALPTSSSVSFPATQQPACHLSSSASASAHGARRRDVAAMVYAPPAVGTAMPSLDFDTSVFNKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSDSDLVLLLISDAAQADNYEKIFSHMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRATRPEGDLGPLHAFTAGVYIALMMAQIEILRKKGHSYSEIINESVIESVDSLNPFMHARGVAFMVDNCSTTARLGSRKWAPRFDYILTQQAFVTVDKDAPINQDLISNFLSDPVHGAIEVCAELRPTVDISVTANADFVRPELRQSS

SEQ ID NO: 3869 - protein, 592 aa, Flaveria ramosissima
MAAAAPTFSSAAPTTNSPPSSSSPTLKTAPQTLGFATTFLSSKTSFKSLQTRLLSSNRGSGSALGARMVAAPVISKSPVSLDFDTSVFKKEKVNLAGHEEYIVRGGRNLFHLLPDAFKGIKQIGVIGWGSQGPAQAQNLRDSLAEAKSDIVVKIGLRKGSSSFAEARAAGFSEESGTLGDIYETISGSDLVLLLISDSAQADNYEKIFSHMKPNSILGLSHGFLLGHLQSIGLDFPKNVSVVAVCPKGMGPSVRRLYVQGKEINGAGINASFAVHQDVDGRATDVALGWSVALGSPFTFATTLEQEYKSDIFGERGILLGAVHGIVESLFRRYTEQGMTEDLAYKNTVECITGVISKTISTKGMKAVYESLSEEGKKDFLIAYSASYYPCMEILYECYEDVASGSEIRSVVLAGRRFYEKEGLPAFPMGKIDQTRMWKVGERVRATRPAGDLGPLYPFTAGVYVALMMAQIEVLRKKGHSYSEIINESLIESVDSLNPFMHARGVSFMVDNCSTTARLGSRKWAPRFDYNLTQQALVAVDNDTPVNQDLVKAFFEDPVHEAVKVCAELRPTVDISVPADADFVRPELRQSSN

SEQ ID NO: 3870 - protein, 529 aa, Solanum phureja
LAARMVAAPATVKAPASFDFETSIFKKEKVTLAGNDEYIVRGGRDLFKYLPDAFKGIKQIGVIGWGSQGPAQAQNLRDSLAEIKSDIVVKIGLRKGSSSFAEARTAGFTEESGTLGDIYETISGSDLVLLLISDAAQADNYEKVFSHMKPNSILGLSHGFLLGHLQSMDLDFPKNISVIAVCPKGMGPSVRRLYVQGKEVNGAGINSSFAVHQDIDGRATDVALGWSVALGSPFTFATTLEQEYKSDIFGERGILLGAVHGVVESLFRRYTENGMNEELAYKNTVECITGVISKTISTKGMLAVYNSLTEEGKREFEAAYSASFYPCMEILYECYEDVATGSEIRSVVLAGRRFYEKEGLPAFPMGKIDQTRMWKVGERVRATRPAGDLGPLYPFTAGVFVALMMAQIEVLRKKGHSYSEIINESVIESVDSLNPFMHARGVSFMVDNCSTTARLGSRKWAPRFDYNLTQQALVAVDNNAPINQDLISNFLADPVHGAIKVCAELRPTVDISVTADADFVRPELRQSGN

SEQ ID NO: 3871 - protein, 581 aa, Saccharum officinarum
MAASTLAFGHPKTLAAAAAGAKSLPTSSSVSFPATQQPACLLSSSASGARRRDVAAMVSAPPAVGTAMPSLDFETSVFNKEKVSLAGHEEYIVRGGRNLFPLLPEAFKGVKQIGVIGWGSQGPAQAQNLRDSLAEAKSNIVVKIGLRKGSKSFEEARAAGFTEESGTLGDIWETISGSDLVLLLISDAAQADNYEKIFSHMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRSTRPEGDLGPLHAFTAGVYIALMMAQIEILRKKGHSYSEIINESVIESVDSLNPFMHARGVAFMVDNCSTTARLGSRKWAPRFDYILTQQAFVAVDKDAPINQDLISNFLSDPVHGAIEVCAELRPTVDISVPANADFVRPELRQSS

SEQ ID NO: 3872 - protein, 583 aa, Triticum aestivum
MAAPTSSAASTLAPFSHPKTLAAATAAGGSSSVAFSPAASHPACALSVSGARRRAVAAMVAAPAKVGAAMPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIVEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDEPVNQDLISNFMSDPVHGAIEVCAELRPTVDISVTADADFVRPELRQSA

SEQ ID NO: 3873 - protein, 296 aa, Ambrosia trifida
PFFFSSNPTLKPLKARSNGSALGARMVSAPAITPKPPSFLTLITSVFKKKRLTLLVMIEYIVRGGRDLFHLLPDAFKGIKQIGVIGWGSQGPAQAQNLRDSLAEAKSDIVVKIGLRKGSSSFNEARAAGFSEESGTLGDIYETISGSDLVLLLISDSAQADNYEKIFSHMKPNSILGLSHGFLLGHLQSAGLDFPKNISVVAVCPKGMGPSVRRLYVQGKRLTEPESTLVLLFIRMLMEEPLMSHLHGQSHLVHLLRLPLLLSRSIRVIYSGSEVFCLVRCMVLWSLCLEGIPKMV

SEQ ID NO: 3874 - protein, 523 aa, Flaveria ramosissima
MVSAPAISKPPMLLDFETSVFKKEKINLAGHDEYIVRGGRDLFHLLPEAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSVGLDFPKNISVVAVCPKGMGPSVRRLYVQGKEVNGAGINASFAVHQDVDGRATDVALAWSVALGSPFTFATTLEQEYRSDIFGERGILLGAVHGIVESLFRRYTEGGMSEDLAYKNTVECITGIISKIISTQGMKAVYESLTEEGKKEFLTAYSASYYPCMDILYECYEDVATGSEIRSVVLAGRRFYEKEGLPAFPMGKIDQTRMWKVGERVRAARPAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNQDLISNFFEDPVHEAVKVCAELRPTVDISVPADAVFCQTRVASS

SEQ ID NO: 3875 - protein, 581 aa, Pennisetum glaucum
MAAATSSTTYLAIARKTLNPAASGAPGTAAASVSFPTAQAPCPLAASAGRRRAVAAKVSSPSVLSTAMPSLDFETSVFKKEKVSLAGHEEYIVRGGRDLFPLLPEAFKGIKQIGVIGWGSQGPAQAQNLRDSLVEAKSDIVVKIGLRKGSKSFEEARAAGFTEESGTLGDIWETVSGSDLVLLLISDSAQADNYEEIFSHMKPNSILGLSHGFLLGHLQSLGLDFPKNISVIAVCPKGMGPSVRRLYVQGKEINGAGINASFAVHQDVDGRATNVALGWSVALGSPFTFVTTLEQEYRSDIFGERGILLGAVHGMVEALFRRYTEHGMDEDSAYKNTVESITGIISKTISKKGMLEVYNSLTEEGKKQFLEAYSAAYYPCMDILYECYEDVSSGSEIRSVVLAGRRFYEKEGLPAFPMGKIDQTRMWKVGERVRSTRPQGDLGPLHPFTAGVYVALMMAQIEVLRKKGHSYSEIINESLIESVDSLNPFMHARGVAFMVDNCSTTARLGSRKWAPRFDYILTQQAFVTIDKKAPINQDLVSNFMSDPVHGAIEVCAQLRPTVDISVTADADFVRPELRQSS

SEQ ID NO: 3876 - protein, 523 aa, Carpinus betulus
VSVPAIKPLTSLDFDTKLFKKEKVNFAGHDEYIVRGGRDLFPLLPDAFKGIKQIGVIGWGSQGPAQAQNLRDSLAEVKSDIVVKIGLRKGSRSFAEARAAGFTEENGTLGDIWETVSGSDLVLLLISDSAQADNYEKIFSHMKPKSILGLSHGFLLGHLQSTGLDFPKDISVIAVCPKGMGPSVRRLYVQGKEINGAGINSSFAVHQDVDGRATDVALGWSVGLGSPFTFATTLEQEYKSDIFGERGILLGAVHGIVEALFRRYTENGMSEDLAYKNTVECITGIISKTISTKGMLAVYNSFSEEDKRVFQTAYSASYYPCMDILYECYEDVASGSEIRSVVLAGRRFYEKDGLPAFPMGKIDQTRMWKVGERVRSTRPAGDLGPLYPFTAGVYVALMMAQIEILRKKGHSYSEIINESVIESVDSLNPFMHARGVSFMVDNCSTTARLGSRKWAPRFDYILTQQALVAVDKGAPINQDLISNFQSDPVHGAIEACAQLRPTVDISVPPDADFVRPELRQSSN

SEQ ID NO: 3877 - protein, 478 aa, Allium cepa
  misc_feature (471)..(471): Xaa can be any naturally occurring amino acid
PVLQKMAAAINTHSSSSIISLSTNRSLAKPLSTYNLAFSCVPRTLARHIRSNGGRSSVGACMVQSAPLVGQYPELDFDTSVFKKEKITLSGHDEYIVRGGRDLFHLLPDAFKGIKQIGVIGWGSQGPAQAQNLRDSLVEARSDIVVKIGLRKGSRSFEEARAVGFTEESGTLGEIWETVSTSDLVLLLISDAAQADNYEKVFSHMKPNSILGLSHGFLLGHLQSLGLDFPKNISVVAVCPKGMGPSVRRLYVQGKEVNGAGINASFAVHQDVDGRATDVALGWSVALGSPFTFATTLEQEYKSDIFGERGILLGAVHGIVESLFRRYTENGMSEELAYKNTVECITGTMSKTISTKGMLSVYNSLSEEGKKEFNAAYSSSYYPCMDILYECYEDVASGSEIRSVVLAGRRFQEKEGLPAFPMGKIDQTRMWKVGEKVRAVRPKGDLGPLHPFTAGVFVALMMAQIEFCERXVIHTQRS

SEQ ID NO: 3878 - protein, 532 aa, Manihot esculenta
MAAATAFSGTLSSHTPSLISLDFDSSVFKKEKISLAGHDEYIVRGGRDLFYLLPDAFKGIKQIGVIGWGSQGPAQAQNLRDSLTDAKSDIVVKIGLRKGSHSFAEARAAGFTEENGTLGDIWETISGSDLVMLLISDSAQADNYEKIFSHMKPNSILGLSHGFLLGHLQSMGLDFPKNISVVAVCPKGMGPSVRRLYVQGKEVNGAGINSSFAVHQDVDGRATDIALGWSVALGSPFTFATTLEQEYKSDIFGERGILLGAVHGIVESLFRRYTENGMSEEEAYKNTVECITGIISKTISTKGMLAVYNSLSEEGKKEFEIAYGASYYPCMDILYECYEDVACGNEIRSVVLAGRRIYEKDGLPAFPMGKIDQTRMWKVGERVRSVRQAGDLGPLYPFTAGVYVALMMAQIEILRKKGHSYSEIINESVIESVDSLNPFMHARGVSFMVDNCSTTARLGSRKWAPRFDYILTQQALVAVDNDSPVNRDLISNFLSDPVHGAIEVCAQLRPTVDISVPPDADFVRPELRQSTN

SEQ ID NO: 3879 - protein, 544 aa, Elaeis guineensis
MHMDAAAAGRGGAAALGARMVSVPSISKPAPSLDFETSVFKKEKITLAGQNEYIVRGGRDLFHLLPDAFKGIKQIGVIGWGSQGPAQAQNLRDSLAEAQSDIVVKIGLRKGSRSFEEARAAGFTEENGTLGDIWETISGSDLVLLLISDSAQADNYEKVFSHMKPNSILGLSHGFLLGHLQSLGLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEEMAYKNTVECITGIMSKTISTKGMLSVYNSLTEEEKKEFNAAYSASYYPCMDILYECYEDVACGSEICSVVLAGRRFYEKEGLPAFPMGKIDQTRMWKVGERVRAARPEGDLGPLHPFTAGVYVALMMAQIEVLRKKGHSYSEIINESVIESVDSLNPFMHARGVSFMVDNCSTTARLGSRKWAPRFDYILTQQALVAVDKNAPINQDLLSNFFSDPVHGAIEVCAELRPTVDISVPPDADFVRPELRQTGN

SEQ ID NO: 3880 - protein, 594 aa, Ricinus communis
MAAASSVATTAKSALSTPSLSPSSSLKHNPSRSTLGFISTSSPTLKSLVSRVHTKQNVPLNQRSSSLSVKMVSSPSIAPTTSLDFDTSVFKKEKITLAGHDEYIVRGGRDLFPLLPDAFKGIKQIGVIGWGSQGPAQAQNLRDSLADAKSDIVVKIGLRKGSRSFAEARAAGFTEENGTLGDIWETIAGSDLVLLLISDAAQADNNEKIFSHMKPNSILGLSHGFLLGHLQSLGLDFPKNISVIAVCPKGMGPSVRRLYVQGKEINGAGINSSFAVHQDVDGRATDVALGWSVALGSPFTFATTLEQEYRSDIFGERGILLGAVHGVVECLFRRYTESGMSEDLAYKNTVECITGIVSKTISTKGMLAVYNALSEEGKRDFETAYSASYYPCMDILYECYEDVASGSEIRSVVLAGRRFYEKEGLPAFPMGKIDQTRMWKVGERVRAVRPNGDLGPLYPFTAGVFVALMMAQIEVLRKKGHSYSEIINESLIEAVDSLNPFMHARGVSFMVDNCSTTARLGSRKWAPRFDYILTQQAFVAVDAGTSINQDLISNFMSDPVHGAIEVCAQLRPTVDISVPPDADFVRPELRQSGN

SEQ ID NO: 3881 - protein, 557 aa, Cirsium arvense
VGFLSSQPSSKSLRARAFPSSNGASGSALGARMVSVSPITKSPTFLDFETSVFKKEKINLAGYDEYIVRGGRDLFHLLPDAFKGIKQIGVIGWGSQGPAQAQNLRDSLVEAKSDIVVKIGLRKGSSSFNEARAAGFSEENGTLGDIYETISGSDLVLLLISDSAQADNYEKIFSHMKPNSILGLSHGFLLGHLQSVGLDFPKNISVVAVCPKGMGPSVRRLYVQGKEINGAGINASFGVHQDVDGRATDVALGWSVALGSPFTFATTLEQEYKSDIFGERGILLGAVHGIVESLFRRYTEGGMSEDLAYKNTVECITGTISRTISTQGMKAVYESLTEEGKKEFLTAYSASYYPCMDILYECYEDVASGSEIRSVVLAGRRFYEKEGLPAFPMGKIDQTRMWKVGERVRASRPAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNQDLISNFFEDPVHEAVKVCAELRPTVDISVPADADFVRPELRQASK

SEQ ID NO: 3882 - protein, 579 aa, Avena sativa
MAAATSSASSLAFSHPKTLNPAPQTPAVGSVSFPAAKTPCHLAASAGRRGAVAAKVASPSVISTTMPSLDFDTSVFKKEKVSLAGHEEFIVRGGRNLFPLLPEAFKGIKQIGVLGWGSQGPAQAQNLRDSLAEANLDIVVKIGLRKGSKSFQEARAAGFTEETGTLGDIWETVSSSDLLLLLISDSAQADNYEKIFSHMKPNSILGLSHGFLLGHLQSVGLDFPKNISVIAVCPKGMGPSVRRLYVQGKEINGAGINSSFAVHQDVDGRATDVALGWSIALGSPFTFATTLEQEYRSDIFGERGILLGAVHGIVEALFRRYTEQGMDEDLAYKNTVECITGIVSKTISKKGMLEVYNSLTEEGKKQFNEAYSAAYYPSMDILYECYEDVSSGSEIRSVVLAGRRFYEKEGLPAFPMGNIDQTRMWKVGERVRSTRPQGDLGPLHPFTSGVFVAMMMAQIEVLRKKGHSYSEIINESVIESVDSLNPFMHARGVAFMVDNCSTTARLGSRKWAPRFDYVLTQQAFVTVDKKAPINQDLISNFMSDPVHGAIEVCAELRPTVDISVTADADFVRPELRHSS

SEQ ID NO: 3883 - protein, 524 aa, Flaveria ramosissima
MVSAPSITRPTLLDFETSVFKKEKINLAGHDEYIVRGGRDLFHLLPDAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALGWSVALGSPFTFATTLEQEYRSDIFGERGILLGAVHGIVESLFRRYTEGGMSEELAYKNTVECITGIISKTISTQGMKAVYESLSEEGKKEFLTAYSASYYPCMDILYECYEDVASGSEIRSVVLAGRRFYEKEGLPAFPMGKIDQTRMWKVGEQVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNGAPLNQDLISNFFEDPVHEAVKVCAELRPTVDISVPADADFVRPELRQSSN

SEQ ID NO: 3884 - protein, 587 aa, Artemisia annua
MAAAAPTSITITPTTTATSSTSSNKTPIKKVAFSTPFTSSVKSLQAARVVTRGSCALGASMVAAPVVSSGTEPVLLDFETSVFKKEKVNLAGHDEYIVRGGRDLFHLLPEAFKGIKQIGVIGWGSQGPAQAQNLRDSLAEAKSDIVVKIGLRKGSASFAEARAAGFTEENGTLGDIYPTIAGSDLVLLLISDSAQADNYEKIFSHMKPNSILGLSHGFLLGHLQSIGLDFPKNISVVAVCPKGMGPSVRRLYVQGKEVNGAGINASFGVHQDVDGRATDVALGWSVALGSPFTFATTLEQEYKSDIFGERGILLGAVHGIVESLFRRYTEHGMSEELAYKNTVECITGVISKTISTKGMKAVYESLSEEGKKDFLTAYSASYYPCMEILYECYEDVASGSEIRSVVLAGRRFYEKEGLPAFPMGKIDQTRMWKVGERVRASRPAGDLGPLYPFTAGVYVALMMAQIEVLRQKGHSYSEIINESLIESVDSLNPFMHARGVSFMVDNCSTTARLGSRKWAPRFDYNLTQQALVDVDNGAPINQDLVKKFFEDPVHEAVRVCAELRPTVDISVPADADFVRPELRQSSN

SEQ ID NO: 3885 - protein, 553 aa, Elaeis guineensis
KSGRLLLSRIHLDATVGGRGGAAALGARMVSVPSVSKSAPSLDFETSVFKKEKINLAGQDEYIVRGGRDLFHLLPDAFRGIKQIGVIGWGSQGPAQAQNLRDSLAVAQSDIVVKIGLRKGSRSFEEARAAGFTEENGTLGDIWETISGSDLVLLLISDSAQADNYEKVFSHMKPNSILGLSHGFLLGHLQSLGLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTESGMSEELAYKNTVECITGIISRTISTKGMLSVYSSLTEEGKKEFSAAYSASYYPCMDILYECYEDVACGSEIRSVVLAGRRFYEKEGLPAFPMGKIDQTRMWKVGERVRATRPEGNLGPLHPFTAGVYVALMMAQIEVLRKKGHSYSEIINESVIESVDSLNPFMHARGVSFMVDNCSTTARLGSRKWAPRFDYILTQQAFVAVDKNTPINQDLLSNFLSDPVHGAIEVCAELRPTVDISVPPDADFVRPELRQTST

SEQ ID NO: 3886 - protein, 565 aa, Gossypium raimondii
LPSLAVTYFTLSLKALILVSSRPFSDPLSPLIPTPLTTHNCCGSAMASQTYISLDFHTCVFKKEKVSLAGHHEYIVRGGRDLFTLLPDAFKGIKQIGVIGWGSQGPAQAQNLRDSLADAKSNIIVKVGLRKGSPSFAEARAAGFSEENGTLGDMWETISGSDLVLLLISDAAQADNHEKIFSHMKPNSILGLSHGFLLGHLQSMGLDFPKNISVIAVCPKGMGPSVRRLYVQGKEINGAGINSSFGVHQDFDGRATDVALGWSVALGSPFTFVTTLEQEYKSDIFGERGILLGAVHGIVECLFRRYTENGMSEDLAYKNTVECITGIISKTISTKGILAVYNSLSEEGKREFEIAYSASYHPCMDILYECYEDVASGSEIRSVVLAAQRFYEKDGLPAFPMGKIDQTRMWKVGERVRKARPSGDLGPLYPFTAGVYVALMMAQIEILRKKGHSYSEIINESVIEAVDSLNPFMHARGVSFMVDNCSTTARLGSRKWAPRFDYILTQQALVAVDNGTPINQDLLSNFLSDPVHGAIEVCAQMRPTVDISVHPDADFVRPELRQSGN

SEQ ID NO: 3887 - protein, 63 aa, Elaeis guineensis
AALGARMVSVPSISKPAPSLDFETSALRRRRSPSLVKMSILLEVGGIYSICCQMPSRGSSKLA

SEQ ID NO: 3888 - protein, 520 aa, Gossypium hirsutum
MASQTHISLDFHTCVFKKEKVSLAGHHEYIVRGGRDLFTLLPDAFKGIKQIGVIGWGSQGPAQAQNLRDSLADAKSNIIVKVGLRKGSPSFAEARAAGFSEENGTLGDMWETISGSDLVLLLISDAAQADNHEKIFSHMKPNSILGLSHGFLLGHLQSMGLDFPKNVSVIAVCPKGMGPSVRRLYVQGKEINGAGINSSFGVHQDFDGRATDVALGWSVALGSPFTFVTTLEQEYKSDIFGERGILLGAVHGIVESLFRRYTENGMSEDLAYKNTVECITGIISKTISTKGILAVYNSLSEEGKREFEIAYSASYHPCMDILYECYEDVASGSEIRSVVLAAQRFYEKDGLPAFPMGKIDQTRMWKVGERVRKARPSGDLGPLYPFTAGVYVALMMAQIEILRKKGHSYSEIINESVIEAVDSLNPFMHARGVSFMVDNCSTTARLGSRKWAPRFDYILTQQALVAVDNGTPINQDLLSNFLSDPVHGAIEVCAQMRPTVDISVHPDADFVRPELRQSGN

SEQ ID NO: 3889 - protein, 587 aa, Amborella trichopoda
MAAASLSPVVATSSSSSNGVKTPKLSSRLGLGFLSSSSSSISRSWRQLVLSPSASGKGAIGARMVSMPAVKPEKALDFDTKVFKKEKITLTGHDEYIVRGGRDLFHLLPEAFKGIKQIGVIGWGSQGPAQAQNLRDSLAEAQSNIIVKVGLRKGSRSFAEARAAGFTEESGTLGDIWETVSTSDLLLVLISDAAQADTYEKIFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYKSDIFGERGILLGAVHGIVESLFRRYTEFGMNEELAYKNTVESITGIISKTISTKGMLSIYNSLSAEGKKEFETAYSASYYPCMDILYECYEDVACGSEIRSVVLAGRRFYEKDGLPAFPMGKIDQTRMWKVGERVRSARPAGDLGALYPFTAGVYVALMMAQIEVLRKKGHSYSEIINESVIEAVDSLNPFMHARGVSFMVDNCSTTARLGARKWAPRFDYILTQQTFVAADKETPINQDLISNFLSDPVHGAIDACAQLRPTVDISVTADADFVRPELRQSGN

SEQ ID NO: 3890 - protein, 590 aa, Unknown
  Sequence found in Organisms: Solanum tuberosum, Solanum phureja
MATPAATSFSISSSSSAVSSSTKSLKPALSSNLGFFSTSSPSLKALRAKSHSYNVSSSGGALNVRMVAAPAAVKAPMSLDFETSVFKKEKVTLSGHDEYIVKGGRDLFKLLPDAFKGIKQIGVIGWGSQGPAQAQNLRDSLAEAKSDIVVKIGLRKGSRSFAEARAAGFTEENGTLGDLYETISGSDLVLLLISDAAQADNYEEVFSHMKPNSILGLSHGFLLGHLQSLDLDFPKNISVIAVCPKGMGPSVRRLYVQGKEINGAGINASFAVHQDIDGRATDVALGWSVALGSPFTFATTLEQEYRSDIFGERGILLGAVHGIVESLFRRYTENGMSEELAYKNTVECITGNISRTISTKGMLALYNSLDAEGKKVFATAYSASYYPCMEILYECYEDVAAGSEIRSVVLAGRRFSEKEGLPAFPMGKIDQTRMWKVGERVRATRPSGDLGPLYPFTAGVYVALMMAQIEVLRKKGHSYSEIINESVIESVDSLNPFMHARGVSFMVDNCSTTARLGSRKWAPRFDYNLTQQALVAVDNNLPINMDLMTNFVCDPVHEAIEVCAQLRPTVDISVPADADFVRPELRQTVN

SEQ ID NO: 3891 - protein, 592 aa, Musa acuminata
MAATAVATISLATSSTPPASRAKIQKPAPGTLVLGSSAASLSSSSISLRHVVPAGRGGGRGAAFGARMVSMPSVEKPPPSLDFETSVFKKEKITLAGHDEYIVKGGRDLFYLLPDAFKGIKQIGVIGWGSQGPAQAQNLRDSLVVAKSDIVVKIGLRKGSRSFDEARAAGFTEENGTLGDIWETVAGSDLLLLLISDAAQADNYEKVFSHMKPNSILGLSHGFLLGHLQSLGLDFPKNISVIAVCPKGMGPSVRRLYVQGKEINGAGINSSFAVHQDVDGRAVDVALGWSVALGSPFTFATTLEQEYKSDIFGERGILLGAVHGIVEALFRRYTENGMSEELAYKNTVECITGIISKTISTKGMLSVYSALTEEGKKEFNAAYSASYYPCMDILYECYEDVACGSEICSVVLAGRRFQEKEGLPAFPMGKIDQTRMWKVGERVRATRPAGDLGPLHPFTAGVYVALMMAQIEILRKKGHSYSEIINESVIESVDSLNPFMHARGVSFMVDNCSTTARLGSRKWAPRFDYILTQQAFVSVDKNRSINQDLISNYLYDPVHDAIGVCAQLRPTVDISVPPDADFVRPELRQSSN

SEQ ID NO: 3892 - protein, 592 aa, Valeriana officinalis
MAATSFAPSSFAAASSSSSSASKTLGLNAGFLGSTSLKTASNPLRAPVLSIHAGGSGSASSSVARMVSMPAIKPPTLLDFDTSVFKKEKVTLAGYDEYIVKGGRDLFPLLPDAFKGIKQIGVIGWGSQGPAQAQNLRDSLEEAKSNIVVKIGLRKGSSSCSEARAAGFTEENGTLGDMYETISSSDLVLLLISDAAQADNYEEVLSHMKPNSILGLSHGFLLGHLQSIGKDFPKNISVVAVCPKGMGPSVRRLYVQGKEVNGAGINASFAVHQDVDGRATDVALGWSVALGSPFTFATTLEQEYKSDIFGERGILLGAVHGIVESLFRRYTENGMSEELAYKNTVECITGNISKTISAKGMLAVYNSLSEDGKKEFEAAYSASFYPCMDILYECYEDVASGSEIRSVILAGRRFYEKEGLPAFPMGKIDKTRMWKVGEQVRKTRPAGDLGPLNPFTAGVYVALMMAQIEVLRKKGHSYSEIINESLIESVDSLNPFMHARGVSFMVDNCSTTARLGSRKWAPRFDYILTQQALVAVDQGSPVNQDLIGNFMSDPVHSAIEVCAQLRPSVDISVPQDGQDADFVRPELRQSSN

SEQ ID NO: 3893 - protein, 517 aa, Theobroma cacao
MNPPASLDFHTSVFNKEKVSLAGHHEYIVKGGRNLFKLLPDAFKGIKQIGVIGWGSQGPAQAQNLRDSLAEAKSDIVVKVGLRKGSHSFAEARAAGFTEDNGTLGEIWETISGSDLVLLLISDAAQADNCEKIFSHMKPKSILGLSHGFLLGHLQSMGLDFPKNISVIAVCPKGMGPSVRRLYVQGKEINGAGINSSFAVHQDVDGRATDVALGWSVALGSPFTFATTLEQEYKSDIFGERGILLGAVHGIVEALFRRYTENGMSEDLAYKNTVECITGIISKTISTQGMLAVYNSFSEEGRKEFETAYSTSYYPCMDILYECYEDVACGNEIRSVVLAGRRFYEKDGLPAFPMGKIDQTRMWKVGEQVWRARLAGDLGPLYPFTAGVYLALMMAQIEILRKKGHSYSEIINESVIESVDSLNPFMHARGVSFMVDNCSTTARLGSRKWAPRFDYILTQQALVAVDNGTPIDQDLISNFLSDPVHGAIEVCAQLRPTVDISVPPDADFVRPELRQSS

SEQ ID NO: 3894 - protein, 579 aa, Brachypodium distachyon
MAAATSSASSLAFSHPKTLNPASKTPAVGSVSFPAAQTPCILASSAGRCRAVVAKVASPSVIGATMPSLDFETSVFKKEKVSLAGHDEYIVRGGRNLFPLLPEAFKGIKQIGVLGWGSQGPAQAQNLRDSLAEAKSDIVVKIGLRKGSKSFQDARAAGFTEENGTLGDIWETVSSSDLLLLLISDAAQADNYEKIFSHMKPNSILGLSHGFLLGHLQSVGLDFPQNISVIAVCPKGMGPSVRRLYVQGKEVNGAGINSSFAVHQDVDGRATDVALGWSIALGSPFTFATTLEQEYRSDIFGERGILLGAVHGIVEALFRRYTEQGMDEVLAYKNTVECITGIVSKTISKKGMLEVYNSFTEEGKKQFKEAYSAAFYPSMDILYECYEDVSSGSEIRSVVLAGRRFYEKEGLPAFPMGNIDQTRMWKVGERVRATRPQGDLGPLHPFTAGVFVALMMAQIEVLRKKGHSYSEIINESVIESVDSLNPFMHARGVAFMVDNCSTTARLGSRKWAPRFDYVLTQQAFVTVDKNAPINQDLISNFLSDPVHGAIEICAQLRPTVDISVTADADFVRPELRQSS

SEQ ID NO: 3895 - protein, 525 aa, Flaveria ramosissima
MVSAPALSKPPMLLDFETSVFKKEKINLAGHDEYIVRGGRDLFHLLPEAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSVGLDFPKNISVVAVCPKGMGPSVRRLYVQGKEVNGAGINASFAVHQDVDGRATDVALAWSVALGSPFTFATTLEQEYRSDIFGERGILLGAVHGIVESLFRRYTEGGMSEDLAYKNTVECITGIISKIISTQGMKAVYESLTEEGKKEFLTAYSASYYPCMDILYECYEDVATGSEIRSVVLAGRRFYEKEGLPAFPMGKIDQTRMWKVGERVRAARPAGDLGPLYPFTAGVYVALMMAQIEVLRKKGHSYSEIINESLIESVDSLNPFMHARGVSFMVDNCSTTARLGSRKWAPRFDYILTQQALVAVDNGAPLNQDLISNFFEDPVHEAVKVCAELRPTVDISVPADADFVRPELRQASN

SEQ ID NO: 3896 - protein, 574 aa, Silene vulgaris
YLTTPSPIVKASLKSTLKPSSLNLGFLSPAAFSVKSPSIKNGAGSSLSAHMMVSVPAIDKPSIALDFNTSVFTKEKINLAGHDEYIVRGGRDLFHLLPEAFKGIKKIGVIGWGSQAPAQAQNLKESLAEAKSDIVVKIGLRKGSRSFAEARAAGFTEESGTLGEMWETIAESDLVMLLISDSAQADNYEKVFSHMKPNSILGLSHGFLLGHLQSIGQDFPKHISVVAVCPKGMGPSVRRLYVQGKEINGAGINSSFAVHQDVDGRAADVALGWSVALGSPFSFATTLEQEYKSDIFGERGILLGAVHGLVECLFRRFTENGMSEEDAYKNTVECVTGVISKTISTKGMLALYNSLSEDGKKEFEAAYSASYYPCMEILYECYEDVASGSEIRSVVLAGRRFQEKEGLPAFPMGKIDQTRMWKVGERVRAVRPAGDLGPLNPFTAGVYVALMMSQIEILRKKGHSYSEIINESLIEAVDSLNPFMHARGVSFMVDNCSTTARLGSRKWAPRFDYILNQQALVAVDNNAPINQDLISNFFSDPVHEAIGVCAELRPSVDISVTADADFVRPELRQA

SEQ ID NO: 3897 - protein, 591 aa, Solanum lycopersicum
MATPATTSFAISTSSSSAVSSSSKSLKRALSSNLGFLSTSSLSLKALRAKSYSYNVSSSGGPLSVRMVAAPAAVKAPMSLDFETSVFKKEKVTLSGHDEYIVKGGRDLFKLLPDAFKGIKQIGVIGWGSQGPAQAQNLRDSLAEANSDIVVKIGLRKGSRSFAEARAAGFTEENGTLGDLYETISGSDLVLLLISDAAQADNYEEVFSHMKPNSILGLSHGFLLGHLQSLDLDFPKNISVIAVCPKGMGPSVRRLYVQGKEINGAGINASFAVHQDIDGRATDVALGWSVALGSPFTFATTLEQEYRSDIFGERGILLGAVHGIVESLFRRYTENGMSEELAYKNTVECITGNISRTISTKGMLALYNSLDAEGKKVFATAYSASYYPCMEILYECYEDVATGSEIRSVVLAGRRFSEKEGLPAFPMGKIDQTRMWKVGERVRATRPSGDLGPLYPFTAGVYVALMMAQIEVLRKKGHSYSEIINESVIESVDSLNPFMHARGVSFMVDNCSTTARLGSRKWAPRFDYNLTQQALVAVDNNLPINMALMTDFVCDPVHEAIEVCARLRPTVDISVPADADFVRPELRQTVN

SEQ ID NO: 3898 - protein, 371 aa, Ambrosia trifida
TPFKSLKAQAFSSGSALGARMVASPTITKSPVSLDFDTSVFKKEKVNLAGHEEYIVRGGRDLFHLLPDAFKGIKQIGVIGWGSQGPAQAQNLKDSLAEAKSDIVVKIGLRKGSSSFAEARAAGFSEENGTLGDIYETISGSDLVLLLISDSAQADNYEKIFSHMKPNSILGLSHGFLLGHLQSSGLDFPKNVSVVAVCPKGMGPSVRRLYVQGKEINGAGINASFAVHQDVDGRATDVALGWSVALGSPFTFATTLEQEYKSDIFGERGILLGAVHGIVEALFRRYTEQGMAEDLAYKNTVECITGVISKTISTKGMKAVYESLSEERLKKIYLTAYSASYHPCMEILYECYEDVASGSEIRSVVWPAAAL

SEQ ID NO: 3899 - protein, 543 aa, Flaveria ramosissima
RRFPLSKPSAKSLKARSNGGCGSAIGARMVSAPAISKPPMLLDFETSVFKKEKINLAGHDEYIVRGGRDLFHLLPEAFKGVKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSVGLDFPKNISVVAVCPKGMGPSVRRLYVQGKEVNGAGINASFAVHQDVDGRATDVALAWSVALGSPFTFATTLEQEYRSDIFGERGILLGAVHGIVESLFRRYTEGGMSEDLAYKNTVECITGIISKIISTQGMKAVYESLTEEGKKEFLTAYSASYYPCMDILYECYEDVATGSEIRSVVLAGRRFYEKEGLPAFPMGKIDQTRMWKVGERVRAARPAGDLGPLYPFTAGVYVALMMAQIEVLRKKGHSYSEIINESLIESVDSLNPFMHARGVSFMVDNCSTTARLGSRKWAPRFDYILTQQALVAVDNGTPLNQDLISNFFEDPVHEAVKVCAELRPTVDISVPADAVF

SEQ ID NO: 3900 - protein, 591 aa, Gossypium hirsutum
SFLLLLRCGYYLLSSFSTPSLNSSSRTHKTLTTPNLGFLASVSRSLRSLKATRLTTDNACGSAMASRMVSIPAVQTHISLDFETSVFKKEKVSLAGQDEYIVRGGRDLFKLLPDAFKGIKQIGVIGWGSQGPPQAQNLRDSLADAKSDIIVKVGLRKGSRSFDEARAAGFSEENGTLGDIWETISGSDLVLLLISDAAQADNYEKIFSYMKPNSILGLSHGFLVGHLQSKGLDFPKNISVIAVCPKGMGPSVRRLYVQGREINGAGINSSFGVHQDVDGRATDVALGWSVALGSPFTFATTLEQEYKSDIFGERGILLGAVHGIVECLFRRYTENGMSEDLAYKNTVECITGIISKTISTKGMLAVYNSLSEEGKREFETAYSASYYPCMDILYECYEDVASGSEIRSVVLAGQRFYEKDGLPAFPMGKIDQTRMWKVGERVRKARPSGDLGPLYPFTAGVYVALMMAQIEILRKKGHSYSEIINESVIEAVDSLNPFMHARGVSFMVDNCSTTARLGSRKWAPRFDYILTQQALVTVDNGTPINQDLLSNFLSDPVHGAIEVCAQMRPTVDISVHPDADFVRPELRQSGN

SEQ ID NO: 3901 - protein, 452 aa, Beta vulgaris
MAATAATSFSLSSSSSSVPVPKLLKPSALNLGFLGSSSSNTALNSLKVRAFPSRATNNGGSALSTQMVSAPSSINPPSSATFDFESSIFNKEKITLSGHDEYIVRGGRNLFPLLPDAFKGVKQIGVIGWGSQAPAQAQNLKDSLTEAKSDIVVKIGLRKGSRSFAEARAAGFSEENGTLGEMWETISESDLVLLLISDSAQADNYEKVFSHMKPNSILGLSHGFLLGHLQSLGQDFPKNISVIAVCPKGMGPSVRRLYVQGKEINGAGINSSFAVHQDVDGRATNVALAWSVALGSPFTFATTLEQEYKSDIFGERGILLGAVHGIVECLFRRYTDNGMSEDLAYKNTVECITGVISKTISTKGMLSLYNSLSEEGKKNSKLLTVPHFTLAWTFCTSAMKMLLVGVRSEVLFWLDGAFMRRKGSQLFQWVISIKPACGELVRRSEQLDLQAT

SEQ ID NO: 3902 - protein, 587 aa, Gossypium hirsutum
MAATTTTTSFKAALLSTPSISSSTKSTVLKPRFTSSSSSRYSPIPKSLIAHHVSTKTNAIVAKMGTVPSPVSETTSLDFHTSVFQKEKISLAGHEEYIVRGGRHLFPLLDDAFKGIKQIGVIGWGSQGPAQAQNLRDSLAEAKSDVVVKIGLRKGSRSFAEARAAGFTEENGTLGDIWETVAGSDLVLLLISDSAQADNYEKVFSHMKPNSILGLSHGFLLGHLQSLGLDFPKNISVIAVCPKGMGPSVRRLYVQGKEINGAGINASFAVHQDVDGRATDVALGWSVALGSPFTFATTLEQEYKSDIFGERGILLGAVHGVVECLFRRYVEDGMSEELAYKNTVECITGIVSKTISTKGMLAVYNSLSEEGKKRFEAAYSASYYPCMEILYECYEDVASGSEIRSVVLAGRRFYEKEGLPAFPMGKIDQTRMWKVGERVRATRAKDDLGPLCPFTSGVFVALMMAQIEVLRKKGHSYSEIINESLIEAVDSLNPFMHARGVSFMVDNCSTTARLGSRKWAPRFDYNLTQQAFVAVDSGAPINQDLISNFLSDPVHEAIEVCAKLRPTVDISVPPDADFVRPELRQSS

SEQ ID NO: 3903 - protein, 525 aa, Ambrosia trifida
MVSAPAITKPPTLLDFDTSVFKKEKINLAGHDEYIVRGGRDLFHLLPDAFKGIKQIGVIGWGSQGPAQAQNLRDSLAEAKSDIVVKIGLRKGSSSFNEARAAGFSEESGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALAWSVALGSPFTFATTLEQEYKSDIFGERGILLGAVHGIVESLFRRYTEDGMSEELAYKNTVECITGTISRIISTQGMKAVYESLDEDGKKEFLTAYSASYYPCMDILYECYEDVATGSEIRSVVLAGRRFYEKEGLPAFPMGKIDQTRMWKVGERVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNKAPLNQDLISNFFEDPVRDAVKVCAELRPTVDISVPADADFVRPELRQGSN

SEQ ID NO: 3904 - protein, 525 aa, Ambrosia trifida
MVSAPAISKPPTLLDFDTSVFKKEKINLAGHDEYIVRGGRDLFHLLPDAFKGIKQIGVIGWGSQGPAQAQNLRDSLAEAKSDIVVKIGLRKGSSSFNEARAAGFSEESGTLGDIYETISGSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALAWSVALGSPFTFATTLEQEYKSDIFGERGILLGAVHGIVESLFRRYTEDGMSEELAYKNTVECITGIISKIISTKGMKAVYESLDEEGKKEFLTAYSASYYPCMDILYECYEDVATGSEIRSVVLAGRRFYEKEGLPAFPMGKIDQTRMWKVGEQVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNKAPVNQDLISNFFEDPVHDAVKVCAELRPTVDISVPADADFVRPELRQGSN

SEQ ID NO: 3905 - protein, 583 aa, Flaveria ramosissima
MAAAAPTFSSAAPTTVSPSSSSSPTLKTAPQTLGFTTAFLSSKTSFKSLQTRLLTSHGGSGSALGARMVAVPVISKSPASLDFDTSVFKKEKVNLAGHEEYIVRGGRDLFHLLPDAFKGIKQIGVIGWGSQGPAQAQNLRDSLAEAKSDIVVKIGLRKGSSSFAEARAAGFSEENGTLGDIYETISGSDLVLLLISDSAQADNYEKIFSHMKPNSILGLSHGFLLGHLQSIGLDFPKNVSVVAVCPKGMGPSVRRLYVQGKEINGAGINASFAVHQDVDGRATDVALGWSVALGSPFTFATTLEQEYKSDIFGERGILLGAVHGIVESLFRRYTEQGMTEDLAYKNTVECITGVISKTISSKGMKAVYESLSEEGKKDFLIAYSASYYPCMEILYECYEDVASGSEIRSVVLAGRRFYEKEGLPAFPMGKIDQTRMWKVGERVRATRPDGDLGPLYPFTAGVYVALMMAQIEVLRKKGHSYSEIINESLIESVDSLNPFMHARGVSFMVDNCSTTARLGSRKWAPRFDYNLTQQALVAVDNGTPVNQDLVKAFFEDPVHEAVKACAELRPTVDISGACRCCIL

SEQ ID NO: 3906 - protein, 525 aa, Lactuca sativa
MVSAPAITKPPTLLDFETSVFNKEKINLAGYDEYIVRGGRDLFHLLPDAFKGIKQIGVIGWGSQGPAQAQNLRDSLVEAKSDIVVKIGLRKGSSSFNEARGAGFSEENGTLGDIYETISGSDLVLLLISDSAQADNYEKIFSHMKPNSILGLSHGFLLGHLQSAGLDFPKNISVVAVCPKGMGPSVRRLYVQGKEINGAGINASFAVHQDVDGRATDVALAWSVALGSPFTFATTLEQEYKSDIFGERGILLGAVHGIVESLFRRYTEGGMSEDLAYKNTVECITGNISKTISTQGMKAVYESLTEEGKKEFLTAYSASYYPCMDILYECYEDVASGSEIRSVVLAGRRFYEKEGLPAFPMGKIDQTRMWKVGERVRASRPAGDLGPLYPFTAGVYVALMMAQIEVLRKKGHSYSEIINESLIESVDSLNPFMHARGVSFMVDNCSTTARLGSRKWAPRFDYILTQQALVAVDNGSPLNQDLISNFFEDPVHEAVKVCAELRPTIDISVPVDADFVRPELRQASN

SEQ ID NO: 3907 - protein, 514 aa, Pennisetum glaucum
MPSLDFETSVFNKEKVSLAGHEEYIVRGGRNLFPLLPEAFKGVKQIGVIGWGSQGPAQAQNLRDSLAEAKSDIVVKIGLRKGSKSFEEARAAGFTEESGTLGDIWETVSGSDLVLLLISDAAQADNYEKIFSYMKPNSILGLSHGFLLGHLQSLGLDFPKNISVIAVCPKGMGPSVRRLYVQGKEVNGAGINSSFAVHQDVDGRATDVALAWSVALGSPFTFATTLEQEYKSDIFGERGILLGAVHGIVEALFRRYTEQGMDEESAYKNTVEGITGIISKTISKKGMLEVYNSLSEEGKKEFNKAYSASFYPCMDILYECYEDVASGSEIRSVVLAGRRFYEKEGLPAFPMGNIDQTRMWKVGEKVRSTRPEGDLGPLHPFTAGVYIALMMAQIEILRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVPANADFVRPELRQSS

SEQ ID NO: 3908 - protein, 523 aa, Brassica napus
MVASSAVRAPVSLDFETSVFKKEKVSLAGYDEYIVRGGRDLFKHLPDAFKGIKQIGVIGWGSQGPAQAQNLRDSLVEAKSDIVVKIGLRKGSKSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNYLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDSGAPINKDLISNFFADPVHGAIEVCAQLRPTVDISVPEDADFVRPELRQSS

SEQ ID NO: 3909 - protein, 524 aa, Chelidonium majus
MVSVPAVKPLTTLDFETSVFNKEKVTLAGHDEYIVKGGRDLFHLLPDAFKGIKQIGVIGWGSQGPAQAQNLRDSLVEAKSDIVVKIGLRKGSRSFAEARAAGFTEETGTLGDIYETISGSDLVLLLISDAAQADNYEKIFSHMKPNSILGLSHGFLLGHLQSLGIDFPKNISVIAVCPKGMGPSVRRLYVQGKEINGAGINASFAVHQDVDGRATDVALGWSVALGSPFSFATTLEQEYKSDIFGERGILLGAVHGVVESLFRRYTENGMNEDLAYKNTVECITGITSKTISTEGMLAVYNSLSEEGKKDFQTAYSASYYPCMEILYECYEDVACGSEIRSVVLAGRRFYEKEGLPAFPMGKIDQTRMWRVGERVRSTRQAGDLGLMYPFTAGVYVALMMAQIEVLRKKGHSYSEIINESVIESVDSLNPFMHARGVSFMVDNCSTTARLGSRKWAPRFDYILTQQALVAVDNNSPINQDLISNFLSDPIHGAIEVCAQLRPTVDISVPANADFVRPELRQSSN

SEQ ID NO: 3910 - protein, 526 aa, Momordica charantia
WCPCLRLSPLTFVFRYFDASVFKKEKVNLAGHDEYIVRGGRDLFPLLPEAFKGIKQIGVIGWGSQGPAQAQNLRDSLAEAKSDIVVKIGLRKGSRSFAEARAAGFSEENGTLGDIYETVSGSDLVLLLISDSAQADNYEKIFSHMKPNSILGLSHGFLLGHLQSLGLDFPKNFSVIAVCPKGMGPSVRRLYVQGKEINGAGINSSFAVHQDVDGRATDVALGWSVALGSPFTFATSLEQEYKSDIFGERGILLGAVHGIVESLFRRYTENGMAEELAYKNTVESITGIISKTISTKGMLAVYNSFSPDEKKEFEKAYSASYYPCMDILYECYEDVASGSEIRSVVLAGRRFYEKEGLPAFPMGKIDQTRMWKVGERVRQVRPAGDLGPLHPFTAGVYVALMMAQIEILRKKGHSYSEIINESVIESVDSLNPFMHARGVSFMVDNCSTTARLGSRKWAPRFDYIVTQQALVAIDNGSAVNQDLISNFLSDPVHGAIETCAQLRPTVDISVPPDADFVRPELRQSGN

SEQ ID NO: 3911 - protein, 525 aa, Fagopyrum esculentum
MVSVSPSVKSATILDFETSAFQREKVSLAGHDEYIVRGGRHLYPLLPEAFKGIKQIGVIGWGSQGPAQAQNLRDSLAEIKSDIVVKIGLRKGSSSFAEARAAGFTEETGSLGEMWETISSSDLVMLLISDAAQADCYEKVFSHMKPNSILGLSHGFLLGHLQSIGQDFPKNISVVAVCPKGMGPSVRRLYVQGKEINGAGINASFGVHQDVDGRATDVALGWSVALGSPFTFATTLEQEYKSDIFGERGILLGAVHGIVESLFRRYTENGMDEDLAYKNTVESITGTISKTISTQGMLAVYNALSEQGKKEFEAAYSAAFYPCMDILYECYEDVASGSEIRSVVLAGRRFYEKEGLPAFPMGKIDQTRMWKVGERVRSTRPAGDLGPLYPFTAGVFVACMMAQIEVLRKKGHSYSEIINESVIESVDSLNPFMHARGVSFMVDNCSTTARLGSRKWAPRFDYILTQQALVAVDKNAPVNRDLISNFLSDPVHGAIEVCAQLRPTVDISVTADADFVRPELRQSGN

SEQ ID NO: 3912 - protein, 467 aa, Flaveria ramosissima
MVSAPSITRPTLLDFETSVFKKEKINLAGHDEYIVRGGRDLFHLLPDAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALGWSVALGSPFTFATTLEQEYRSDIFGERGILLGAVHGIVESLFRRYTEGGMSEELAYKNTVECITGIISKTISTQGMKAVYESLSEEGKKEFLTAYSASYYPCMDILYECYEDVASGSEIRSVVLAGRRFYEKEGLPAFPMGKIDQTRMWKVGERVRAVRPAGDLGPLYPFTAGVYVALMMAQIEVLRKKGHSYSEIINESLIESVDSLNPFMHARGVSFMVDNCSTTARLGSRNGRHALITFLPNRL

SEQ ID NO: 3913 - protein, 512 aa, Brassica juncea
SLDFETSVFKKEKVSLAGYDEYIVRGGRDLFKHLPDAFKGIKQIGVIGWGSQGPAQAQNLRDSLVEAKSDIVVKIGLRKGSRSFEEARAVGFTEESGTLGDIWETISGSDLVLLLISDAAQADNYEKIFSHMKPNSILGLSHGFLLGHLQSMGLDFPKNISVVAVCPKGMGPSVRRLYVQGKEINGAGINASFAVHQDVDGRAADVALGWSVALGSPFTFATTLEQEYKSDIFGERGILLGAVHGIVESLFRRYTENGMSEDLAYKNTVECITGTISRTISTQGMLAVYNSLSEEGKKDFETAYSASFYPCMEILYECYEDVAAGSEIRSVVLAGRRFYDKEGLPAFPMGKIDQTRMWKVGERVRKSRPAGDLGPLYPFTAGVYVALMMAQIEILRKKGHSYSEIINESVIESVDSLNPFMHARGVSFMVDNCSTTARLGSRKWAPRFDYNLTQQALVAVDSGAPINKDLISNFFADPVHGAIEVCAQLRPTVDISVPEDADFVRPELRQSS

SEQ ID NO: 3914 - protein, 593 aa, Tropaeolum majus
MAAASFTHSPISQLTSSSSCRTKLSGIKPGFVVTSPSSSSSYSPSLNHLKLRIPSADSSSLGRSSISAKMVAAPAVGGLTKTFDFETSVFKKEKVTLAGQEEYIVRGGRDLFHLLPDAFKGIKQIGVIGWGSQGPAQAQNLRDSLVEAKSDIVVKIGLRKGSSSFAEARSAGFSEENGTLGDIYETISGSDLVMLLISDAAQADNYEKIFSHMKPNSILGLSHGFLLGHLQSLGLDFPKNISVIAVCPKGMGPSVRRLYVQGKEVNGAGINASFGVHQDVDGRATDVALGWSVALGSPFTFATTLEQEYKSDIFGERGILLGAVHGVVECLFRRYVDQGMAEDEAYKNTVECITGNVSKTISTKGMLALYNSLSEDDKKIFQAAYSASYYPCMDILYECYEDVASGSEIRSVVLAGRRFYEKEGLPSFPMGKIDQTKMWKVGQRVRSTRPAGDLGPLHPLTAGVFVALMMAQIELLRKKGHSYSEIINESVIEAVDSLNPFMHARGVSFMVDNCSTTARLGARKWAPRFDYVLNQQAMVALDDGTPVNQDLVSNFLSDPVHGAIEVCAQLRPTVDISVPADADFVRPELRQSS

SEQ ID NO: 3915 - protein, 571 aa, Amorphophallus konjac
RAFKPSSGAQGFRLGFLPSLSMAAPRLLVSRSPSDAVAARGGSALGARMVSAPSIQKTSLDFETSVFRKEKISLAGHDEYIVKGGRDLLHLLPDAFKGIKQIGVIGWGSQGPAQAQNLRDSLAEAKSDIVVKIGLRKGSRSFTEARAAGFSEENGTLGDIWETVSGSDLLLLLISDAAQADNYEKIFSLMKPNSILGLSHGFLLGHLQSLGLDFPKNISVIAVCPKGMGPSVRRLYIQGKEVNGAGINSSFAVHQDVNGRATDVALGWSIALGSPFTFATTLEQEYKSDIFGERGILLGAVHGIVEALFRRYTENGMSEEVAYKNTVECITGIISKTISTKGMLSVYDSLSVDGKKDFQAAYSASYYPCMDILYECYEDVACGNEIQSVVLAGRRFYEKDGLPAFPMGKIDQTRMWKVGERVRAARPPGDLGPLHPFTAGVYVALMMAQIEVLRKRGHSYSEIINESVIEAVDSLNPFMHARGVSFMVDNCSTTARLGSRKWAPRFDYILTQQAFVTVDKGLPINQDLLSNFLSDPVHGAMEVCAQLRPSVDISVPPDADFVRPELRGTSS

SEQ ID NO: 3916 - protein, 156 aa, Fagopyrum esculentum
AKTLRPLILRSMPRNNAAGGGSARMMLVPSVKPATTLDFETSVFQKEKVSLAGHDEYIVRGGRHLFPLLPDAFKGIKQIGVIGWGSQGPAQAQNLRDSLTEIKSDIVVKVGLRKGSRSFVDARAAGFTEESGTLGDMWETISTSDLVMLLISDAAS

SEQ ID NO: 3917 - protein, 514 aa, Pseudoroegneria spicata
  misc_feature (249)..(249): Xaa can be any naturally occurring amino acid
MPSLDFDTAVFNKEKVSLAGHEEYIVRGGRNLFPLLPEAFKGVKQIGVIGWGSQGPAQAQNLRDSLVEAKSDIVVKIGLRKGSKSFEEARGAGFTEENGTLGDIWETVSGSDLVLLLISDSAQADNYEKIFSHMKPNSILGLSHGFLLGHLQSHGLDFPKNISVVAVCPKGMGPSVRRLYVQGKEVNGAGINASFAVHQDVDGRATDVALGWSVALGSPFTFATTLEQEYKSDIFGERGILLGAVHGIXEALFRRYTEQGMDEELAYKSTVEGITGIISKTISKKGMLEVYNSLSEEGKKEFNKAYSASFYPCMDILYECYEDVASGSEIRSVVLAGRRFYDKEGLPAFPMGKIDQTRMWKVGEKVRSTRPDGDLGPLHPFTAGVYVALMMAQIEVLRKKGHSYSEIINESVIESVDSLNPFMHARGVAFMVDNCSTTARLGSRKWAPRFDYILTQQAFVTVDKDAPINQDLISNFMSDPVHGAIEVCAELRPTVDISVTADADFVRPELRQSA

SEQ ID NO: 3918 - protein, 337 aa, Vitis vinifera
MAATTSFTPGVSAPAPLSSSPPCKAFSKTLGFKLGSSPSSSTTLKPLISRAPANGRPSLSVRMVSLPSVLPTTSLDFETSVFKKEKIALAGHDEYIVRGGRDLFHLLPDAFKGIKQIGVIGRGSQGPAQVQNLRDSLAEAKSDIVVKIGLRKGSRSLAEARAAGFTEENGTLGDIWETIAGSNLVLLLISDSAQADNYEKVFSHMKPNSMLGLSHDFLLGHLQSLGLDFPENISVITVCPKGMGPSVRRLYVQGKEVNGAGIDSSFAVHQDVDGRATDVALGWSVALGSPFTFATTLEYEYQSDIFGERGILLGAVHGVVESLFRRYTENGMNEDLA

SEQ ID NO: 3919 - protein, 130 aa, Humulus lupulus
LDFDTSVFKKEKINLAGHDEYIVRGGRNLFHLLPHAFKGIKQIGVIGWGSQGPAQAQNLRDSLAEAKSDIVVKIGLRKGSRSFAEARAAGFTEESGTLGDIYETISSSDLVMLLISDSAQADNFEKFSHT

SEQ ID NO: 3920 - protein, 564 aa, Flaveria ramosissima
MATATATTTFSTLTPATSSSTAAPSLKVAPKTLVFNVGLLSSKPTFKSLRARSNGGSGSALGARMVSAPAITRPTLLDFETSVFKKEKINLAGHDEYIVRGGRDLFHLLPDAFKGIKQIGVIGWGSQGPAQAQNLRDSLAEAKSDIVVKIGLRKGSSSFNEARAAGFTEETGTLGDIYETISGSDLVLLLISDSAQADNYEKIFSHMKPNSILGLSHGFLLGHLQSAGLDFPKNISVVAVCPKGMGPSVRRLYVQGKEVNGAGINASFAVHQDVDGRATDVALGWSVALGSPFTFATTLEQEYRSDIFGERGILLGAVHGIVESLFRRYTEGGMSEELAYKNTVECITGIISKTISTQGMKAVYESLSEEGKKEFLTAYSASYYPCMDILYECYEDVASGSEIRSVVLAGRRFYEKEGLPAFPMGKIDQTQMWKVGERVRAVRPAGDLGPLYPFTAGVYVALMMAQIEVLRKKGHSYSEIINESLIESVDSLNPFMHARGVSFMVDNCSTTARLGSRKWAPRFDYILTQQALVAVDNGAPLNQDLISNFFEDPVHEAVKVCAEL

SEQ ID NO: 3921 - protein, 287 aa, Trigonella foenum-graecum
MASDSNATNTLQAIRYNRGSLQLLDQTKLPLESVYLEIRNSNDGWNAIRDMVVRGAPAIAIAAALSLAVEVSNLDDFNGSTDDAVYFLQKKLDYLVSSRPTAVNLSDAATKLKEIISKAAATTSEAKGVFQAYLEAAEIMLEDDVASNRAIGTFGASFIQNQTEKLKLSVLTHCNTGSLATAGYGTALGVIRALNSGGVLERAYCTETRPFNQGSRLTAYELVHDKIPATLIADSAAAALMQAGRVDAVVVGADRVASNGDTANKIGTYSVALCAKFHNVPFLWLHH

SEQ ID NO: 3922 - protein, 372 aa, Cicer arietinum
MASDSNATNMLQAIRYNRGSLQLLDQTKLPLESVYLEIRDSNDGWNAIRDMVVRGAPAIAIAAALALAVEVSNLDDFSGSTDDAAYFLHKKLEYLVTSRPTAVNLSDAATKLKEIISMAAATTSEARGVFQAYVEAAEIMLEDDVASNKAIGIYGASFIQNHTEKHKLSVLTHCNTGSLATAGYGTALGVIRALHSGGVLERAYCTETRPFNQGSRLTAYELVHDKIPATLIADSAAAALMQAGRVDAVVVGADRVASNGDTANKIGTYSVALCAKFHNVPFYVAAPLTSIDLSLSSGKQIVIEERSPKELLNTRGGLGEQVAASGISVWNPAFDVTPANLISGIITEKGVITKTSAGDASFDIKTFVQKTS

SEQ ID NO: 3923 - protein, 374 aa, Cajanus cajan
MACESNQVSATNTLQSICYNRGSLQLLDQRKLPLETLYLDIRDSTDGWNAIRDMVVRGAPAIAIAAALSLAVEVFNLDDFNGSAGDAVSFLQKKLEYLVSSRPTAVNLSDAVTKLKEVISNAAATTSEGKSVFQAYVDAAEVMLEDDVASNKAIGSYGASFIQQLTKKQKLSVLTHCNTGSLATAGYGTALGVIRALHSGGVLERAFCTETRPFNQGSRLTAFELVHEKIPATLIADSAAAALMKAGRVDAVVVGADRVASNGDTANKIGTYSVALCAKFHNVPFYVAAPLTSIDLSLSSGQEIVIEERSPKELLNTHGGLGEQIAASGISVWNPAFDVTPANLISGIITEKGVITKTSAGDAFDIKAFVQKTG

SEQ ID NO: 3924 - protein, 375 aa, Lotus japonicus
MASSGSNELTGTNTLQSIRYNRGSLQLLDQRKLPLETIYLEIRDSTDGWNAIRDMVVRGAPAIAIAAALALAVEVSNLGDFSGSPSDAASFLQNKLEYLVSSRPTAVNLSDAATKLKEVISGAAATASEAKSVFQDYIEAAEIMLVDDVASNRAIGSYGATFIQHQVEKPKLSVLTHCNTGSLATAGYGTALGVIRALHSGGALERAYCTETRPFNQGSRLTAFELVHDKIPAALIADSAAAALMKSGRVDAVVVGADRVASNGDTANKIGTYSVALCAKFHNVPFYVAAPLTSIDLSLSSGEEIVIEERSPKELLNSRGGLGEQVAASGISVWNPAFDVTPANIISGIITEKGVITKSSAADAFDIKAFIQKTL

SEQ ID NO: 3925 - protein, 371 aa, Vigna unguiculata
MAREFNDVAATLQSIRYNRGSLQLLDQRKLPLETTYLEIRDSTDGWNAIRDMVVRGAPAIAIAAALSLAVEVFNLDGFNGSAGEAVSFLQNKLEYLVSSRPTAVNLSDAAGKLKEVVSTAAATTSEGRTVFQAFIEAAEVMLEDDVASNRAIGSYGASCIQQQTEKKKLSVLTHCNTGSLATAGYGTALGVIRALHSAKVLERAYCTETRPFNQGSRLTAYELVHEKIPATLIADSAAAALMKAGSVDAVVVGADRVASNGDTANKIGTYSVALSAKFHNVPFYVAAPLTSIDLSLSSGQEIVIEERSPKELLNARGGLGEQVAASGISVWNPAFDVTPANLISGIITEKGVITKTSDDAFDIKAFVQKTG

SEQ ID NO: 3926 - protein, 259 aa, Glycine max
MAFESNEVAATTLQAICYKRGSLQLLDQRKLPLETVYLEIRDSTDGWNAIREMVVRGAPAIAIAAALSLAVEVFNLDFNGSATDAVSLLQKKLEYLVTSRPTAVNLSDAATKLKEVISNAAATTSEGRSVFQVYIDAAEVMLEDDVASNRAIGSYGASIIQQQTEKQKLSVLTHCNTGSLATAGYGTALGVIRALHSAGVLKRAYCTETRPFNQGSRLTAFELVHEKIPGTLIADSAAAVIGRTCGCCCCWGRSGCIKW

SEQ ID NO: 3927 - protein, 373 aa, Phaseolus coccineus
MAREFNDVVAATLQSIRYTRGSLHLLDQRKLPLETTYLEIRDSTDGWNAIRDMVVRGAPAIAIAAALSLAVEVFNLDGFNGSAGEAVSFLQNKLEYLVSSRPTAVNLSDAATKLKEVVSNAAATTSEGRSVFQAFIEASEVMLEDDVASNRAIGSYGATCIQQQTEKQKLSVLTHCNTGSLATAGYGTALGVIRALHGGGVLERAYCTETRPFNQGSRLTAYELVHEKIPSTLIADSAAAALMKAGSVDAVVVGADRVASNGDTANKIGTYSVALSAKFHNVPFYVAAPLTSVDLSLSSGQEIVIEERSPKELLNARGGLGEQVAASGISVWNPAFDVTPANLISGIITEKGVITKTSAGDAFDIKAFVQKTG

SEQ ID NO: 3928 - protein, 373 aa, Unknown
  Sequence found in Organisms: Citrus sinensis, Citrus clementina, Citrus sinensis
MALDSVSTDNNSLQSICYRRGSLQLLDQRKLPLETIYLEIRDSADGWSAIREMVVRGAPAIAMAAALSLAVEVFNLNAFSGTAADAASFLGNKLEYLVSSRPTAVNLSDAAAKLKEIISKAAATASEANSVFQAYIEAAEIMLKDDVATNKAIGSYGASFLQNQLKNSKFSVLTHCNTGSLATAGYGTALGVIRALHSEGVLERAYCSETRPFNQGSRLTAFELVHDRIPATLIADSAAAALMKDGRVSAVIVGADRVAANGDTANKIGTYSLALCAKFHNILFYVAAPLTSIDLTLSSGQEIVIEERSAKELLCSRGGLGEQVAASGISVWNPAFDVTPANLITGIITEKGVVTKAGADDAFDIKDFIQKTA

SEQ ID NO: 3929 - protein, 239 aa, Trifolium pratense
  misc_feature (214)..(214): Xaa can be any naturally occurring amino acid
GFHFSVTELTILAKMEAIVKSIYLTRIPNSQTCSASLFNPPLLLQSNATSVTFNSATHHLHKCFLSQQRYGVLLSKSKEKGNMGAIYASEAASPTTTVTERWILEPIGDGDSRHIGFKVERPGAYEIASSEVTVGRVPDKADLVIPVATVSGVHARIRKKQDNLLVIDLDSTNGTYVDDIRLRPGVVTTVSSGSCITFGDTNLAMFRVSKIQGXKVVDTVGETEGELDNGDKSDSTETS

SEQ ID NO: 3930 - protein, 602 aa, Trigonella foenum-graecum
ENSEKPASFAKTLTQSDANNGGGFSVPRYCAETIFPRLDYSAEPPVQTVIAKDVHGEVWKFRHIYRGTPRRHLLTTGWSSFVNQKKLVAGDSIVFLRGENGELFVGIRRAKRGIVNGLETPSGWSSGNGSCGLGVGPYGGAFSVFLREENKVGGVGCNLGGGRVKVSGESVKEAMRLAASNQTFEVVYYPRASTPEFCVKTSAVKAAMRIQWCSGMRFKMPFETEDSSRISWFMGTISSAQVVDPIRWPNSPWRLLQVTWDEPDLLQNVKRVSPWLVELVANMSVIHLAPFSPPRKKLRFPQHPDFPLDVVQFPIPTFSGNPFNPLGCLSSSDHYNAPAAGIQGARHAQIGISLSDLHLNNNKFQLGVFPNNPAKISNVSNKTINHDNKSKESLSCLLTIGNSHKRNLEIKSDSNVKRHQFLLFGQPILTEQQISRKSSSDDVLLSKNKDKEKWFFSDTTQSSLSEQFSPAKSSTTSASADFCWQLGLDTGHCKVFLESEDVGRTLDLSCVGSYEELYRKLAKMFGIERSEMLNHVLYRDATGAVKQTGEEPFSDFMKTAKRLTILMDSDSKDTRRVSITGTRNAERGLDASNKTGPMSIFV

SEQ ID NO: 3931 - protein, 698 aa, Lotus japonicus
MKEADRSSLDPQLWHACAGGMVQMPPVNSKVFYFPQGHAEHAQCSVDFAASLRIPPLILCRVAAVKFSADPETDEVFAKMRLVPLRNSELDHEDGGDGASDGNATEGSEKPASFAKTLTQSDANNGGGFSVPRYCAETIFPRLDYSAEPPVQTVIAKDVHGEVWKFRHIYRGTPRRHLLTTGWSSFVNQKKLVAGDSVVFLRAENGDLCVGIRRAKRGIGGGAEVPSGWSSGAGAGNCGLGPYGAFSVFLREEGKLLRNGCGGGNSSPGGVGRPKVSGESVREAMALAGSNQAFEVVYYPRASTPEFCIKTSAVKAAMRIQWCSGMRFKMPFETEDSSRISWFMGTIASVQVVDPIRWPNSPWRLLQVTWDEPDLLHNVKRVSPWLVELVSNMSTIHHLTPFSPPRKKLRFPPHPDFPLDIQFPLPAFSGNPLGPSSPLCCLSDNAPAGIQGARHAQIGISLSDIHLHNKLQLGVLPTNITNHDHKSKESLSCLLTMGNSQKSLEKSDDDVKRHQFWLFGKPILTEQQISRRRASSDDDNVLLSQNCNSPKKEKWFFGDSQIQSSPEKSSTTSSGEFSWQLGLDTGHCKVFLESEDVGRTLDLSRVGSYEELYRRLANMFGMERSELLSHVLYRDSTGAVKHTGEEPFSDFMKTAKRLTILTDSAGSKDTRRVLITGTRNAERGLDASNKTGPLSIFA

SEQ ID NO: 3932 - protein, 935 aa, Cicer arietinum
MLHNKLFPKKTRGGKIIRQLREHYLRDDIYCGAPFCTVCDSSGARLSESASTILVVDTNVVLNQIDLLENPAIDDVVVLSIVLEEVKNKNLSVYNRIRAICDNSMRKFCVFSNEYHRDTYVKDMRGETKNDRNDRAIRVAAQWYQKHLGGAVKVLLITNDKENKRKASEEGICAETVESYVKSLDRPDLLDLLVRPSSEDVDMEEVEDLRPSKRKVIYSEHKPMSEITSGLHRGIYHQGKLRVNRYNPFEAYVGSESIGDEIIIYGRSNMNRAFDGDIVAVELLPQDQWKEEKSLSIAGEEDGDEDEDVHLAPNSADVAPRTIPQQCSTGEVNAGSCRPCGCIVGIIKRNWHSYCGSLEPMPMPGGSGGVAHALFVSKDRRIPKIRIQTRQLENLLDKRIIVSVDSWDRQSRYPSGHYVRTIGEIGDRDTESEVVLIENDINSRPFSSQVLACLPPLPWSVTSEDLSIPFRQDLRHLRVFSVDPPGCKDIDDALHCYALPNGNFEVGVHIADVTNFVFPGTPLDDEASQRGTSVYLVERRIDMLPKPLTEDVCSLRSDVERLAFSVIWEMTPEADIISTRYTKSVIKSAAALSYVEAQARMDDSRLMDPVTTDLRNMNSLAKKMRLRRIERGALTLASAEVKFQIDTETHDPLDIGMYQIREANQMVEEFMLAANVSVAQQILKSFPLCSLLRRHPTPTREMLEPLLRVAAAVGLNLDVSSSKALADSLDHAVGDDPYFNKLIRILATRCMSQAVYFCSGDLSPPEYQHYGLATPLYTHFTSPIRRYADVIVHRLLAASLGISKLPPVFQDRLQLTSIADNLNYRHRNAQMAGRASVELHTLIYFRKRPTDTEARIVKIRSNGFFVFVPKYGIEGPVYLTTRAEKGSGEWYVDEQEQKIKKMDGSLSYSILQTVQIHMEVVEPQPNRPKLQLTLI

SEQ ID NO: 3933 - protein, 934 aa, Cajanus cajan
MLHNKSFVKKTKGGKVMKQVREHYLRDDIYCGAPFCTVCDSSAARLSASPSTILVVDTNVVLNQIDLLENPAFDNVVVLSIVLEEVKNKNMSVYNRVRSICSNSMRKFFVFSNEYHRDTYVKEMSGETKNDRNDRAIRVATQWYQNHLGGAVKVLLITNDRENKRKACEEGIFAETVESYVKSLDRPDLLDLLVRPASEDVHMEEVEDLRPSKRKLIYSEHKPMSEITSGLHRGIYHQGKLRVNRHNPFEAYVGSESIGDEIIIYGRSNMNRAFDGDIVAVELLPQDQWQEASSLSIAGEEDEDVDEDVHLAPNSADDAPRTIPQQGSSEKVNAAPSRPSGRIVGIIKRNWHSYCGSLDPMPMPAGSGGIAHALFVSKDRRIPKIRIQTRQLENLLDKRIIVAVDSWDRQSRYPSGHYVRTIGEIGDRDTESEVVLIENDINTRPFSSQVLACLPPLPWVVSSEDLSNPIRQDLRHLRVFSVDPPGCKDIDDALHCHALPNGNFEVGVHIADVTNFVHPGTPLDDEAAQRGTSVYLVERRIDMLPKPLTEDICSLRSDVERLAFSVIWEMTPEADIISTRYTKSVIKSSAALSYVEAQARMDDSRLMDPITADLRNMNSLAKKMRLRRIERGALTLASAEVKFQIDTETHDPLDIGMYQIREANQMVEEFMLAANVSVAQQILKTFPLCSLLRRHPTPTREMLEPLLMTAAAVGLHLDVSSSKALADSLDHAVGEDPYFNKLIRILATRCMSQAVYFCSGDLSPPEYHHYGLASPLYTHFTSPIRRYADVIVHRLLAASLGISKLPSVFQDRLQLTNISDNLNYRHRNAQYAGRASVELHTLIYFRKRPTDTEARIVKIRSNGFFVFVPKYGIEGPVYLTKAEKGSGEWYVDEQQQKIKKMDGSLSYSILQTVQIHMEVVEPQPNRPKLQLTLI

SEQ ID NO: 3934 - protein, 934 aa, Glycine max
MLHNKSFVKKTKGGKVIKQVREHYLRDDIYCGAPFCTVCDSSSARLSASPSIILVVDTNVVLNQIDLLENPAIDDVVVLSIVLEEVKNKNMSVYNRIRAICSNSMRKFFVFSNEYHRDTYIKEMSGETKNDRNDRAIRVATQWYQNHLGGAVKVLLLTNDKENKRKASEEGILAETVESYVKSLDQPDLLDLLVRPASEDVDMEEVEDLRPSKRKVIYSEHKPMSEITSGLHRGIYHQGKLRVNRYNPFEAYVGSESIGDEIIIYGRSNMNRAFDGDIVAAELLPQDQWQGVSSLSIAHEEDEDEDEDVHLAPNSADDAPRTISQQGSSEQVNAVPSRPSGRIVGIIKRNWHSYCGSLEPMPMPAGSGGIAHALFVSKDRRIPKIRIQTRQLENLLDKRIIVAVDSWDRQSRYPSGHYVRTIGEIGDRDTESEVVLIENDINTRPFSSQVLACLPPLPWVVSSEDLSNPIRKDLRHLRVFSVDPPGCKDIDDALHCHVLPNGNFEVGVHIADVTNFVYPGTPLDDEAAQRGTSVYLVERRIDMLPKPLTEDICSLRSDVERLAFSVIWEMTPEADIIATSYTKSVIKSSAALSYVEAQARMDDSRLMDPITADLRNMNSLAKKMRLRRIERGALTLASAEVKFQIDTETHDPLDIGMYQIREANQMVEEFMLAANVSVAQQILKSFPLCSLLRRHPTPTREMLEPLLRTAAAVGLHLDVSSSKALADSLDHAVGDDPYFNKLIRILATRCMTQAVYFCSGDLSPPEYHHYGLAAPLYTHFTSPIRRYADVIVHRLLAASLGISKLPPVFQDSLQLTSIADNLNYRHRNAQYAGRASVELHTLIYFRKRPTDTEGRIVKIRSNGFFVFVPKYGIEGPVYLTKAEKGSGEWYVDEQQQKIKKMDGSLSYNVLQTVQIHMEVVEPQPNRPKLQLTLI

SEQ ID NO: 3935 - protein, 934 aa, Glycine max
MLHNKSFVKKTKGGKVMKQVREHYLRDDIYCGAPFCTVCDSSGARLSASPSTILVVDTNVVLNQIDLLENPAIDDVVVLSIVLEEVKNKNMSVYNRIRAICSNSMRKFFVFSNEYHRDTYIKEMSGETKNDRNDRAIRVATQWYQNHLGGAVKVLLITNDKENKRKASEEGILAETVESYVKSLVRPDLLDLLVRPASEDVDMEEVEDLRPSKRKVIYSEHKPMSEITSGLHRGIYHQGKLRVNRYNPFEAYVGSESIGDEIVIYGRSIMNRAFDGDIVAAELLPQDQWQGVSSLSIAHEEDEDENEDVHLAPNSADDAPRAVSQQGSSEQLNAVPSRPCGRIVGIIKRNWHSYCGSLEPMPMPAGNGGIAHALFVSKDRRTPKIRIQTRQLENLLDKRIIVAVDSWDRQSRYPSGHYVRTIGKIDDRDTETEVVLIENDINTRPFSSQVLACLPPLPWVVSSEDLSNPIRKDLCHLCVFSVDPPGCKDIDDALHCHSLPNGNFEVGVHIADVTNFVHPGTPLDDEAAQRGTSVYLVERRIDMLPKPLTEDICSLRSDVERLAFSVIWEMTPEADIISTRYTKSVIKSSAALSYVEAQARMDDSRLMDPITADLRNMNSLAKKMRLRRIERGALTLASAEVKFQIDTETHDPLDIGMYQIREANQMVEEFMLAANVSVAQQILNSFPLVSLLRRHPTPTREMLEPLLQTAAAVGLHLDVSSSKALADSLDHAVGDDPYFNKLIRILATRCMTQAVYFCSGDLSPPEYHHYGLAAPLYTHFTSPIRRYADVIVHRLLAASLGISKLPSVFQDRLQLTSIADNLNYRHRNAQYAGRASVELHTLIYFRKRPTDTEARIVKIRSNGFFVFVPKYGIEGPVYLTKAEKGSGEWYVDDQQQKIKKMDGSLSYSVLQTVQIHMEVVEPQPNRPKLQLTLI

SEQ ID NO: 3936 - protein, 935 aa, Phaseolus coccineus
MLHNKSFVKKTRAGKVMKQVREHYLRDDIYCGAPFCTVCDTSGARLNASPSTTILVVDTNVVLNQIDLLENQAFDNIVVLSIVLEEVKNKNMAVYNRIRALCSNSTKKFYVFSNEYHRDTYVKEMSGETKNDRNDRAIRVATQWYQNHLGGAVKVLLITNDRENKRKASEEGIFAETVESYVKSLDQPDLLDLLVRPASEDVNMEEVEDLRPSKRKVIYSEHKPMSEITSGLHRGIYHQGKLRVNRYNPFEAYVGRESIGDEIVIYGRSNMNRAFDGDVVAVELLPQDQWQEVSSLSIAGEEDENEDEDVHLAPNSADVAPRTIPQQGSSGQVNAVPNRPSGRIVGIIKRNWHSYCGSLEPMPMPAGSGGIAHALFVSKDRRIPKLRIQTRQLENLLDKRIIVAVDSWDRQSRYPSGHYVRTIGEIGDRDTESEVVLIENDINTRPFSSQVLACLPPLPWLVSSEDLSNPIRQDLRHLLVFSVDPPGCKDIDDALHCHALPNGNFEVGVHIADVTNFVHPGTPLDDEASQRGTSVYLVERRIDMLPKPLTEDICSLRSDVERLAFSVIWEMTPEADIISTRYTKSVIKSSAALSYVEAQARMDDSRLRDPITTDLRNMNSLAKKMRLRRIERGALTLASAEVKFQIDTETHDPLDIGMYQIREANQMVEEFMLAANVSVAEQILKSFSLCSLLRRHPTPTREMLEPLLQTAAAVGLHLDVSSSKALADSLDHAVGDDPYFNKLIRILATRCMSQAVYFCSGDLSPPEYHHYGLAAPLYTHFTSPIRRYADVIVHRLLAASLGISKLPSVFQDRLQLSSIADNLNYRHRNAQYAGRASVELHTLIYFRKRPTDTEARIVKIRSNGFFVFVPKYGIEGPIYLTKSGKGNGEWYVDEQQQKIKRMDGSLSYSVLQTVQIHMEVVEPQPNRPKLQLTLI

SEQ ID NO: 3937 - protein, 934 aa, Quercus alba
MLHSKTFVKKTRGGKVNKQVREHYLRDDIYCGAPICKLCDSSAARLSPSASTILVLGTNVVLNQIDLLENPAIDDVVMLSVVLDEVKNKNMGVYNRVRALCSNSLRRFFVFANEHHKDTFVKEMAKESKNDRNDRAIRVAAQWYQSHLGGAARVLLITNDKENKRKAIAEGISAETIESYVKSLDRPDLLDLVVQPSSEDVEMEEVEDLRPSKRKVIYTEHKPMSEITSGLHRGIYHQGKLRVNRYNPFEAYVGSESIGDEIIIYGRTNMNRAFDGDIVAVELLPQDQWHEEKSLSIADEEDEEEDVHLVPSSADDAPRTTNLVQGSAGDTNAVSSRPSGCVVGIIKRNWHSYCGSLEPMPMPAGSGGTAHALFVSKDRRIPKIRIHTRQLENLLDKRIIVAVDSWDRLSRYPSGHYVRTIGEIGDRDTESEVVLIENDINSRPFSSQVLACLPPLPWSVSSEDLANPIRQDLRDLRVFSVDPPGCKDIDDALHCTALPSGNFEVGVHIADVTNFVHPGSPLDDEASQRGTSVYLVERRIDMLPKPLTEDICSLRSDVERLAFSVIWEMTPEADIISTRYTKSVIKSCAALSYIEAQARMDDSRLMDPLTTDLRNMNVLAKKMRSRRIERGALTLASAEVKFQIDTETHDPLDIGMYQIREANQMVEEFMLAANVAVADKILKHFSLCSLLRRHPSPTREMLEPLLRTAAAVGLNLDVSSSKALAESLDHAVGDDPYFNKLIRILATRCMTQAVYFCSGDLSPPEYHHYGLAAPLYTHFTSPIRRYADVIVHRLLSASLGIYKLPSIFQDRPHLTSIADNLNYRHRNAQMASRASVELHTLIYFRKRPTDTEARVVKIRSNGFIVFVPKYGIEGPVYLTTRSEKGGGEWFVDEQQQKIKKMDGSLSYSVLQTVRIHMEVVEPQPNRPKLQLTLT

SEQ ID NO: 3938 - protein, 937 aa, Vitis vinifera
MLQSKSFVRKTKQGKVVKVVREHYLRDDIYCGASICKVCDSSTARLSPSASTILILDTNVVLNQIDLLENPAIDDVVVLSVVLEEVKNKNISVYNRLRTLCSNSMRKFFVFSNEYHKDTYVKQMAGESPNDRNDRAIRVATQWYQSHLGAAARVLLITNDRENKRKATEEGISAETVESYVKALGQPGLLDLLVQPAPEDVGMEEVEDLRPSKRKVIYSEHKPMSEITSGLHRGIYHQGKLRVNRYNPFEAYVGSESIGDEIIIYGRGNMNRAFDGDVVAVELLPQDQWQEEKSLSIADEEDEEEEDVHLVPSSADDAPRNTDLAQGSVGGTKAVLCRPSGRVVGIIKRNWHSYCGSLEPMPMPAGNGGIAHALFVSKDRRIPKIRIQTRQLGNLLDKRIIVAVDSWDCLSRYPSGHYVRTIGEIGDRDTESEVVLIENDINSRPFSLQVLACLPPLPWSVSSEDLANPCRLDLRHVCVFSVDPPGCKDIDDALHCTTLPNGNFEVGVHIADVTNFVHPGTPLDDEAAQRGTSVYLVERRIDMLPKPLTEDICSLRSDVERLAFSVIWEMTPQAEIISTKYTKSIIKSCAALSYIEAQARMDDSRLMDPLTMDLRNMNALAKVMRLRRIERGALTLASAEVKFQIDTETHDPLDIGMYQIREANQMVEEFMLAANVSVAEKILKHFPLCSLLRRHPSPTREMLEPLLRTAAAVGLNLDVSSSKALADSLDHAVGDDPYFNKLIRILATRCMTQAVYFCSGDLSPPEFHHYGLAAPLYTHFTSPIRRYADVIVHRLLAASLGLYKLPTIFQDNAQLTSTADNLNYRHRNAQMAGRASVELHTLIYFRKRPTDTEARIVKIRSNGFIVFVPKYGIEGPVYLTPRGEKGGGEWVVDEQQQKVKKMDGSISYSVLQTVMIHMEVVEPQPNRPKLELALICR

SEQ ID NO: 3939 - protein, 934 aa, Prunus persica
MLQNKSFVKRTRGGKITKVVREHYLRHDIYCGAPICKVCDTSQARLSPTPSTILIFDTNVVLNQIDLLENPAIDDVVVLSIVLEEVKNRNLSVYNRVRALCSNSLRKFFVFSNEHHKDTYVTEMSGESKNDRNDRAIRVAAQWYQSHLAGSARILLITNDKENKRKAIEEGISAETVESYVRSLSRPDLLDLLVQPASEDVNMEEVEDLRPSKRKIIYTEHKPMSEITSGLHRGIYHQGKLRVNRYNPFEAYVGSESIGDEIIIYGRTNMNRAFDGDIVAVELLPQDQWHEEKSLALADEEDEEEDVHLVPGSADDAPWTTAQPPGSAGVTESISSRPSGRVVGIIKRNWHSYCGSLEPMAMPAGSGGVAHALFASKDRRIPKIRIHTRQLENLLDKRIVVAVDSWDRLSRYPSGHYVRTIGQIGDRDTETEVVLIENDINTRPFSSQVLACLPPLPWSVSSEDLANSIRQDLRQLRVFSVDPPGCKDIDDALQCTSLPNGNYEVGVHIADVTNFVHSDTPLDDEASQRGTSVYLVERRIDMLPKPLTEDVCSLRADVERLAFSVIWEMTPEAEIISTRYTKSVIKSCAALSYIEAQARMDDSRLMDPLTTDLRNMNALAKIMRERRIQRGALTLASAEVKFQIDTETHDPLDIGMYQIREANQMVEEFMLAANVSVAEKILKHFPLCSLLRRHPTPTREMLEPLLRTAAAVGLNLDVSSSKALADSLDSAVADDPYFNKLIRILATRCMTQAVYFSSGDLSPPEYLHYGLAAPLYTHFTSPIRRYADVIVHRLLAASLGIQKLPAIFQDGTRLTSIADNLNYRHRNAQMASRASVELHTLIFFRKRPTDTEARIVRIRSNGFFVFVPKYGIEGPVYLTPRGDKEGGEWFVDEQQQKIRKMDGSMSYSVLQTVFIHLEIVEPQPNRPKLQLTLV

SEQ ID NO: 3940 - protein, 933 aa, Malus domestica
MLQNKSFVKRTRGGKITKVVREHYLRHDIYCGAPVCKVCDTSGARLSPTASTILIFDTNVVLHQIDLIENPAIDDVVVLSIVLEEVKNRNLSVYNRVRALCSNSLRKFFVFSNEHHKDTYVTDMSGESKNDRNDRAIRVAAQWYQTHLAGSAKVLLITNDKENKRKAIEEGISAETVESYVRSLSRPELLDLLVQPASEDVKMEDTEDLRPSKRKVIYSEHKPMSEITSGLHRGIYHQGKLRVNRYNPFEAYVGSESIGDEIIIYGRTNMNRAFDGDIVAVELLPQDQWHEEKSLALADEEDEEEDVHLVPGSADDAPRTIAAQGSAGVTEPVQNRPSGRVVGIIKRNWHSYCGSLEPMAKPAGGGGIAHALFVSKDRRIPKIRIQTRQLENLMDKRIIVAVDSWDPLSRYPSGHYVRTIGVIGDKDTETEVVLIENDINTRPFSSQVLACLPPLPWFVSSEDLANPIRQDLRQLRVFSVDPPGCKDIDDALHCTALPNGNYEVGVHIADVTNFVHSGTPLDDEASQRGTSVYLVERRIDMLPKPLTEDICSLRADVERLAFSVIWEMTAEAEIISTRYTKSVIKSCAALSYIEAQARMDDSRLMDPLTTDLRNMNSLAKIMRARRIERGALTLASAEVKFEIDTETHDPLDIGMYQIREANQMVEEFMLAANVSVAEKILKHFPLCSLLRRHPSPTREMLEPLLRTAAAIGLNLDVSSSKALADSLDSAVGDDPYFNKLIRILATRCMTQAVYFCSGDLSPPEYLHYGLAASLYTHFTSPIRRYADVITHRLLAASLGIYKLPTIFQDGPRLTSIADNLNYRHRNAQMASRASVELHTVIFFKKRPTDTEARIVRIRSNGFFVFVPKYGIEGPVYLTPRGEKGGGEWYVDEQQQKIRKMDGSISYSVLQTVFIHMEIVEPQPNRPKLQLSLV

SEQ ID NO: 3941 - protein, 932 aa, Eucalyptus grandis
MLHNKSFVKKTRAGKITKNVREHYLRDDIYCGVPTCKVCDASAARLSGSASSPILVLDTNVVLNQIDLLENPAIDDVVVLSIVLQEVRNRNLAVYNRIRALCSNLAKKFFVFSNEHHKDTFVQDMAGESKNDRNDRAIRVAAQWYQSHLGGAAQVLLITNDRENKRKATEEGIPAETIEAYVKSLDRKDLLDLLVRPASEDVVMEGVEDLRPSKRKVIYTEHKPLSEITSGLHRGIYHQGKLRVNRYNPFEAYVGSESIGDEIIIYGRGNMNRAFDGDIVAVELLPQDQWQEENSLSLADEEDEEEGVHLVPGSADDAPRTTNLVQGASGPPPSRPSGRVVGIIKRNWHSYCGSLEPMPMPAGDGGVAHALFVSKDRRIPKIRIQTRQLGNLLNKRIVVTVDSWDRLSRYPSGHYVRTIGEIGDRDAESEVVLIENDIDARPFSSQVLACLPPLPWSVSSEDLANPIRQDLRHLRVFSVDPPGCKDIDDALHCTALSNGNFEVGVHIADVTNFLHPSTPLDDEAAQRGTSVYLVERRIDMLPKPLTEDICSLRADVERLAFSVIWEMTPEAEIISTRYTKSIIKSCAALSYIEAQTRMDDSRLADPLTTDLRNMNTLAKIMRHRRIERGALTLASAEVKFQIDTETHDPLDIGMYQIREANQMVEEFMLAANVSVAEKILKHYPLCSLLRRHPIPTKEMLEPLLRTAASVGLELDVSSSKALADSLDRAVGEDPYFNKLIRILATRCMTQAVYFCSGDLTPPEYQHYGLAAPLYTHFTSPIRRYADVIVHRLLAASLGIDKLPAIFQDRPQLTSIADNLNYRHRNAQMAGRASVELHTLIYFRKRPTDTEARIVKIRSNGFIVFVPKFGIEGPVYLTERSEKGGGEWFVDEQQQKIKKMDGSISYGVLQKVNIHMEVVEPQPNRPKLQLALV

SEQ ID NO: 3942 - protein, 934 aa, Ricinus communis
MLHSKTFNKKTRGGKVQKLVREVYLRDDIYCGASFCKVCDTSAARLTASASAILVLDTNVVLNQIDLLENPAIEDVVVLSIVLQEVKNKNTAVYNRIRALCSNPARKFFVFSNEFHRDTYVQIMTGESPNDRNDRAIRVATSWYQTHLGDAAKVLLITNDRENKRKATEEGVVAETIEAYVKSLGQPALLDLLVQPSSEDTVMEEVEDLRPSKRKVVYPEHKPMSEITAGLTSGIYHQGKLRVNRYNPFEAYVGSESIGEEIVIYGRGNMNRAFDGDIVAVELLPQDQWREDGSMSIADEDDDDEGVHLVPNSADDAPRTTNPVSSSASDTNPISTRPSGHVVGIIKRNWHSYCGSLEPMPVPAGSGGLVYALFVSKDRRVPKIRIQTRQLQNLLDKRIIVAVDSWDRQSRYPSGHYVRSIGEIGDRDTETEVVLIENDIDARPFSAQVLACLPPLPWSVSEEDLANPIRTDLRHLLVFSVDPPGCKDIDDALHCTMLPHGNFEVGVHIADVTNFVHPSTPLDDEATQRGTSVYLVERRIDMLPKPLTEDICSLRADVERLAFSVIWEMTPQAEIITTRYAKSVIKSCAALSYIEAQARMDDSRLMDPVTKDLRNMNALAKIMRQRRIERGALTLASAEVKFQIDTETHDPLDIGMYQIREANQMVEEFMLAANVSVAEQILKQFPGCSLLRRHPTPTKDMLEPLLQTAASVGLTLDVSSSKALADSLDRAVSDDPYFNKLIRIMATRCMTQAVYFCSGDLSPLEFHHYGLAAPLYTHFTSPIRRYADVIVHRLLAASLGIYKLPTIFRDRPQLTSIADNLNYRHRNAQMASRGSVELHTLIYFRKRPTDTEARIVKIRSNGFIVFVPKYGIEGPVYLTPRGEKGGGEWFVDEQQQKIKKMDGSLSYGILQAVRIHLEVVEPQPNRPKLQLTLL

SEQ ID NO: 3943 - protein, 687 aa, Beta vulgaris
MLQSKSFVKKTKGGKVVKVVREHYLRDDIYCGASICKICDSSVARLFSDASTLLILDTNVVLNQIDLLENPAIDEVVVLSVVLDEVKNKNLSVYNRLRALCGNSQRKFFVFSNEHHKETYVKGMIGESPNDRNDRAIRVATQWYQKHLGSAVRVLLVTNDRENKRKANEEGILAETVESYVKSLGQPALLDLVAQPASEDMVMDGVEDLRPSKRKVIYSEHKPMSEITAGLHRGIYHQGKLRVNRYNPFEAYVGSESIGDEIVIHGRTNMNRAFDGDIVAVELLPQDQWHGEKSRIADEEDEEDENVRLAPNSADDAPRNTNVQGSSADDTPGRPSGLVVGVIKRNWHSYCGSLEPMSLPAGSGGTVHALFVSKDRRIPKIRIQTRQLGNLLDKRIIVAVDSWDRLSRYPSGHYVQTIGVIGDRETETEVVLIENDINSRPFSSQVLACLPPLPWSVSPEHLSDPNREDLRNLRVFSVDPPGCRDIDDALHCIPLPNGNFAVGVHIADVTNFVHSGTPLDDEASQRGTSVYLVERRIDMLPKPLTEDICSLRSDVERLAFSVIWEMTPQADIISSRFTKSVIKSCAAMSYVEAQARMDDSRLVDPLTTDLRNMNTLAKIMRQRRIERGALTLASAEVKFQIDTETHDPLDIGMYQIREANQMVEEFMLAANVSVAGKILKHFPFVHY

SEQ ID NO: 3944 - protein, 935 aa, Citrullus lanatus
MLHNKSFVKKTKSGKVMKQVREHYLRDDIYCGTSICKKCDSSVARLGASTSPILVLDTNVVLTQIDLLENPAIDDVVMLSVVLDEVKNKNLSVYNRVRALCSNPLRRFFVFSNEHHKDTYIKEMSGESKNDRNDRAIRVAAQWYQNHLGGATRILLITNDRENRRKAIEEGICAETIESYVRSLGQTHLLDLLVQSANEDANMEEVEDLRPSKRKVLYSEHKPMSEITSGLHRGIYHQGKLRVNRYNPFEAYVGSESIGDEIIIYGRTNMNRAFDGDVVAVELLSRDQWHEEKSLTMVDEEDDEEEDVHLVPGSADDAPRAASVLQGSSGDSSSSSPRPAGRVIGIIKRNWHSYCGSLDPMPMPAGSGGVAYALFVSKDRRIPKIRIQTRQLENLLDKRIIVAVDSWDRLSRYPSGHYVRSIGEIGDRDTESEVVLIENDINSRPFSSQVMACLPPLPWSVSSVDVANPIRQDLRHLNVFSVDPPGCKDIDDALHCTALPNGNFEVGVHIADVTNFVHPGTALDDEAAQRGTSVYLVERRIDMLPKPLTEEICSLRADVERLAFSVIWEMTPEADIISTRYTKSIIKSSAALSYVEAQARMDDSRLMDPITRDLRNMNALAKKMRLRRIERGALTLASAEVKFQIDTETHDPLDIGMYQIREANQMVEEFMLAANVSVAEKILKHFPLCSLLRRHPTPTKEMLEPLIRTAVAVGLDLDVSSSKALADSLDRALGDDPYFNKLIRILATRCMTQAVYFYSGDLSPPEYQHYGLAAPLYTHFTSPIRRYADVIVHRLLAASLGIFKLPTLFLDRPKLTSIADNLNYRHRNAQMAGRASVELHTLIYFKKRPTDTEARIVKIRSNGFIVFVPKFGIEGPVYLSGKGEKQSGEWFVDEQEQKIKKLDGSITYNILQAVRIHMEVVEPQPNRPKLQLTLL

SEQ ID NO: 3945 - protein, 934 aa, Manihot esculenta
MLHSKTFSKKTRGGKVQKLVREVYLRDDIYCGASFCKVCDTSAARFTASASTILVLDTNVVLNQIDLLENPAIEDVVVLSVVLQEVKNKNTAVYNRIRALCSNPARKFFVFSNEFHRDTYVQNMTGESPNDRNDRAIRVATRWYQSHLGDAVKVLLITNDRENKKKATEEGVSAETIESYVKSLGQPALLDLLAQPASEDIIMEEVEDLRPSKRKVVYPEHKPMSEITAGLTSGIYHQGKLRVNRYNPFEAYVGSESIGDEIVVYGRGNMNRAFDGDIVAVEILPQDQWREDESLSIADEDDDNEEVHLVPSSADDAPRTTNSVSGSASDTNPISGRPCGRVIGIIKRNWHSYCGSLEPMPMPAGSGGLVYALFVSKDRRIPKIRIQTRQLENLLDKRIIVAVDSWDRQSRYPSGHYVRSIGEIGDRDTETEVVLIENDIDARPFSAQVLACLPPLPWSVSEQDLVNPIRTDLRHLRVFSVDPPGCKDIDDALHCMMLPNGNFEVGVHIADVTNFVHPGTPLDDEATQRGTSVYLVERRIDMLPKPLTEDICSLRADVERLAFSVIWEMTPEAEIISTRYIKSVIKSCAALSYVEAQARMDDSRLMDPVTKDLRNMNTLAKTMRQRRIERGALTLASAEVKFQIDTETHDPLDIGMYQIREANQMVEEFMLAANVSVAEQILKHFPGCSLLRRHPTPTKDMLEPLLRTAASVGLNLDISSSKALADSLDHAVSDDPYFNKLIRIMATRCMTQAVYFCSGDLSPPEFHHYGLAAPLYTHFTSPIRRYADVIVHRLLAASLEIYKLPTIFRDRPQQTSIADNLNYRHRNAQMASRGSVELHTLIYFRKRPIDTEARIVKIRSNGFIVFVPKYGIEGPVYLTPRGEKGGGEWFVDEQQQKIKKMDGSLSYGILQAVKIHLEVVEPQPNRPKLQLTLL

SEQ ID NO: 3946 - protein, 939 aa, Aquilegia formosa
MLQSKSFVRKTKQGKVLKVVREHYLRDDIYCGASICKVCDTKVARLSSSASTILVLDTNVVLNQIDLLENPAIDDVVVLSVVLDEVKNKNLSVYNRLRALCSNTLRKFFVFSNEHHKDTYVKAMVGESPNDRNDRAIRVATNWYQRHLGGGTRVLLITNDKENKRKATDEGIFAETVETYVKSLGQPNLLDLVVHPTSEDVGMEDVEDLRPSKRKVIYIEHKPMSEITAGLHRGIYHQGKLRVNRYNPFEAYVGSESIGDEIIIQGRGNMNRAFDGDVVAVELLPKEQWHEGKSLSIADDDFSFIEDEEEEDVHLVPNSADDAPRNRDTIQDSSSTVNPVSCRPSGRVVGIIKRNWQSYCGSLEPMPMPAGNGGIAHALFVSKDRRIPKIRIQTRQLGNLLDKRIIVTVDSWDCLSRYPSGHYVRTIGEIGDRDTETKAILIENDINSRPFSTQVLACLPPLPWSVSTEDLMNPNRQDLRQLRVFSVDPPGCRDIDDALHCTALPDGNFEVGVHIADVTNFVHSGTPLDDEASQRGTSVYLVERRIDMLPKPLTEDICSLRSDVERLAFSVIWVMTPEAEIISTRYTKSVIKSSAVMSYVEAQARMDDSRLMDPLTTDLRNLNTLAKIMRQRRIDRGALTLASAEVKFQIDTETHDPLDIGMYQIREANQMIEEFMLAANVSVAEKILKHFSMCSLLRRHPSPTKEMLEPLLRTAAAIGLDLDVSSSKALADSLDRAVGDDPYFNKLIRILATRCMPQAVYFCSGDLTPPEFHHYGLASPLYTHFTSPIRRYADVIVHRLLAAALGIYKLPTIFQDRPQLTSIADNLNYRHRNAQMASWASVELHTLIFFRKRPTDTEARIVKIRANGFIVFVPKYGIEGPVYLTPKGEKGGDWVVDEEHQKVKKMDGSISYSVLQMVQIHMEVVEPQPNRPKLQLTLM

SEQ ID NO: 3947 - protein, 558 aa, Citrus clementina
MLKSKSYSRKTKSNKIKKEVREVYLRDDIWCGAASCSTCDSSAARLSASTILVVDTNVVLNQIDLLENPAIDDVVVLSVVLDEVKNKNLSVYNRIRALCSNSLRNFYVFSNTFHKDTHVDKMDKESPNDLNDRAIRVATQWYQKHLGDATKVLLVTNDRENMRKATEQGIFAETIESYVKSLGQPNLLDLLVHPASEDVNMEDVEDLRPSKRKVIYPEHKPMSEITSGLRRGIYHQGKLRVNRYNPFEAYVGSESIGDEIIIYGRTNMNRAFDCDIVAVELLPQEQWHEEKSLFIAAEEDDEDEDDVHLAPSSADDAPRTASVAAAAAGENSAPSRPSGRVVGIIKRNWHSYCGSLEPMPMPAGSGSVAHALFVPKDRRIPKIRIQTRQLGNLLDKRIIVAVDSWDCQSRYPFGHYVQVIGEIGDRDTESEMVLIDNDIDARPFSTQVLACLPPLPWSVSSEDLANPIRLDLRDLRVFSVDPPGCKDIDDALHCTALSSGNFEVGVHIADVTNFVHPGTPLDDEAAKRGTSVYLVERRIDMLPKPLTEGKFIYMFTAG

SEQ ID NO: 3948 - protein, 935 aa, Cucumis sativus
MLHNKSFVKKTKSGKVMKQVREHYLRDDIYCGASICKKCDSSVARLGASTSPILVLDTNVVLTQIDLLENPAIDDVVMLSVVLDEVKNKNLSVYNRVRALCSNPLRRFFVFSNEHHKDTYIKDMSGESKNDRNDRAIRVAAQWYQNHLGGATRVLLITNDRENRRKAIEEGIGAETIESYVRSLGQTHLLDLLVQSANTDANKEDVEDLRPSKRKVLYSEHKPMSEITSGLHRGIYHQGKLRVNRYNPFEAYVGSESIGDEIIIYGRTNMNRAFDGDVVAVELLSRDQWHEEKSLTIADDEDDEEEDVHLVPGSADDAPRAASVLQGSSGDSSSSSPRPAGRVIGIIKRNWHSYCGSLDPMPMPAGSGGIAYALFVSKDRRIPKIRIQTRQLENLLDKRIIVAVDSWDRLSRYPSGHYVRSIGEIGDRDTESEVVLIENDINSRPFSSQVMTCLPPLPWSVSPVDIANPIRQDLRHLNVFSVDPPGCKDIDDALHCTALSNGNFEVGVHIADVTNFVHPGTALDDEAAQRGTSVYLVERRIDMLPKPLTEDICSLRADVERLAFSVIWEMTPEADIVSTSYTKSIIKSSAALSYVEAQARMDDSRLMDPITRDLRNMNALAKKMRLRRIERGALTLASAEVKFQIDTETHDPLDIGMYQIREANQMVEEFMLAANVSVAEKILKHFPLCSLLRRHPTPTKEMLEPLIRTAVAVGLDLDVSSSKALADSLDRALGDDPYFNKLIRILATRCMTQAVYFYSGDLSPPEYQHYGLAARLYTHFTSPIRRYADVIVHRLLAASLGIFKLPTLFLDRPKLTTIADNLNYRHRNAQMAGRASVELHTLIYFKKRPTDTEARIVKIRSNGFIVFVPKFGIEGPVYLTGKSEKQSGEWFVDEQEQKIKKLDGSITYNILQAVRIHMEVVEPQPNRPKLQLTLL

SEQ ID NO: 3949 - protein, 711 aa, Valeriana officinalis
MLQSKSFVRKTKQGKVVKVVREHYLRDDIYCGASFCKVCDTSTARLSSSASTILVIDTNVVLNQIDLLENPAIDEVVVLSVVLEEVKHKNVAVYNRLRALCSSSSRKFFVFSNEYHKDTYVKAMAGETPNDRNDRAIRVAAQWYQNHLGNAFRVLLITNDRENKRKASEEGISAETVESYVRSLGQPALLDLLVQPPSEDTRMEDADDSRPSKRKVIYNEHKPMSEITSGLLRGIFHQGKLRVNRYNPFEAYVGSESIGDEIIIYGRGNMNRAFDGDVVAVELLPQDQWHDEKSLSIAEQEDEEDDDVHLAPSSADDAPVKGSNGDMSNVPPRPSGRIVGIIKRNWKSYCGSLDPMPMPAGNGGVAHALFVSKDRRIPKIRIQTRQLGNLLDKRIIVSVDSWDCASRYPSGHYVRTIGDIGDRDTESEVVLIENDIDARPFTSQVLACLPPLPWNVSAEDLANPIRQDLRHLRVFSVDPPGCKDIDDALHCTLSPNGNFEVGVHIADVTNFVHPGTPLDDEATQRGTSVYLVERRIDMLPKPLTEDICSLRADVERLAFSVIWEMTPEAEIISTRYTKSVIKSCAALSYVEAQARMDDSRLMDPVTTDLRNMNALAKKMRQRRIDRGALTLASAEVKFQIDTETHDPLDIGMYQIREANQMVEEFMLAANISVAEKILQTFSTMLFVKAASKSNKKCLTFTSYSSRCWRQS

SEQ ID NO: 3950 - protein, 932 aa, Helianthus annuus
MLQSKSFVRKTKQGKVVKVVREHYLRDDIYCGASFCKVCDTKGARFTSPECTILVLDTNVVLNQIDLLENSAIDDVVVLSVVLDEVKNKNLAVYNRLRALCSNTLRRFFVFSNEHHKDTYVKAMAGESPNDRNDRAIRVAAQWYQNHLGGPTRILMVTNDRENKRKATEEGISADTVESYVKSLGQPALLDLLVQPNSSEDMEIEDLRPSKKKAIYTEHKPMSEITSGIRCGIYHQGKLRVNRYNPFEAYVGSESIGDEIIISGRGNMNRAFDGDVVAVELLPQDQWQNEASLHIAEEDDEDDGVHLAPSSADVAPRITNPAQGSSENANNPPSRPSGRVVGIIKRNWHAYCGSLEPMPMPAGNAGIAHALFVSKDRRFPKIRIQTRQLGNLLDKRIIVAVDTWDCQSRYPSGHYVRTIGDIGDRETETEVVLIENDIDARPFSSQVLACLPPLPWSVSSEDLSNPIRQDLRHLRIFSVDPPGCKDIDDALHCTPLPNGNFEVGVHIADVTNFVHPGTPLDSEATQRGTSTYLVERRIDMLPKPLTEDICSLRADVERLAFSVIWEMTPEAHVISTRYTKSVIKSCAALSYVEAQARMDDSRLMDPVTADLRNMNALAKIMRQRRIERGAITLASAEVKFQVDTETHDPLDIGMYQIREANQMVEEFMLAANVSVAEQILKKFPQCSLLRRHPSPTKEMLEPLLRTAAAVGLDLDVSSSKALADSLDRAVGDDPYFNKLIRILATRCMTQAVYFCSGDLSPPEFHHYGLAAPLYTHFTSPIRRYADVIVHRLLAASLDIYKLPPIFQDRPQLTSIADNLNYRHRNAQMASRSSIELHTIIFFRKRPTDTEARIVKIRANGFIVFVPKYGIEGPVHLTMRGAKGGGEWVVDEQQQMIKKVDGSISYGVLQPVKIHMEVVEPQPNRPKLQLTLI

SEQ ID NO: 3951 - protein, 933 aa, Helianthus annuus
MLQSKSFVRKTKQGKVVKVVREHYLRDDIYCGASFCKVCDTKGARFTSPECTILVLDTNVVLNQIDLLENSAIDDVVVLSVVLDEVKNKNLAVYNRLRALCSNTLRRFFVFSNEHHKDTYVKAMAGESPNDRNDRAIRVAAQWYQNHLGGPTRILMVTNDRENKRKATEEGISADTVESYVKSLGQPALLDLLVQPNSSEDMEIEDLRPSKKKAIYTEHKPMSEITSGIRCGIYHQGKLRVNRYNPFEAYVGSESIGDEIIISGRGNMNRAFDGDVVAVELLPQDQWQNEASLHIAEEDDEEDDGVHLAPSSADVAPRIANPAQGSSENANNPPSRPSGRVVGIIKRNWHAYCGSLEPMPMPAGNAGIAHALFVSKDRRFPKIRIQTRQLGNLLDKRIIVAVDTWDCQSRYPSGHYVRTIGDIGDRETETEVVLIENDIDARPFSSQVLACLPPLPWSVSSEDLSNPIRQDLRHLRIFSVDPPGCKDIDDALHCTPLPNGNFEVGVHIADVTNFVHPGTPLDSEATQRGTSTYLVERRIDMLPKPLTEDICSLRADVERLAFSGIWEMTPEAHVISTRYTKSVIKSCAALSYVEAQARMDDSRLMDPVTADLRNMNALAKIMRQRRIERGAITLASAEVKFQVDTETHDPLDIGMYQIREANQMVEEFMLAANVSVAEQILKKFPQCSLLRRHPSPTKEMLEPLLRSAAAVGLDLDVSSSKALADSLDRAVGDDPYFNKLIRILATRCMTQAVYFCSGDLSPPEFHHYGLAAPLYTHFTSPIRRYADVIVHRLLAASLDIYKLPPIFQDRPQLTSIADNLNYRHRNAQMASRSSIELHTIIFFRKRPTDTEARIVKIRANGFIVFVPKYGIEGPVHLTMRGAKGGGEWVVDEQQQMIKKVDGSISYGVLQPVKIHMEVVEPQPNRPKLQLTLI

SEQ ID NO: 3952 - protein, 933 aa, Eutrema halophilum
MLQSKVFNKKTRGGRIQKQVREVYLRDDIYCGAFSCKSCDTSAARLSSPKIIVVDTNVVLHQIDLLENQAIDSVVVLSVVLDEVKNRNRSVYNRIRALCSNPARQFYVFSNHVHKDTYVQAMERETANDHNDRAIRVATLWYQKHLGDSSQVLLVTNDRENKRKATEEGISAETIEAYVKSIGQPELLDLLAQPTTEDVTMEDADDSRPSKRKLVYLEHKPMSEITAGLHRGIYHQGKLRVNRFNPFEAYVGSESIGEEIIIYGRSNMNRAFDGDIVAVELLPRDQWQEEKALSIAEEDEEEDDTVHLAPNTADDAPRTSNLPQETSGDKNAIPARPSGRVVGIIRRNWHSYCGSLEPMSLPAGSGGTAHALFVSKDRRIPKIRINTRQLQNLLDMRIVVAVDSWDRQSRYPSGHYVRPIGKIGDRETETEVVLIENDVDYSPFTSQVLACLPPLPWSVSPEDVSNPVRQDLRHLLVFSVDPPGCKDIDDALHCTSLPNGNFELGVHIADVTNFVHPGTPLDDEASKRGTSVYLVERRIDMLPKPLTEDICSLRADVERLAFSVIWEMNPEAEIISTRFTKSIIKSSAALSYVEAQARMDDSRLTDSVTTDLRNMNTLAKIMRQRRIDRGALTLASAEVKFQIDTETHDPLDIGMYQIREANQMVEEFMLAANVSVAEQILKHFPSCSLLRRHPTPTREMLEPLLRTAAAIGLNLDVSSSKALADSLDRAVGEDPYFNKLIRILATRCMTQAVYFCSGDLTPPEYLHYGLAAPLYTHFTSPIRRYADVFVHRLLAASLGIYKLPTVFQDRPQLTSVADNLNYRHRNAQMASRASVELHTLIYFRNRPTDAEARVVKIRSNGFIVFVPKYGIEGPVYLTAKGEKGAGDWYVDEEKQKIVKMDGSLSYSVLQTVKIHMEVVEPQPNRPKLQLTLL

SEQ ID NO: 3953 - protein, 934 aa, Elaeis guineensis
MLQSKSFVKKTKQGRVVKVVREHYLRDDIYCGALSCKVCNTSAARLSSSACTILIVDTNVVLNQIDLLENPAIEDVVVLSVVLEEVRNKNLAVYNRVKALCTNSLRKFFVFSNEHHRDTYVKEMVGESPNDRNDRAIRVAARWYQSHLGGSIQVLLITNDKENKRKAIEEGLSAETVESYVKSLGQPNLLDLVALPTSEDVGMAEVEDLRPSKRKVIYSEHKPMSEITSGLHRGIYHQGKLRVNRYNPFEAYVGSESIGDEMVVHGRANMNRAFDGDIVAVEVLPQDQWHEEKSSIIADDEDDEEEDVHLVPSSADDAPRNTNLVQPAAASAASTSSRPAGRVVGIIKRNWHSYCGSLEPMPMPAGNGGIAHALFVSKDRRIPKIRIQTRQLGNLLDKRIVVAVDSWDCLSRYPSGHYVRTIGEIGDRDTESEVLLIENDINSRPFSAQVLACLPPLPWTLSSEDLANPKRQDLRHVRVFSVDPPGCKDIDDALHCTSLPNGNFEVGVHIADVTNFVLPGTPLDDEAAQRGTSVYLVERRIDMLPKPLTEDICSLRSDVERLAFSVIWEMTPEAEIISTRYTKSVIKSCAALSYVEAQARMDDSRLMDPLTTDLRNLNSLAKVMRHQRIERGALTLASAEVKFQIDTETHDPLDIGMYQIREANQMIEEFMLAANVSVAEKILKHFPLCSLLRRHPIPTKEMLEPLLRTAAAVGLDLDVSSSKALADSLDHAVGDDPYFNKLIRILATRCMTQAVYFCSGDLSPSEYHHYGLAAALYTHFTSPIRRYADVIVHRLLAAALGIAKLPPIFMDGPQLTSIADNLNYRHRNAQMASRASVELHTLIYFRKRPTDTEARIVKIKSNGFIVFIPKFGIEGPVYLMPRGEKGGDWVVDEVHQRVTRTGTNISYGILNTVRIHMEVVEPQPSRPKLELTLI

SEQ ID NO: 3954 - protein, 933 aa, Arabidopsis lyrata
MLQSKVFNKKTRGGRIQKQVREVYLRDDIYCGAFSCKSCDSSAARLSSPKILVVDTNVVLHQIDLLENQAIDSVVVLSVVLDEVKNRNRSVYNRIRALCSNPTRQFYVFSNHVHKDTYVQAMEKESANDHNDRAIRVATLWYQKHLGDTSQVLLVTNDRENKRKATEEGISAETIEAYVKSIGQPELLDLLAQPTNEDVTMEDADDSRPSKRKLIYQEHKPMSEITAGLHRGIYHQGKLRVNRFNPFEAYVGSESIGEEIIIYGRSNMNRAFDGDIVAVELLPRDQWQEEKALSIAEEDDEEDDTVHLAPNSADDAPRTSNLSQETSGDKNATPARPSGRVVGVIRRNWHSYCGSLEPMSLPAGSGGTAHALFVSKDRRIPKIRINTRQLQNLLDMRIVVAVDSWDRQSRYPSGHYVRPIGKIGDRETETEVVLIENDVDYSPFSSQVLACLPPLPWSVSPEDVSNPIRQDLRHLLVFSVDPPGCKDIDDALHCTSLPNGNFELGVHIADVTNFVHPGTPLDDEASKRGTSVYLVERRIDMLPKPLTEDICSLRADVERLAFSVIWEMSPDAEIISTRFTKSIIKSSAALSYVEAQARMDDSRLTDSLTTDLRNMNTLAKIMRQRRIDRGALTLASAEVKFQIDTETHDPLDIGMYQIREANQMVEEFMLAANVSVAGQILKLFPSCSLLRRHPTPTREMLEPLLRTAAAIGLTLDVSSSKALADSLDRAVGEDPYFNKLIRILATRCMTQAVYFCSGDLTPPEYHHYGLAAPLYTHFTSPIRRYADVFVHRLLAASLGIYKLPTVFQDRPQLTSVADNLNYRHRNAQMASRASVELHTLIYFRNRPTDAEARVVKIRSNGFIVFVPKYGIEGPVYLTGKGEKGAGDWYVDEEKQKIVKMDGSLSYSVLQTVKIHMEVVEPQPNRPKLQLSLL

SEQ ID NO: 3955 - protein, 934 aa, Brassica rapa
MLQSKVFNKKTRGGRIQKQVREVYLRDDIYCGAFSCKSCDTSAARLSSPKIIVVDTNVVLHQIDLLENQAIDNVVVLSVVLDEVKNRNKSVYNRIRTLCSNPVKQFYVFSNHVHKDTYVQAMERETANDHNDRAIRVATLWYQKHLGDTSQVLLVTNDRENKRKAIEEGISAETIEAYVKSIGQPELLDLLAQPTGEDVTMEDADDSRPSKRKLVYLEHKPMSEITAGLHRGIYHQGKLRVNRFNPFEAYVGSESIGEEIIIYGRSNMNRAFDGDIVAVELLPRDQWQGEKALSIAEEDEEEEDDTVHLAPNSADDAPRTSNLAQVTSGDKNANPARPSGRVVGVIRRNWHSYCGSLEPMSLPAGSGGTAHALFVSKDRRIPKIRINTRQLENLLDMRIVVAVDSWDRQSRYPSGHYVRPIGKIGDRETETEVVLIENDVDYSPFSSQVLACLPPLPWSVSAEDVSSPVRQDLRHLLVFSVDPPGCKDIDDALHCTSLPNGNFELGVHIADVTNFVHPGTPLDDEASKRGTSVYLVDRRIDMLPKPLTEDICSLRADVERLAFSVIWEMSPGAEIISTRFTKSIIKSSAALSYVEAQARMDDSRLTDPVTTDLRNMNALAKIMRQRRIDRGALTLASAEVKFQIDTETHDPLDIGMYQIREANQMVEEFMLAANVSVAEQILKLFPSCSLLRRHPTPTREMLEPLLRTAAAIGLSLDVSSSKALADSLDRAVGEDPYFNKLIRILATRCMTQAVYFCSGDLSPPEYLHYGLAAPLYTHFTSPIRRYADVFVHRLLAASLGIYKLPTVFQDRPQLTSVADNLNYRHRNAQMASRASVELHTLIYFKNRPTDAEARVVKIRSNGFIVFVPKYGIEGPVYLTAKGEKGVGDWYVDEEKQKIVKMDGSLSYSVLQTVRIHMEVVEPQPNRPKLELTLL

SEQ ID NO: 3956 - protein, 935 aa, Populus trichocarpa
MLHSKTFNKKTRGGRIQKLVREVYLRDDIYCGALFCKSCEDKSKARLTATASTILILDTNVVLNQIDLLENPAVEDVVLLSVVLQEVKNKNSAVYGRIRNLIDSPARRFVVFSNEFHRDTYVQIMAGESPNDRNDRAIRVAARWYQSHLGEAVKVLLITNDRENKRKATEEGVSAETIESYVKSLGQPALLDLLVQPASEDVIMEEVEDMRPSKRKVVYPEHKPMSEITSGLTKGIYHQGKLRVNRYNPFEAYVGSESIGDEIVIYGRGNMNRAFDGDVVAVELLPQDQWHEEKSLSIVDEEDEEEDVHLVPGSSDDAPRTSIPVSSSTFDTNPVSSRPSGLVVGIIKRNWHSYCGSLEPMPMPAGSGGLVYALFVSKDRRIPKIRIQTRQLDNLLDKRIIVAVDSWDRQSRHPSGHYIRSIGQIGDRDTETELVLIENDIDARPFSAQVLACLPPLPWSVSSKDLNESNRVDLRHLCVFSVDPPGCKDIDDALHCTMLPTGNFEVGVHIADVTNFVHPGTPLDDEATQRGTSVYLVERRIDMLPKPLTEDICSLRADVERLAFSVIWEMTPEAEIISTKYTKSVIKSRAALSYVEAQARMDDSRLVDPVTKDLRNMNALAKIMRQRRIHRGALTLASAEVKFQIDTETHDPLDIGMYQIREANQMVEEFMLAANVSVAEKILKEFPECSLLRRHPTPTKEMLGPLLRTAAAVGLNLDVTSSKALADSLDRAVGDDPYFNKLIRIMATRCMTQAVYFCSGELSPPEFLHYGLAAPLYTHFTSPIRRYSDVIVHRLLAASIGIYKLPTIFRDRPQLTSIADNLNYRHRNAQMASRGSVELHTLIYFRNRPTDTEARIVKMRSNGFIVFVPKFGIEGPVYLTMRGDKGGGEWFVDEQQQKIRKMDGSVSYSILQAVKIHLEVLEPKPNRPKLQLTLL

SEQ ID NO: 3957 - protein, 931 aa, Mimulus guttatus
MLQSKSFVKKTKQGRVVKVVREHYLRDDIYCGAPLCKVCDVAASRLSSTASTILVVDTNVVLHQIDLLENPAIDDVVVLSVVLEEVKNKNLGVYNRLRALCSNSQRRFFVFSNEYHKDTYVKIETGESPNDRNDRAIRVAAQWYQNHLGSAVRVLLITNDRDNKKKAVTDGILAETVESYVKSLGQPALLDLIVQPPSDDVTMEDAEDLRPSKRKTIYPEHKPMSEITSGLHRGIYHQGKLRVNRYNPFEAYVGSESIGDEIIVYGRTNMNRAFDGDIVAVELLPQDRWQEEKSLAIANDEDEEEDDVHLAPSSADDAPRVPSSAGDKNAMPTRPSGRVIGIIKRNWHSYCGSLDPMPMPAGEGGIAHALFVSKDRRIPKIRMQTRQLGNLLDKRIIVAVDSWDRLSRHPSGHYVRTIGEIGDRDTESEVVLIENDIDARPFSSQVLACLPPLPWSVSAEDISNPIRQDLRHLRVFSVDPPGCKDIDDALHCMLLPSGHFEVGVHIADVTNFVHPGTPLDDEAATRGTSVYLVERRIDMLPKPLTEDVCSLRSDVERLTFSVIWEMTPEAEIISTRYTKAIIKSCAALSYVEAQARMDDSRLMDPLTTDLRNMNVLAKIMRQKRIERGALTLASAEVKFQIDTETHDPLDIGMYQIREANQMIEEFMLAANISVAKKILEHFPPTSLLRRHPSPTKEMLEPLIQTAAAVGLCLDVTSSKALADSLDRAVGEDPYFNKLIRILATRCMTQAVYFCSGDLSPPEFCHYGLAAPVYTHFTSPIRRYADVIVHRLLAASLGICRLPDIFQERPRLTSIADNLNYRHKNAQMASRASVELHTLIYFRNRPTDTEARILKIRSNGFIVFVPKYGIEGPVHLMARGQKEGGKWIVDEQQQKIKKIDGQDSYGVLQTVRIHMEVVEPQPNRPKLQLTLI

SEQ ID NO: 3958 - protein, 981 aa, Brassica napus
MLQSKVFNKKTRGGRIQKQVREVYLRDDIYCGAFSCKSCDTSAARLSSPKIIVVDTNVVLHQIDLLENQAIDNVVVLSVVLDEVKNRNKSVYNRIRSLCSNPAKQFYVFSNHVHKDTYVQAMERETANDHNDRAIRVATLWYQKHLGDTSQVLLVTNDRENKRKAIEEGISAETIEAYVKSIGQPELLDLLAQPAGEDVTMEDADDSRPSKRKLVYLEHKPMSEITAGLHRGIYHQGKLRVNRFNPFEAYVGSESIGEEIIIYGRSNMNRAFDGDIVAVELLPRDQWQEEKALSIAEEDEEEDDDTVHLAPNSADDAPRTSNLAQVTSGDKNANPARPSGRVVGVIRRNWHSYCGSLEPMSLPAGSGGTAHALFVSKDRRIPKIRINTRQLENLLDMRIVVAVDSWDRQSRYPSGHYVRPIGKIGDRETETEVVLIENDVDYSPFSSQILACLPPLPWSVSAEDVSSPVRQDLRHLLVFSVDPPGCKDIDDALHCTSLPNGNFELGVHIADVTNFVHPGTPLDDEASKRGTSVYLVDRRIDMLPKPLTEDICSLRADVERLAFSVIWEMSPGAEIISTRFTKSIIKSSAALSYVEAQARMDDSRLTDPVTTDLRNMNALAKIMRQRRIDRGALTLASAEVKFQIDTETHDPLDIGMYQIREANQMVEEFMLAANVSVAEQILKLFPSCSLLRRHPTPTREMLEPLLRTAAAIGLSLDVSSSKALADSLDRAVGEDPYFNKLIRILATRCMTQAVYFCSGDLSPPEYLHYGLAAPLYTHFTSPIRRYADVFVHRLLAASLGIYKLPTVFQDRPQLTSVADNLNYRHRNAQMASRASVELHTLIYFKNRPTDAEARVVKIRSNGFIVFVPKYGIEGPVYLTAKGEKGVGDWYVDEEKQKIVKMDGSLSYSVLQTVRIHMEVVEPQPNRPNSNSPFCKTLQPFKSRFHYFYIVWTNCQELVWYLHLFCVLYAYFILLCVSLSKS

SEQ ID NO: 3959 - protein, 592 aa, Trigonella foenum-graecum
MAKMNPLFILAFFSISSLFFSTVRSDSSDKRYKEGDLVPLFANKVGPFHNPSETYRYFDLPFCIPDHLKEKKEALGEVLNGDRLVSAPYQLEFQKDKDSVPVCKKTLTKEEVGNFRSAVRKDYYFQMYYDDLPIWGFIGKVDKEGKDPSDYRYYLYKHIHFDIFYNKDRVIEINVRTDPNALVDVTEDNEVDVEFFYTVKWKETNTPFEKRMDKYSQSSSLPHHLEIHWFSIINSCVTVLLLTGFLATILMRVLKNDFVKYAHDEETAEDQEETGWKYIHGDVFRFPKFKSVFAAALGSGTQLFTLTVFIFILALVGVFYPYNRGALFTALVVIYALTSGIAGYTATSFYCQLEGTNWVRNLLLTGCLFCGPLFLTFCFLNTVAIVYNATAALPFGTIVVIVLIWTLVTSPLLVLGGIAGKNSKAEFQAPVRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYAYCLYYYHARSDMSGFMQTSFFFGYMACICYGFFLMLGTVGFRASLFFVRHIYRSIKCE

SEQ ID NO: 3960 - protein, 593 aa, Aquilegia formosa
MAKKKNTLLFSISILISFLAIHVRSDGSDHRYKLGEPVPLYANKVGPFHNPSETYRYFDLPFCLPAHLKEKKEALGEVLNGDRLVSAPYKLDFLAEKDSEVVCKKKLTTEEVIQFRKAVTKDYYFQMYYDDLPIWGFIGKVDKEGKSDPSEYKYYLYKHIHFDINYNKDRVIEINVRTDPNSLVDLTEDKPVEAEFMYTVKWKETTIPFEKRMEKYSQSSSMPHHLEIHWFSIINSCVTVLLLTGFLATILMRVLKNDFVKYAHDEEAADDQEETGWKYIHGDVFRYPKSKSLFAAALGSGTQLFTLTIFIFVLALVGVFYPYNRGALFTALVVIYALTSGIAGYTATSFYCQLEGSNWVRNLLLTGCLFCGPLFLTFCFLNTVAIAYSATAALPFGTIVVIVLIWTLVTSPLLVLGGIAGKNSKSEFQAPVRTTKYPREIPPLPWYRGTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 3961 - protein, 594 aa, Gossypium hirsutum
MRNFGNSPAFVILGVFILSCVSHVRSDASDHRYKEGDPVPLYANKVGPFHNPSETYRYFDLPFCSPDHVKEKKEALGEVLNGDRLVSAPYKLNFKEEKDSSVVCKKKLSKDEVVFFRKAVEKDYYFQMYYDDLPIWGFIGKVDKEGKADPSEYKYYLYKHIQFDVLYNKDRVIEISARMDPHLLVDLTEDKEVDAEFMYTVKWKETDTPFEKRMERYSMSSSLPHHLEIHWFSIINSCVTVLLLTGFLATILMRVLKNDFIKYGQDEEAADDQEETGWKYIHGDVFRFPKYKSLFAAALGSGTQLFTLTVFIFMLALVGVFYPYNRGALFTALVVIYALTSGIAGYVATSFYCQLEGTNWVRNLLLTGCLFCGPLFLTFCFLNTVAIAYSATAALPFGTIVVIVLIWTLVTSPLLVLGGIAGKNSRAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLFFVRHIYRSIKCE

SEQ ID NO: 3962 - protein, 594 aa, Gossypium raimondii
MRNFGNSPAFVILGVFILSCVSHVRSDASDHRYKEGDPVPLYANKVGPFHNPSETYRYFDLPFCSPDHVKEKKEALGEVLNGDRLVSAPYKLNFKEEKDSSVVCKKKLSKDEVVFFRKAVEKDYYFQMYYDDLPIWGFIGKVDKEGKADPSEYKYYLYKHIQFDVLYNKDRVIEISARMDPHLLVDLTEDKEVDAEFMYTVKWKETDTPFEKRMERYSMSSSLPHHLEIHWFSIINSCVTVLLLTGFLATILMRVLKNDFIKYGQDEEAADDQEETGWKYIHGDVFRFPKYKSLFAAALGSGTQLFTLTVFIFMLALVGVFYPYNRGALFTALVVIYALTSGIAGYVATSFYCQLEGTNWVRNLLLTGCLFCGPLFLTFCFLNTVAIAYSATAALPFGTIVVIVLIWTLVTSPLLVLGGIAGKNSRAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLLLGTVGFRASLFFVRHIYRSIKCE

SEQ ID NO: 3963 - protein, 594 aa, Gossypium hirsutum
MRNFGNSPAFVILGVFILSCVSHVRSDASDHRYEEGDPVPLYANKVGPFHNPSETYRYFDLPFCSPDHVKEKKEALGEVLNGDRLVSAPYKLNFREEKDSSVVCKKKLSKDEVVFFRKAVEKDYYFQMYYDDLPIWGFIGKVDKEGKADPSEYKYYLYKHIQFDVLYNKDRVIEISARMDPHLLVDLTEDKEVDAEFMYTVKWKETGTPFEKRMERYSMSSSLPHHLEIHWFSIINSCVTVLLLTGFLATILMRVLKNDFIKYGQDEEAADDQEETGWKYIHGDVFRFPKYKSLFAAALGSGTQLFTLTVFIFMLALVGVFYPYNRGALFTALVVIYALTSGIAGYVATSFYCQLEGTNWVRNLLLTGCLFCGPLFLTFCFLNTVAIAYSATAALPFGTIVVIVLIWTLVTSPLLVLGGIAGKNSRAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLLLGTVGFRASLFFVRHIYRSIKCE

SEQ ID NO: 3964 - protein, 594 aa, Manihot esculenta
MDNPFATLLLFLFAVVVASSVTHVRSDSSDHRYKEGDSVPLYANKVGPFQNPSETYRYFDLPFCVPDHVKEKKEALGEVLNGDRLVSAPYKLNFRDEKTSSLVCKKTLSKEEVAKFRSAIDKDYYFQMYYDDLPIWGFIGKVDKEGKTDPSEYKYFLYKHIQFDVLYNKDRVIEVSVRMDPNSLLDLTEDKEVETEFFYTVKWKETDTPFEKRMEKYSLSSSLPHHLEIHWFSIINSCVTVLLLTGFLATILMRVLKNDFVKYAQDEEAADDQEETGWKYIHGDVFRYPKYKSLFAAALGSGSQLFTLTVFIFILALVGVFYPYNRGALFTALVVIYALTSGIAGYTATSFYCQLEGNNWVRNLLLTGCLFCGPLFLTFCFLNTVAIVYSATAALPFGTIVVIVLIWTLVTSPLLVLGGIAGKNSKAEFQAPCRTTKYPREIPQLPWYRSSLPQMAMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLFFVRHIYRSIKCE

SEQ ID NO: 3965 - protein, 63 aa, Chelidonium majus
ISSLLIQVRSDGSDHRYKPNDPVPLYANKVGPFHNPSETYRFFDLPFCSPSHVTEKKELLVKY

SEQ ID NO: 3966 - protein, 594 aa, Gossypium hirsutum
MKNMGDFPTFLVVGLLIFSCLSYVRSDASDHRYKDGDAVPLYANKVGPFHNPSETYRYFDLPFCSPDHVTEKREALGEVLNGDRLVSAPYKLNFKEEKDSSVVCKKQLSKDEVAFFRKAVDKDYYFQMYYDDLPIWGFIGKVDKEGKTDPSEYKYFLFKHIQFDVLYNKDRVIEVNARMDPHSLVDLTEDKEVDAEFMYSVKWKETDTPFEKRMDKYSMSSSLPHHLEIHWFSIINSCVTVLLLTGFLATILLRVLKNDFIKYGQDEEAADDQEETGWKYIHGDVFRFPKYKSLFAAALGSGTQLFTLTVFIFMLALVGVFYPYNRGALFTALVVIYALTSGIAGYTATSFYCQLEGNNWVRNLLLTGCLFCGPLFLTFCFLNTVAIVYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRASLLFVRHIYRSIKCE

SEQ ID NO: 3967 - protein, 594 aa, Gossypium raimondii
MKNMGDFPTFLVVALLIFSCLSYVRSDASDHRYKDGDAVPLYANKVGPFHNPSETYRYFDLPFCSPDHVTEKREALGEVLNGDRLVSAPYKLNFKEEKDSSVVCKKQLSKDEVAFFRKAVDKDYYFQMYYDDLPIWGFIGKVDKEGKTDPSEYKYFLFKHIQFDVLYNKDRVIEVNARMDPHSLVDLTEDKEVDAEFMYSAKWKETETPFEKRMDKYSMSSSLPHHLEIHWFSIINSCVTVLLLTGFLATILLRVLKNDFIKYGQDEEAADDQEETGWKYIHGDVFRFPKYKSLFAAALGSGTQLFTLTVFIFMLALVGVFYPYNRGALFTALVVIYALTSGIAGYTATSFYCQLEGNNWVRNLLLTGCLFCGPLFLTFCFLNTVAIVYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRASLLFVRHIYRSIKCE

SEQ ID NO: 3968 - protein, 591 aa, Manihot esculenta
MNELLIFLIFAVLIASSVTHVSSDASDHRYKEGDHVPLYANKVGPFHNPSETYRYFDLPFCVPDHVKEKKEALGEVLNGDRLVSALYKLNFRDEKTSAVVCKKTLTKEEVARFRSAIDKDYYFQMYYDDLPIWGFIGKVDKEGKADPSEYKYLLYKHIQFDVLYNKDRVIEVSVRMDPHSLLDLTEEKEVDAEFLYTVKWKETDTPFEKRMEKYSLSSSLPHHLEIHWFSIINSCVTVLLLTGFLATILMRVLKNDFVKYAQDEEAADDQEETGWKYIHGDVFRYPKYKSLFAAALGSGTQLFTLTVFIFVLALVGVFYPYNRGALFTALVVIYALTSGIAGYTASSFYCQLEGNNWVRNLLLTGCLFCGPLFITFCFLNTVAIVYSATAALPFGTIVVIVLIWTLVTSPLLVLGGIAGKNSKAEFQAPCRTTKYPREIPQLPWYRSALPQMAMAGFLPFSAIYIELYYIFASVWGHRIYTIYSILFIVFIILLIVTAFITVALTYFQLAAEDHEWWWRSFLCGGSTGLFIYAYCLYYYHARSDMSGFMQTSFFFGYMACICYGFFLMLGTVGFRASLFFIRHIYRSIKCE

SEQ ID NO: 3969 - protein, 594 aa, Gossypium hirsutum
MKNMGDFPTFLVVGLLIFSCLSYVRSDASDHRYKDGDAVPLYANKVGPFHNPSETYRYFDLPFCSPDHVTEKREALGEVLNGDRLVSAPYKLNFKEEKDSSVVCKKQLSKDEVAFFRKAVDKDYYFQMYYDDLPIWGFIGKVDKEGKTDPSEYKYFLFKHIQFDVLYNKDRVIEVNARMDPHSLVDLTEDKEVDAEFMYSAKWKETETPFEKRMDKYSMSSSLPHHLEIHWFSIINSCVTVLLLTGFLATILLRVLKNDFIKYGQDEEAADDQEETGWKYIHGDVFRFPKYKSLFAAALGSGTQLFTLTVFIFMLALVGVFYPYNRGALFTALVVIYALTSGIAGYTATSFYCQLEGNNWVRNLLLTGCLFCGPLFLTFCFLNTVAIVYSATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGIFIYAYCLYYYYARSDMSGFMQTSFFFGYMACICYGFFLMLGTVGFRASLLFVRHIYRSIKCE

SEQ ID NO: 3970 - protein, 592 aa, Glycine max
MGRSTLALVLAILISLQGTPHVRSDASDHRYKDGDSVPLYANKVGPFHNPSETYRYFDLPFCVTGHEKDKTEALGEVLNGDRLVSAPYELSFKKEKDSKVVCKRKLTKEQVAQFREAVKKDYYFQMYYDDLPIWGFIGTVDKEGKTDPSEYKYFLYKHIQFDIHYNKDRVIEISARMDPHSVVDLTEDKDVDVEFVYTAKWKETETPFEKRMDKYSQSSSLPHHLEIHWFSIINSCVTVLLLTGFLATILMRVLKNDFMKYAQDEEAADDQEETGWKYIHGDVFRFPKFKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 3971 - protein, 593 aa, Citrus sinensis
MSDSSFRILIIGVLIACSLTHVRSDASDHRYKVGDVVPLYANKVGPFHNPSETYRYFDLPFCSPDGIIKEKREALGEVLNGDRLVSAPYKLNFRDEKDSAVACRKKLSEQDVAQFRSAVEKDFYFQMYYDDLPIWGFIGKVDKEGKTHPSEYKYFLYKHIQFDILYNKDRVIEISARMDPHSLVDLTEDKEVDVEFMYSVKWKETDTPFEKRMEKYSLSSSLPHHLEIHWFSIINSCVTVLLLTGFLATILMRVLKNDFVKYAQDEEAADDQEETGWKYIHGDVFRFPKYKSLFAAALGSGSQLFTLTVFIFMLALVGVFYPYNRGALFTALVVIYALTSGIAGYTAASFYCQLEGTNWVRNLLLTGCLFCGPLFLTFCFLNTVAIAYNATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGVFIYAYCLYYYYARSDMSGFMQTSFFFGYMACVCYGFFLMLGTVGFRASLLFVRHIYRSIKCE

SEQ ID NO: 3972 - protein, 593 aa, Citrus clementina
MSDSSFRILIIGVLIACSLTHVRSDASDHRYKVGDVVPLYANKVGPFHNPSETYRYFDLPFCSPDGIIKEKREALGEVLNGDRLVSAPYKLNFRDEKDSAVACRKKLSEQDVAQFRSAVEKDFYFQMYYDDLPIWGFIGKVDKEGKTHPNEYKYFLYKHIQFDILYNKDRVIEISARMDPHSLVDLTEDKEVDVEFMYSVKWKETDTPFEKRMEKYSLSSSLPHHLEIHWFSIINSCVTVLLLTGFLATILMRVLKNDFVKYAQDEEAADDQEETGWKYIHGDVFRFPKYKSLFAAALGSGSQLFTLTVFIFMLALVGVFYPYNRGALFTALVVIYALTSGIAGYTAASFYCQLEGTNWVRNLLLTGCLFCGPLFLTFCFLNTVAIAYNATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGAFIYAYCLYYYYARSDMSGFMQTSFFFGYMACICYGFFLMLGTVGFRASLLFVRHIYRSIKCE

SEQ ID NO: 3973 - protein, 591 aa, Glycine max
MGRSTLALVLAILISFQGTHVRSDASDHRYKDGDSVPLYANKVGPFHNPSETYRYFDLPFCVTGHEKEKTEALGEVLNGDRLVSAPYELSFKKEKDSKVVCKRKLTKEQVAQFREAVKKDYYFQMYYDDLPIWGFIGTIDKEGKTDPSEYKYFLYKHIQFDILYNKDRVIEISARMDPHSVVDLTEDKDVDVEFMYTAKWKETDTSFEKRMDKYSQSSSLPHHLEIHWFSIINSCVTVLLLTGFLATILMRVLKNDFMKYAQDEEAADDQEETGWKYIHGDVFRFPKHKSFFSAALGSGTQLFTLTIFIFMLALVGVFYPYNRGALFTALVVIYALTSGIAGYTATSFYIQLEGTNWVRNLLLTGCLFCGPLFLMFCFLNTVAIAYSATAALPFGTIVVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 3974 - protein, 593 aa, Citrus clementina
MSDSPITLLVVGVLIACCLTHVRSDSSDHRFKVGDPVPLYANKVGPFHNPSETYRYFDLPFCSPDAIIKEKREALGEVLNGDRLVSAPYKLNFRDEKDSALACRKKLSEQDVAQFRSAVEKDFYFQMYYDDLPIWGFIGKVDKEGKTHPSEYKYFLYKHIQFDILYNKDRVIEISARMDPHSLVDLTEDKEVDVEFMYSVKWKETDTPFEKRMEKYSLSSSLPHHLEIHWFSIINSCVTVLLLTGFLATILMRVLKNDFVKYAQDEEAADDQEETGWKYIHGDVFRFPKYKSLFAAALGSGSQLFTLTVFIFMLALVGVFYPYNRGALFTALVVIYALTSGIAGYTAASFYCQLEGTNWVRNLLLTGCLFCGPLFLTFCFLNTVAIAYNATAALPFGTIVVIVLIWTLVTSPLLVLGGIAGKNSKAEFQAPCRTTKYPREIPPLPWYRSAIPQMAMAGFLPFSAIYIELYYIFASVWGHRIYTIYSILFIVFIILLIVTAFITVALTYFQLAAEDHEWWWRSFLCGGSTGVFIYAYCLYYYYARSDMSGFMQTSFFFGYMACVCYGFFLMLGTVGFRASLLFVRHIYKSIKCE

SEQ ID NO: 3975 - protein, 592 aa, Trigonella foenum-graecum
MGRSVVWIHLLLLISLLAATHVRSDASNHRYSDGDPVPLYANKVGPFHNPSETYRYLDLPFCVTGHEKEKTEALGEVLNGDRLVSAPYELKFRKEKDSKVVCKKTLTREQVNQFREAVKKDYYFQMYYDDLPIWGFIGTVDKEGKTDPSEYKYFLYKHIQFDVLYNKDRVIEISARMDPHSVVDLTDDKEVDVEFMYTVKWKETDIPFEKRMEKYSQSSSLPHHLEIHWFSIINSCVTVLLLTGFLATILMRVLKNDFMKYAQDEEAADDQEETGWKYIHGDVFRFPKYKSIFAAALGSGTQLFTLTIFIFMLALVGVFYPYNRGALFTALVVIYALTSGIAGYIATSFYIQLEGTNWVRNLLLTGCLFCGPLFLMFCFLNTVAIAYSATAALPFGTICVIVLIWTLVTSPLLVLGGIAGKNSKTEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGSVGFRASLLFVRHIYRSIKCE

SEQ ID NO: 3976 - protein, 593 aa, Cajanus cajan
MGRRRSTLALVLAILISLHGTHVRSDASDHRYKEGDPVPFYANKVGPFHNPSETYRFFDLPFCVTGHEREKTEALGEVLNGDRLVSAPYELNFRTEKDSNLVCKRKLTKEQVAQFREAVKKDYYFQMYYDDLPIWGFIGTVDKEGKTDPSEYKYFLYKHIQFDILYNKDRVIEISARMDPHSVVDLTEDKDVDVEFLYTAKWKETDTPFEKRMEKYSQSSSLPHHLEIHWFSIINSCVTVLLLTGFLATILMRVLKNDFMKYAQDEEAADDQEETGWKYIHGDVFRFPKYKSLFAASLGSGTQLFTLTIFIFMLALVGVFYPYNRGALFTALVVIYALTSGIAGYTATSFYIQLEGSNWVRNLLLTGCLFCGPLFLMFCFLNTVAIVYSATAALPFGTILVILLIWTLVTSPLLVLGGIAGKNSKAEFQAPVRTTKYPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMLCICYGFFLMLGSVGFRASLLFVRHIYRSIKCE

SEQ ID NO: 3977 - protein, 589 aa, Brassica napus
MKMLLLLLGALVLSSVGYVRSDASDHRYKEGDIVPLYANKVGPFHNPSETYRYFDLPFCVPEGVKEKKEAFGEVLNGDRLVSAPYKLNFRDEKDSEVYCKKKLSKEEVKKFRQAVEKDYYFQMYYDDLPIWGFIGKVDKEIKSDPSEYKYFLYKHIEFEILYNNDRVIEISARMDPHSLVDLTEDKEVDAEFMYTVKWKETETPFEKRMDKYSMSSSLPHHLEIHWFSIINSCVTVLLLTGFLATILMRVLKNDFTKYAQDEEAADDLEETGWKYIHGDVFRFPTHNSLFAASLGSGTQLFTLTIFIFMLALVGVFYPYNRGALFTALVVIYALTSGIAGYTSASFYCQLEGKSWVRNLLLTGCLFCGPLLLTFCFLNTVAITYTATAALPFGTIVVIVLIWTLVTSPLLVLGGIAGKNSKAEFQAPCRTTKYPREIPPLPWYRSAVPQMAMAGFLPFSAIYIELYYIFASVWGHRIYTIYSILFIVFIILIIVTAFITVALTYFQLAAEDHQWWWRSFLCGGSTGLFIYAYCLYYYYARSDMSGFMQTSFFFGYMACICYGFFLMLGTVGFRAALFFVRHIYRSIKCE

SEQ ID NO: 3978 - protein, 592 aa, Mimulus guttatus
MARGGEWRAVVLLLLCTAFPAARSDGSDHKYKVGDPVPLYANKVGPFHNPSETYRYFDLPFCSPGDVKDKSEALGEVLNGDRLVSAPYKLDFLADRESEVICKKQLSKEEVAVFRSAVAKDYYFQMYYDDLPIWGFLGKVDKEGKADPSEYKYYLFKHLHFEIFYNKDRVIEINARTDPSALVDLTEDKEVDVEFVYSAKWKETNIAFEKRMEKYSHSSSLPRHLEIHWFSIINSCVTVLLLTGFLATILMRVLKNDFVKYAHDEEAADDQEETGWKYIHGDVFRFPKYKSLFAAALGSGTQLFTLATFIFLLALVGVFYPYNRGALFTALVVIYALTSGIAGYTAAAFYCQLEGTNWVRNLLLTGGLFCGPLFLTFCFLNTVAIAYHATAALPFGTIVVIFLIWALVTSPLLVLGGIAGKNSKAEFQAPVRTTKYPREIPPLPWYRSTVPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMASVCYAFFLMLGAVGFRASLFFVRHIYRSIKCE

SEQ ID NO: 3979 - protein, 592 aa, Mimulus guttatus
MAIGGEWHVVVLLLLCTAFPAVRSDASDHKFKVGDPVPLYANKVGPFHNPSETYRYFDLPFCSPGNVKDKSEALGEVLNGDRLVSAPYKLDFLADKESEVICKKHLSKEEVAVFRSAVAKDYYFQMYYDDLPIWGFLGKVDKEGKADPSEYKYHLFKHLHFEIFYNKDRVIEINARTDPNALVDLTDDKEVDVEFVFSAKWKETNIEFDKRMEKYSHSSSLPRHLEIHWFSIINSCVTVLLLTGFLATILMRVLKNDFVKYAHDEEAADDQEETGWKYIHGDVFRFPKYKSLFAAALGSGTQLFTLTTFIFLLALVGVFYPYNRGALFTALVVIYALTSGIAGYTASSFYCQLEGTNWVRNLLLSGGLFCGPLFLTFCFLNTVAIAYHATAALPFGTIVVIFLIWALVTSPLLVLGGIAGKNSKAEFQAPVRTTKYPREIPPLPWYRSTVPQMAMAGFLPFSAIYIELYYIFASVWGHRIYTIYSILFIVFIILLIVTAFITVALTYFQLAAEDHEWWWRSFLCGGSTGLFIYSYCLYYYYARSDMSGFMQTSFFFGYMACVCYAFFLMLGAVGFRAALFFVRHIYRSIKCE

SEQ ID NO: 3980 - protein, 588 aa, Ricinus communis
MNDNNPFIILVVSVLIIACSVTHVRSDASDHRYKDGDPVPLYANKVGPFHNPSETYRYFDLPFCVPDHLKEKTEALGEVLNGDRLVSAPYKLNFRDEKDTAVVCRKKLTKEEVGRFRSAVDKDYYFQMYYDDLPVWGFIGKIDKQDNKYFLYKHIQFDVLYNKDRVIEVNTRMDPQSLLDLTEDKNVDAEFLYTVKWKETDIPFEKRMDKYSFSSSLPHHLEIHWFSIINSCVTVLLLTGFLATILMRVLKNDFMKYAQDEEAADDQEETGWKYIHGDVFRYPKYKSLFAAALGSGTQLFALTVFIFMLALVGVFYPYNRGALFTALVVIYALTSGIAGYTATSFYYQLEGTNWVRNLLLTGCLFCGPLFLTFCFLNTVAIIYSATAALPFGTILVILLIWTLVTSPLLVLGGIAGKNSKAEFQAPCRTTKYPREVPQLPWYRSALPQMGMAGFLPFSAIYIELYYIFASVWGHRIYTIYSILFIVFIILLIVTAFITVALTYFQLAAEDHEWWWRSFLCGGSTGLFIYAYCLYYYYARSDMSGFMQTSFFFGYMACICYGFFLMLGTVGFRASLLFVRHIYRSIKCE

SEQ ID NO: 3981 - protein, 592 aa, Orobanche aegyptiaca
MTTRGGWHVVVLLVLCIAIRAVRSDGSDHKYKVGDAVPLYANKVGPFHNPSETYRYFDLPFCSPGNVKDKSEALGEVLNGDRLVSAPYKLDFLVDKESEVICKKQLSKKEIAEFRSAVAKDYYFQMYYDDLPIWGFLGKVDKEGKADPSEYKYYLFKHLHFEIFYNKDRVIEINARTDPGALVDLTDDKEVDVEFMYSAKWKETNIDFEKRMEKYSHSSSLPRHLEIHWFSIINSCVTVLLLTGFLATILMRVLKNDFVKYAHDEETADDQEETGWKYIHGDVFRFPKYKSLFAAALGSGTQLFTLATFIFLLALVGVFYPYNRGALFTALVVIYALTSGIAGYTAASFYCQLEGTNWVRNLLLTGGLFCGPLFLTFCFLNTVAIAYHATAALPFGTIVVIFLIWALVTSPLLVLGGIAGKNSKAEFQAPCRTTKYPREIPPLPWYRGTLPQMAMAGFLPFSAIYIELYYIFASVWGHRIYTIYSILFIVFIILLIVTAFITVALTYFQLAAEDHEWWWRAFLCGGSTGLFIYGYCLYYYYARSDMSGFMQTSFFFGYMACVCYAFFLMLGAVGFRAALFFVRHIYRSIKCE

SEQ ID NO: 3982 - protein, 592 aa, Euonymus alatus
MEKRIMACIVAAVLILCGVSQVRSDASDHRFKVGDDVPLYANKVGPFHNPSETYRYFDLPFCSSAPVKEKKEALGEVLNGDRLVSAPYKLDFLNEKESEVACKRRLTKEEVVQFRRAVSKDYYFQMYYDDLPIWGFLGKVDKEGKSDPSEYKYYLFKHLIFNIFYNKDRVIEITVQSDQNSLVDITEDKEVEVEFTYTVKWKETEIPFEKRMDKYSQSSSLPHHLEIHWFSIINSCVTVLLLTGFLATILMRVLKNDFSKYAHDEESADDQEETGWKYIHGDVFRYPKYKSLLAAALGSGTQLFTLAIFIFMLALVGVFYPYNRGALFTALVVIYALTSGIAGYTAASFYCQLEGTNWVRNLLLTGSLFCGPLFLTFCFLNTVAIAYSATAALPFGTIVVIFLILTLVTTPLLVLGGIAGKNSKAEFQAPCRTTKYPREIPPLPWYRKSLPQMAMSGFLPFSAIYIELYYIFASVWGHRIYTIYSILFIVFIILLIVTAFITVALTYFQLAAEDHDWWWRSFLCGGSTGLFIYGYCLYYYYARSDMSGFMQTSFFFGYMACICYGFLLMLGTVGFRASLFFVRHIYRSIKCE

SEQ ID NO: 3983 - protein, 592 aa, Quercus alba
MKKTIVIVAALVIISCYGITEVRSDASDHRYKEGDPVPLYANKVGPFHNPSETYRYFDLPFCSSGHVTEKKEALGEVLNGDRLVSAPYKLDFKKDKDTEVACKRKLSKDDVTHFRNAVQKDYYFQMYYDDLPIWGFIGKVEKEGKVDPSEYKYFLFKHIQFEVSYNKDRVIEIMAHMDPQSVVDLTEDKEVEAEFMYTVKWKETEIPFEKRMEKYSQSSSLPHHLEIHWFSIINSCVTVLLLTGFLATILMRVLKNDFMKYAQDEEAADDQEETGWKYIHGDVFRFPKYKSLFAAALGSGSQLFTLTVFIFMLALVGVFYPYNRGALFTALVVIYALTSGIAGYTASSFYCQLEGKNWVRNLLLTGCLFCGPLFLTFCFLNTVAIAYSATAALPFGTIVVIVLIWTLVTSPLLVLGGIAGKNSKAEFQAPCRTTKYPREIPPLPWYRSTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGAVGFRASLLFVRHIYRSIKCE

SEQ ID NO: 3984 - protein, 592 aa, Eucalyptus grandis
MAKKTIAPILGLAVVALCLAPAAVSSPSNHRYEERDPVPLYANKVGPFHNPSETYRYFDLPYCTPDQMKDKKEALGEVLNGDRLVSAPFDLNFLTNKEYEVVCKKTLSKAEVARFRSAIIQDYYFQMYYDDLPIWGFIGKVDKEDRDPSEYKYLLYKHIIFEIFYNKNRVIEINVRTDPNSVADLTEDKEVDFQFMYSAKWKETTITFEKRMDKYSHSSSLPHHLEIHWFSIVNSCVTVLLLTGFLATILMRVLKNDFVKYAHDEESAEDEEETGWKYLHGDVFRFPKYKSLFAAAVGSGTQLFTLTVFIFILALVGVFYPYNRGALFTALVVIYALTSGIAGYTATSFYCQLEGTNWVRNLLLTGCLFCGPLFLTFCFLNTVAIAYTATAALPFGTILVIVLIWTLVTSPLLILGGIAGKNSKAEFQAPCRTTKYPREIPPLPWYRGTIPQMAMAGFLPFSAIYIELYYIFASVWGHRIYTIYSILFVVFIILLIVTAFITVALTYFQLAAEDHKWWWRSFLCGGSTGLFIYGYCLYYYYARSDMSGFMQTSFFFGYMACICYGFFLMLGTVGFRAALLFIRHIYRSIKCE

SEQ ID NO: 3985 - protein, 598 aa, Eucalyptus grandis
MRKEPSAGRRSLLAAIAALAIASLAIGARSDASDHRYKDGEVVPLYANKVGPFHNPSETYRFFDLPFCSPDNVKDKPEALGEVLNGDRLVSAPYKLNFKEEHDSKVVCSKKLSKEEVARFRAAVKKDYYFQMYYDDLPIWGFIGKVEKEGKGDPSEYKYFLYKHIQFDILYNKDRVIEISARMDPHSVVDLTEDKDVDVEFMYTVKWKETETPFEKRMDKYSHSSSLPHHLEIHWFSIINSCVTVLLLTGFLATILMRVLKNDFVKYAQDEEAADDQEETGWKYIHGDVFRYPKHKSLFAAALGSGTQLFTLTVFIFMLALVGVFYPYNRGALFTALVVIYALTSGIAGYTATSFYCQLEGPNWVRNLLLTGCLFCGPLFLTFCFLNTVAIAYNSTAALPFGTIVVIFLIWTLVTAPLLVLGGIAGKNSKAEFQAPCRTTKYPREIPPLPWYRSTVPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGMVGFRASLLFVRHIYKSIKCE

SEQ ID NO: 3986 - protein, 593 aa, Valeriana officinalis
MMMMMIRFVAVAVLIICSSIQVVRSDGSNHKYKAGDQVPLYANKVGPFHNPSETYRFFDLPFCSPAHVKEKREALGEVLNGDRLVSAPYKLDFLVEKDSETLCKKKLSKEEVSQFRAAVTKDYYFQMYYDDLPVWGFLGKVDKEDKSDPSEFKYYLFKHLHFEILYNKDRVIEINARTDPNALVDLTEDKEIDVDFMYTVKWKETDIPFDKRMDKYSSTSSLPHHLEIHWFSIINSCVTVLLLTGFLATILMRVLKNDFVKYAHDEEAADDEEETGWKYIHGDVFRYPKYKSLFAAAYGSGTQLFTLSIFIFILALVGVFYPYNRGALFTALVVIYALTSGIAGYTASSFYHQLEGSNWVRNLLLTGCLFCGPLFLTFCFLNTVAIAYSATAALPFGTIVVIVLIWSLVTSPLLVLGGIAGKNSKADFQAPCRTTKYPREIPPLPWYRGTVPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTLGFRAALFFVRHIYRSIKCE

SEQ ID NO: 3987 - protein, 595 aa, Amsonia hubrichtii
MEKKKHRMVRWQVIVFLVMSMVAVARSDGSDHKYKAKDQVPLYANKVGPFQNPSETYRFFDLPFCSPDHVKEKKEALGEVLNGDRLVSAPYKLDFLVDKDSETVCKKKLTKDEVKLFRNAVTKDYYFQMYYDDLPVWGFLGKVDKEGKSDPSEYKYYLFKHLHFEIFYNKDRVIEINARTDPSALVDITEDKNVDVEFLYSVKWKETNIPFEKRMEKYSKTSALPHHLEIHWFSIINSCVTVLLLTGFLATILMRVLKNDFVKYAHDEETADDQEETGWKYIHGDVFRYPKYKSLFAAALGCGTQLFIMATFIFILALVGVFYPYNRGALFTALVVIYALTSGIAGYTAASFYCQLEGTNWVRNVLLTGALFCGPLFLTFCFLNTVAIAYSATAALPFGTIVVIFLIWALVTSPLLVLGGVAGKNSKAEFQAPCRTTKYPREIPPLPWYRSTLPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRASLFFVRHIYRSIKCE

SEQ ID NO: 3988 - protein, 589 aa, Zostera marina
MATMRSWSAFLLVLLVGLVRSDSSDHRYKPGDFVPLYANKVGPFHNPSETYRYFDLPFCSPEHVKEKKEALGEVLNGDRLVDAPYKLDFQTDVESKLVCKKSLSKEQVSQFRNAVNKDYYSQMYYDDLPIWGFIGKVEKDAKGDPTESKYFLYRHIHFDILYNNNHVIEINVRMDPNALVDVTDDRQVDVDFLYSVKWKETTTPFEKRMEKYSQSSSLPHHLEIHWFSIINSCVTVLLLTGFLATILMRVLKNDFVKYDRDEEAVDDQEESGWKYIHGDVFRFPKNNSLISACLGSGTQLFTLTIFIFILALVGVFYPYNRGALFTALVVIYALTSGIAGYTATSFYCQLEGTNWVRNLLLTGCLFCGPLFFTFCFLNTVAIVYSATAALPFGTIVVIVLIWTLVTSPLLVLGGIAGKNSKAEFQAPVRTTKYPREIPSLPWYRGTIPQMAMAGFLPFSAIYIELYYIFASVWGHRIYTIYSILSIVFVILIIVTAFITVALTYFQLASEDHGWWWRSFLCGGSTGLFVYGYCLYYYYARSDMSGFMQTSFFFGYMACICYGFFLMLGTVGFHASLFFVRHIYKSIKCE

SEQ ID NO: 3989 - protein, 592 aa, Gossypium raimondii
MDRIRAFLVAVAIVTLCGVPQVRSTASDHRYKAGDEVPLYANKVGPYHNPSETYRYFDFPFCSSAPVKEKKEALGEVLNGDRLVSAPYKLEFLTEKEAEIACKRKLTREEVVKFRKAVSKDYYFQMYYDDLPIWGFLGKVEKEGKTDPADYKYYLFKHLVFEIHHNKDRVIEVTVRSDPNALVDLTEDVPVDVDFMYTVKWKETNTPFEKRMDKYSLSSSLPHHLEIHWFSIINSCVTVLLLTGFLATILMRVLKNDFIKYAHDEESADDQEESGWKYIHGDVFRYPKHKSLFAAALGSGTQLFTLTSFIFILALVGVFYPYNRGALFTALVVIYALTSGIAGYTAASFYCQLEGTNWVRNLLLTGSLFCGPLFVTFCFLNTVAIAYKATAALPFGTIVVIFLIWALVTSPLLVLGGIAGKNSKAEFQAPCRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGLFIYTYCLYYYNARSDMSGFMQTSFFFGYMACICYGFFLMLGAIGFRASLLFVRHIYRSIKCE

SEQ ID NO: 3990 - protein, 240 aa, Euonymus alatus
EKKRKNTEEKRIMACIVAAVLILCGLSQVRSDASDHRFKVGDDVPLYANKVGPFHNPSETYRYFDLPFCSSAPVKEKKEALGEVLNGDRLVSAPYKLDFLNEKESDVACKRRLTKEQVTQFRRAVSKDYYFQMYYDDLPIWGFLGRVDKEGKSDPSEYKYYLFRHLIFNIFYNKDRVIEITVQSDPNSLVDITEDKEVEVEFTYTVKWKETEIPFREEDGEVFTVFFTATSLGNPLVLNN

SEQ ID NO: 3991 - protein, 596 aa, Elaeis guineensis
MGRKKAMVLVAVLVAVFLLCFGIAGVAADASDHRYKAGEPVPLYANKVGPFHNPSETYRYFDLPFCSPEHVKEKSEALGEVLNGDRLVDAPYKLDFRVDLDSKVVCTKKLKSEEVAQFRSAVLKDYYFQMYYDDLPIWGFIGKVDREGKTDENEYKYYLYRHIHFDVLYNGDRVIEINAHTDPNALVDVTKDREIEVEFLYSVKWRETSTPFENRMDKYSQTSSLPHHLEIHWFSIINSCVTVLLLTGFLATILMRVLKNDFVKYAHDEESAEDQEETGWKYIHGDVFRFPKHKSLFAACVGSGTQLFALTIFIFILALVGVFYPYNRGALFTALVVIYALTSGIAGYISTSFYFQLEGTNWVRNLLMTGCLFCGPLFLTFCFLNTVAIIYSATAALPFGTILVILLIWTLVTSPLLVLGGIAGKNSKAEFQAPCRTTKYPREIPPLPWYRGTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACVCYGFFLMLGSIGFRAALLFVRHIYRSIKCE

SEQ ID NO: 3992 - protein, 467 aa, Tropaeolum majus
MYYDDLPIWGFLGKLDKEGKTDPTEFKYYLFNHLQFEIFYNKDRVIEISVRSDPHSIVDLTEDKEVDVDFTYTVRWKETETPFEKRMEKYSHSSSLPHHLEIHWFSIINSCVTVLLLTGFLATILMRVLKNDFVKYAHDEEAADDQEETGWKYIHGDVFRYPKHNSLFAAALGSGSQLFALTIFIFMLALVGVFYPYNRGALFTALVVMYALTSGIAGYIAASFYCQLEGTNWVRNLLLTGGLFCGPLFLTFCFLNTVAIAYNATAALPFGTIVVIFLIWTLVTSPLLILGGIAGKNSKAEFQAPCRTTKYPREIPPLPWYRRALPQMAMAGFLPFSAIYIELYYIFASVWGHRIYTIYSILFIVFIILLIVTAFITVALTYFQLAAEDHAWWWRSFLCGGSTGLFIYAYCLYYYFARSDMSGFMQTSFFFGYMACICYGFFLMLGTIGFRAALLFVRHIYRSIKCE

SEQ ID NO: 3993 - protein, 591 aa, Gossypium hirsutum
MDRIRAFLVAVAVVAICGVPQVRSTASDHRYKAGDEVPLYANKVGPYHNPSETYRYFDFPFCSSAPVKEKKEALGEVLNGDRLVSAPYKLEFLTEKEAEIACKRKLTKEEVVKFRKAVSKDYYFQMYYDDLPIWGFLGKVERRKTDPADYKYYLFKHLVFEIHHNKDRVIEVTVRSDPNALVDLTEDVPVDVDFMYTVKWKETNTPFEKRMDKYSLSSSLPHHLEIHWFSIINSCVTVLLLTGFLATILMRVLKNDFIKYAHDEESADDQEESGWKYIHGDVFRYPKHKSLFAAALGSGTQLFTLTSFIFILALVGVFYPYNRGALFTALVVIYALTSGIAGYTAASFYCQLEGTNWVRNLLLTGSLFCGPLFVTFCFLNTVAIAYKATAALPFGTIVVIFLIWALVTSPLLVLGGIAGKNSKAEFQAPCRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGLFIYTYCLYYYNARSDMSGFMQTSFFFGYMACICYGFFLMLGAIGFRASLLFVRHIYRSIKCE

SEQ ID NO: 3994 - protein, 596 aa, Zostera marina
MRGMRLTDRVSLATLAIFLIFLSREVSSDGSNHRYSTGDAVPLYANKVGPFHNPSETYRYFDLPFCTPEHVKEKLEALGEVLNGDRLVDAPYKLDFLTDLDSKVLCKKKLSVQEVKKFRSAVNKDYYFQMYYDDLPLWGFIGKMEKDASGDPNESKSFLYRHIQFDILYNKNRVIEINVRTDPNAMVDVTEDREVDVEFLYSVKWKETNTPFEKRMEKYSQSSSLPHHLEIHWFSIINSCVTVLLLTGFLATILMRVLKNDFVKYAHDDEAVEDQEETGWKYIHGDVFRFPQNKSLFAACLGSGTQLFALTIFIFILALVGVFYPYNRGALFTALVVIYALTSGIAGYVATSFYCQLEGSNWVRNLLLTGCLFCGPLFLTFCFLNTVAIVYSATAALPFGTIVVIVLIWTLVTSPLLVLGGIAGKNSKAEFQAPVRTKKYPREIPPSPWYRGTVPQMAMAGFLPFSAIYIELYYIFASVWGHRIYTIYSILFIVFIILLIVTAFITVALTYFQLAAEDHKWWWRSFLCGGSTGLFIYGYCLYYYHARSDMSGFMQTSFFFGYMACICYGFFLMLGSVGFRASLFFIRHIYKSVKCE

SEQ ID NO: 3995 - protein, 593 aa, Unknown
  Sequence found in Organisms: Hordeum vulgare, Secale cereale, Triticum aestivum
MASPAARAASALLLLLALAVAGVLSDGSDHRYKLGDPVPLYANKVGPFHNPSETYRYFDLPFCSPEKVKEKSEALGEVLNGDRLVDAPYKLDFRTDHDSKAVCPKKLTKEDVAKFRNAVAKDYYFQMYYDDLPLWGFIGKVEKGGKPDPSEWKYYLYRHIIFDILYNNDRVIEINVHTDQSALVDLTEDKEVNVDFLYTVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRTTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 3996 - protein, 589 aa, Valeriana officinalis
MRWLAVVLVVVVAICSVPEVKSDGSDHKYKVADQVPLYANKVGPFQNPSETYRYFDLPFCLPAHLKEKKEALGEVLNGDRLVSAPYKLDFLVEKDGEIICNKKLTKEEVAQFRSAIAKDYYFQMYYDDLPLWGFLGKHEKEKDDPNESKYYLFKHLHFDIQYNNDRVIEVNVRTDPNALVDLTEDKEVDADFMYSVKWKETDTPFEKRMEKYSFISSLPHHLEIHWFSIINSCVTVLLLTGFLATILMRVLKNDFVKYAHDEETAEEQEETGWKYIHGDVFRYPKYKSLFAAALGSGTQLFILAIFIFILALVGVFYPYNRGALFTALVVIYALTSGIAGYTGVSFYCQLEGTNWVRNLLLTGCLFCGPLFLTFCFLNTVAIAYSATAALPVGTILVIVLIWALVTSPLLVLGGIAGKNSKSEFQAPCRTTKYPREIPQLPWYRATIPQMAMAGFLPFSAIYIELYYIFASVWGHRIYTIYSILFIVFIILLIVTAFITVALTYFQLAAEDHKWWWRSFLCGGSTGLFIYGYCLYYYYGRSDMSGFMQTSFFFGYMACICYGFFLMLGAVGFRASLVFVRHIYRSIKCE

SEQ ID NO: 3997 - protein, 593 aa, Setaria italica
MAASPAAAAALLALLALAAAGGVAADGSDHRYKAGEPVPLYANKVGPFHNPSETYRYFDLPFCSPEKVREKSEALGEVLNGDRLVDAPYKLDFRVDLDSRSVCSKKLTTEDVAKFRNAVAKDYYFQMYYDDLPLWGFIGKVDKEGKADPSEWKYYLYKHIIFDILFNNDRVIEINVHTDQSALVDLTEDKETNVEFLYSVKWKETLTPFEKRMEKYSSSSNLPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKTEFQAPCRTTKYPREIPPLPWYRQTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 3998 - protein, 597 aa, Elaeis guineensis
MGKEKAMDLAAVAAVTTLLLCLGITGVAADASDHRYKAGEAVPLYANKVGPFHNPSETYRYFDLPFCPPEHMKEKSEALGEVLNGDRLVDAPYKLDFRVDLDSKAVCKKKLTIEEVAQFRSAVLKDYYFQMYYDDLPIWGFIGKVDREGKTDEDEYKYYLYRHIHFDILYNGDRVIEINVHTDPNALADVTTDKEIEVEFLYSVKWKETSTPFENRMEKYSQSSSLPHHLEIHWFSIINSCVTVLLLTGFLATILMRVLKNDFVKYAHDEESAEDQEETGWKYIHGDVFRFPKHKSLFAACIGSGTQLFALAIFIFILALVGVFYPYNRGALFTALVVIYALTSGIAGYISTSFYFQLEGTNWVRNLLMTGFLFCGPLFLTFCFLNTVAIIYSATAALPFGTILVILLIWMLVTFPLLVLGGVAGKNSKVEFQAPCRTTKYPREIPPLPWYRATIPQMAMAGFLPFSAIYIELYYIFASIWGHRIYTIYSILFIVFIILLIVTAFITVALTYFQLAAEDHEWWWRAFLCGGSTGLFIYGYCLYYYYARSDMSGFMQTSFFFGYMACICYGFFLMLGTIGFRASLLFVRHIYRSIKCE

SEQ ID NO: 3999 - protein, 595 aa, Centaurea maculosa
MLKKKMVVIRWWLLVALLVVSPIQQVRSGSSDHKYKPNDEVPIYANKVGPFHNPSETYRFFDLPFCLPAHLKEKPEALGEVLNGDRLVSAPYKLPFMVEKDSEIVCRKKLTKEEVSKFRSAVAKDYYFQMYYDDLPFWGFLGKVEKDKTDPSEEKYYLFKHLHFEIHYNKDRVIEINAKADPNAVVDLTEDKELEVEFMYTVRWKETDIPFENRMEKYSQSSSQPHHLEIHWFSIINSCVTVLLLTGFLATILMRVLKNDFVKYAHDEEAADDQEETGWKYIHGDVFRYPKYKSLFAASLGSGTQLFSLALFIFALALVGVFYPYNRGALFTALVVIYALTSGIAGYTAASFYHQLEGTNWVRNLLLTGCLFCGPLFLTFCFLNTVAIAYTATAALPFGTIVVIVLIWTLVTSPLLVLGGIAGKNSKAEFQAPVRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGVFIYGYCLYYYYERSDMSGFMQTSFFFGYMACICYGFFLMLGTVGFRASLFFVRHIYRSIKCE

SEQ ID NO: 4000 - protein, 592 aa, Lactuca sativa
MMVKPQIYKWLVLALFVICSVMGAVTSDASNHKYKNGDVVPLYANKVGPFQNPSETYRYFDLPFCLPGDLKEKKEALGEVLNGDRLVSAPYKLDFLVDKDSEFICTKKLTKQEVNKFRKAISKDYYFQMYFDDLPLWGFIGKYEKTELNELKYYLFKHLQFEVLYNKDHVIEVNVRTDPSALVDVTEDKEVNVDFMYTVRWKETNIPFDKRMEKYSQNSSLPHHLEIHWFSIINSCVTVLLLTGFLATILMRVLKNDFVKYAHDEETAEDQEETGWKYIHGDVFRYPKFKSLFAAALGSGTQLFALTIFIFILALVGVFYPYNRGALFTALVVIYALTSGIAGYTASSFYCQLEGTNWVRNLLLTGSLFCGPLFLTFCFLNTVAIAYSATAALPFGTIVVIALIWALVTSPLLVLGGIAGKNSKAEFQAPCRTTKYPREIPPLPWYRGSLPQMAMAGFLPFSAIYIELYYIFASVWGHRIYTIYSILFIVFIILVIVTAFITIALTYFQLAAEDHEWWWRSFVCGGSTGLFIYGYCLYYYYGRSDMTGFMQTSFFFGYMACICYGFFLMLGMIGFRASLFFVRHIYRSIKCE

SEQ ID NO: 4001 - protein, 593 aa, Zea mays
MAALRAPAATLLVLLALAAAGGVAADGSDHRYKIREPVPLYANKVGPFHNPSETYRYFDLPFCSPDKVKEKSEALGEVLNGDRLVDAPYKLDFRDEVESKAVCSKKLTTEDVVKFRNAVAKDYYFQMYYDDLPLWGFIGKVEKGGKDDPSEWKYYLYRHIIFDILYNNDRVIEINVHTDQSALVDLTEDKETNVEFLYSAKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRRTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRASLFFVRHIYKSIKCE

SEQ ID NO: 4002 - protein, 592 aa, Amborella trichopoda
MVVNMGLVGCIFLLFVISGFKVGADGSDHKYKQGDRVPLYANKVGPFHNPSETYRYYDLPFCSPEHVTEKREDLGEVLNGDRLVDAPYQLQFRLERESEVLCKKKLSKDKVAQLRDAVNKDYYFQMYYDDLPIWGFIGKVDKDNKADPSEYRYLLFKHIHFEISYNKDRVIEINVKTDPNFSVDITEDKEVEVEFLYSVKWKETDTPFEKRMDKYSKSSSMPQHLEIHWFSIINSCVTVLLLTGFLATILMRVLKNDFIKYSHDDDAADDQEETGWKYIHGDVFRFPKHKSLFAAVLGSGTQLLALAMFIFLLALVGVFYPYNRGALFTALVVIYALTSGIAGYTATSTYLQLEGTNWVRNLLLTGCLFCGPLFLTFCFLNTVAIVYSATAALPFGTILVILLIWTLVTSPLLVLGGIAGKNSKTEFQAPCRTTKYPREIPPLPWYRSTIPQMAMAGFLPFSAIYIELYYIFASVWGHKIYTIYSILFIVFIILIIVTAFITVALTYFQLAVEDHEWWWRSVLCGGSTGVFILGYCLYYYYARSDMSGFMQTSFFFGYMACICYGFFLMLGTVGFRASLLFVRHIYRSIKCE

SEQ ID NO: 4003 - protein, 589 aa, Aristolochia fimbriata
MKTLPAFVVALCLLSALRVSADGSNHKYKEGDHVPLYANKVGPFHNPSETYRYYDLPFCTPEHVKEKREDLGEVLNGDRLVSAPYQLNFRVDRQSETLCQKTLSREEVAKLRDAVSKDYYFQMYYDDLPFWGFIGKVDKENKLDSSEFKYLLFKHIHFDILYNNDRVIEINVQTDPNLAADITEDKEVVVELSYSVKWKETDIPFEKRMEKYSKSSSMPQHLEIHWFSIINSCVTVLLLTGFLATILMRVLKNDFIKYSHDEESLDDQEETGWKYIHGDVFRFPKYKSLFCAVLGSGTQLLALAIFIFLLALVGVFYPYNRGALFTALVVIYALTSGIAGYTATSMYLQLEGTNWVRNLLLTGCLFCGPLFLTFCFLNTVAIAYSATAALPFGTILVILLIWTLVTSPLLVLGGIAGKNSKAEFQAPCRTTKYPREIPPLPWYRGTIPQMAMAGFLPFSAIYIELYYIFASVWGHKIYTIYSILFIVFIILIIVTAFITVALTYFQLAVEDHEWWWRSVLCGGSTGVFIFGYCLYYYYARSDMSGFMQTSFFFGYMACICYGFFLMLGTVGFRASLLFVRHIYRSIKCE

SEQ ID NO: 4004 - protein, 593 aa, Zea mays
MAASPAAAAALLILFALGAAGGVAADGSDHRYKMYEPVPLYANKVGPFHNPSETYRYFDLPFCSPEKVKEKSEALGEVLNGDRLVDAPYKLDFRSEVESKAVCSKKLTKEDVVKFRNAVAKDYYFQMYYDDLPLWGFIGKVEKGGKADPSEWKYYLYRHIIFDILYNNDRVIEINVHTDQSALVDLTEDKETNVDFLYSVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYSQLEGTNWVRNLLLTGCLFCGPLLLTFCFLNTVAIAYSATAALPFGTICVIVLIWTLVTFPLLVLGGIAGKNSKSEFQAPCRTTKYPREIPPLPWYRRTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 4005 - protein, 593 aa, Saccharum officinarum
MAASPAVAAALLVLLALAAAGGVAADGSDHRYKMNEPVPLYANKVGPFHNPSETYRYFDLPFCSPEKVREKSEALGEVLNGDRLVDAPYKLDFRFEVESKAVCSKKLTVEDVVKFRNAVAKDYYFQMYYDDLPLWGFIGKVEKGGKADPSEWKYYLYRHIIFDILYNNDRVIEINVHTDQSALVDLTEDKETNVEFLYSVKWKETPTPFEKRMEKYSSSSNMPHQLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYIATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRKTIPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 4006 - protein, 595 aa, Sorghum bicolor
MAASPAPAAAAALLVLLALAAAGGVAADGSDHRYKMNEPVPLYANKVGPFHNPSETYRYFDLPFCSPEKVREKSEALGEVLNGDRLVDAPYKLDFRLEVESKAVCSKKLTVEDVVKFRNAVAKDYYFQMYYDDLPLWGFIGKVEKGGKADPSEWKYYLYRHIIFDILYNNDRVIEINVHTDQSALVDLTEDKETNVEFLYSVKWKETPTPFEKRMEKYSSSSNMPHHLEVHWFSIINSCVTVLLLTGFLATILMRVLKNDFVKYAHDEEAADDQEESGWKYIHGDVFRFPKNKSLFSAALGTGTQLFALTTFIFLLALVGVFYPYNRGALFTALVVIYALTSGIAGYVATSFYCQLEGTNWVRNLLLTGCLFCGPLFLTFCFLNTVAIAYSATAALPFGTICVIVLIWTLVTFPLLVLGGIAGKNSKSEFQAPCRTTKYPREIPPLPWYRRTVPQMAMAGFLPFSAIYIELYYIFASVWGHRIYTIYSILFIVFIILLIVTAFITVALTYFQLAAEDHEWWWRSFLCGGSTGFFVYGYCLYYYYARSDMSGFMQTSFFFGYMACICYAFFLMLGMVGFRAALFFVRHIYKSIKCE

SEQ ID NO: 4007 - protein, 617 aa, Amorphophallus konjac
RSPRRGRRSPSRRTWERERERERGGVAKRAAVLVAVSALLVCFGVAGVVGDPSDHRYMQGDPVPLYANKVGPFHNPSETYRYFDLPFCYPENMNEKREALGEVLNGDRLVDAVYKLDFLMDQDSKVVCNKRLTKEEVAQFRNAVSKDYYFQMYYDDLPIWGFVGKVEKDGRDPSDYKYFLYRHIHFEILYNKDRVIEINVKTDPNALVDLTEDRGVDVVFLYTVKWKETTTPFEKRMEKYSHTSSLLHHLEIHWFSIINSCVTVLLLTGFLATILMRVLKNDFVKYAHDEESADDQEETGWKYIHGDVFRFPKNKSLFSACLGSGTQLFTLAIFIFVLALVGVFYPYNRGAFFTALVVIYALTSGIAGYTATSFYCQLEGNNWVRNLLLTGCLFCGPLFLTFCFLNTVAIAYSATAALPFGTIVVIVLIWTLVTFPLLVLGGIAGKNSKAEFQAPVRTSKFPREIPPLPWYRSTIPQMAMAGFLPFSAIYIELYYIFASVWGHRIYTIYSILFIVFIILLIVTAFITVALTYFQLAAEDHEWWWRSFLCGGSTGLFIYGYCLYYYYARSDMSGFMQTSFFFGYMACICYGFFLMLGTVGFRAGLVFVRHIYRSIKCE

SEQ ID NO: 4008 - protein, 590 aa, Ambrosia trifida
MMDNNTLIHQWLLLALLLICSVMTSVTSDVSNHKYKSGDAVPLYANKVGPFQNPSETYRYFDLPFCLPDDLKEKKEALGEVLNGDRLVSAPYKLDFLVDKDSESICSKKLSKKEVEKFRKAISKDYYFQMYFDDLPLWGFIGKYDTKEQKYYLFKHLQFEVRYNKNHVIEVNVQTDPTALVDITQDKEVNVDFVYTVRWKETNIPFKKRMDKYSQNSSLPHHLEIHWFSIINSCVTVLLLTGFLATILMRVLKNDFVKYAHDEEAAEDQEETGWKYIHGDVFRYPQHKSLFAAALGSGTQLFALTIFIFILALVGVFYPYNRGALFTALVVIYALTSGIAGYTASSFYCQLEGTNWVRNLILTGGLFCGPLFITFCFLNTVAISYSATAALPFGTIVIIGLIWALVTSPLLVLGGIAGKNSKAEFQAPCRTTKYPREIPPLPWYRGTLPQMAMAGFLPFSAIYIELYYIFASVWGHRIYTIYSILFIVFIIPVIVTAFITIALTYFQLAAEDHEWWWRSFVCGGSTGLFIYGYCLYYYYGRSDMTGFMQTSFFFGYMACICYGFFLMLGTIGFRAALFFVRHIYRSIKCE

SEQ ID NO: 4009 - protein, 595 aa, Amborella trichopoda
MDAKMAIAGFLLLLFLCSGVTVQSDASNHKYKPGDPVPLYVNKVGPFHNPSETYRYFDLPFCPPAHLTEKKEALGEVLNGDRLVEAAYKLDFRVDKDSDVVCKKRLSRDEVASFRNAVIKDYYFQMIYDDLPLWGFVGKIEKDIKADVPEFRYLLYKHIHFEAIYNKDRIIEISVQAIQGEPNHLVDVTEDKGIDLELTYSVKWKETDTPFEKRMGKYSKTSALPHHLEIHWFSILNSCVTVLLLTGFLATILMRVLKNDFVKYSHDEDVADDQEETGWKYIHGDVFRYPKHKSLFVAILGCGTQLLALAMFIFILSLVGVFYPYNRGALFTALVVIYALTSGIAGYTATSFYSQLEGTNWVRNLLLTGCLFCGPLFLTFCFLNTVAIVYSATAALPFGTIVVIVLIWSLVTSPLLVLGGIAGKNSKAEFQAPCRTTKYPREIPPLPWYRGTIPQMAMAGFLPFSAIYIELHYIFASVWGHKIYTIYSILFIVFIILIIVTAFITVALTYFQLAAEDHEWWWRSLLYGGSTGFFIFGYCLYYYYVRSDMSGFMQTSFFFGYMACICYGFFLMLGTVGFRASLLFVRHIYRSIKCE

SEQ ID NO: 4010 - protein, 595 aa, Eutrema halophilum
MEKPASRVLLPSLLLVLFIYGVAPVISDGSDHRYKVGDDVPLYANKVGPFHNPSETYRYFDLPFCSSAPVKEKKEALGEVLNGDRLVSAPYKLEFLGEKNSEVACRKRLSREDVAKFRDVITKDYYFQMYYDDLPIWGFLGKVVKDGKSDPSEYKYYLFNHLQFEIFYNKDRVIEIIVRTDQNFLVDLTEDKEVEVDFTYTVRWKETEIPFEKRMEKYSLASSMPHHLEIHWFSIINSCVTVLLLTGFLATILMRVLKNDFVKYAHDEEAADDQEETGWKLIHADVFRFPKHKSLLAAALGSGTQLFTLAVFIFMLALVGVFYPYNRGALFTALVVIYALTSGIAGYTAASFYCQLEGTNWVRNLMLTGSLFCGPLLLTFSFLNTVAIAYQATAALPFGTIVVIFLIWALVTSPLLILGGIAGKNRKPEFQAPCRTTKYPREIPPLRWYRRTLPQMAMAGFLPFSAIYIELYYIFASVWGHRIYTIYSILSIVFLILVIVTAFITVALTYFQLASEDHEWWWRSLLCGGSTGLFIYAYCLYYYYARSDMTGFMQTSFFFGYMACICYGFFLMLGAIGFRASLFFVRHIYRSIKCE

SEQ ID NO: 4011 - protein, 587 aa, Pinus taeda
MAMGRFLVLALALAFLFGYGVEGSASDHRYSKGDHVPLYANKVGPFHNPSETYRYFDLPFCPPDKVTEKREDLGEVLNGDRMVGARYKLHFQEDKNSELLCRKKLTKEDLGKFREAVKKDYYFQMYYDDLPIWGFIGKTDKENNANPIFLYKHLHFEILYNNDRVIEITVRTDPNFTVDITEDKEVEVDFTYSVKWVETQTPFERRMDKYSKSSSLPQHLEIHWFSIINSCVTVLLLTGFLATILMRVLKNDFIKYSHDEESTDDQEETGWKYIHGDVFRYPPYKSLFCAVLGSGTQLFTLAIFIFMLALVGVFYPYNRGALYTALVVIYALTSGIAGYTAASFYRQLEGSNWVRNLLLTGCLFCGPLFLTFCFLNTVAIAYNATAALPFGTIVVILLIWTLVTSPLLVLGGIAGKNSKSEFQAPCRTTKYPREIPLLPWYRGTIPQMAMAGFLPFSAIYIELYYIFASVWGHKIYTIYSILFIVFIILIIVTAFITIALTYFQLAVEDHEWWWRSVLCGGSTGVFIFGYCLYYYFARSDMNGFMQTSFFFGYMTCICYGFFLMLGTVGFRASLLFVRHIYRSIKCE

SEQ ID NO: 4012 - protein, 590 aa, Podocarpus macrophillus
MAKLVLVSAFLLLSFLVHNVHGGYSDHKYHDRDHVPLYANKVGPFQNPSETYQYFDLPFCQPDHMTEKREDLGEVLNGDRMVDAPYKLDFKVNKESEILCKKKLTIEYLRKFREAIKNDYYFQMYYDDLPIWGFIGKVDKEIKSDGKGPRYLLYTHVHFDIFYNKDRVIEINVRTDPRFTVDITEDKEIEVEYMYSVKWQESDLPFEQRMEKYSKSSSLPQHLEIHWFSIINSCVTVLLLTGFLATILMRVLKNDFVKYSHDEETADDQEETGWKYIHGDVFRYPPHKSLFCAVLGSGTQLLALAIFIFMLALVGVFYPYNRGALYTALVVIYALTSGIAGYTAASFYHQLEGTNWVRNLLLTGCLFCGPLFLTFCFLNTVAIAYHATAALPFGTILVILLIWTLVTSPLLVLGGIAGKNSKTEFQAPCRTTKYPREIPPLPWYRGTIPQMAMAGFLPFSAIYIELYYIFASLWGHKIYTIYSILFIVFIILIIVTAFITIALTYFQLAVEDHEWWWRSVVCGGSTGVFIFGYCFYYYFARSDMSGFMQTSFFFGYMACICYGFFLMLGTVGFRASLLFVRHIYRSIKCE

SEQ ID NO: 4013 - protein, 447 aa, Trifolium pratense
DTNMSTLNVFSQPLHPTISSSLCCSSSLNNNNNNYVYSCQNSKLSFLSNSHNFSILSSSHSTPTKLSNFHNIFSKSGNGSSWLQSSATASNSEHKKGAVYSTFPSSPAQVSSVQDLFEFICSGPLLDKIGLTSENVAESIDKWLSYGLQLCRLFQLNELFLTEPQKVRLYHYYIPVFLWCESEIARHRSQFKDEEDIPPLVIGFSAPQGCGKTTLVFALDFLFQMIGRKSATISIDDFYLTAEGQSKLREANPGNALLEFRGNAGSHDLPFSVETLTSLTKMSREGIKMKLPRYDKSAFGGRGDRADPSTWPEIEGPLTVVLFEGWMLGFKPVPDEVVKAVDPQLEIINKNLEAYYEAWDKYIKSWIVIKIQDPSCVFQWRLQAEIAMREAGNPGMSDDEVRDFVSRYLPAYNAYLPTLYSQGPNGSDPQHLLTIEIDEKRNPILGV

SEQ ID NO: 4014 - protein, 429 aa, Cajanus cajan
MATLNLFSQPLQPTISPSFCCSNTNHYNSNNSKLHFFTNSRHFSVLPQFSTHSSNSKSGSGNSWLQNSSTSAGIEYRKRPLYSVFPTKPAQVASVQDLYEFICSGPLLDKIGITQEQVAESIDTWLLYGRYLCRLFQLNELYLTEPQKARIYHYYVPVFLWCEQQISQHQSKFKEGEDIPPLVIGFSAPQGCGKTTLVFALDYLFEEIGRKSATISIDDFYLTAEGQNKLREANPGNALLEFRGNAGSHDLAISVETLSALTKMTREGMKMKLPRYDKSAFSGRGDRADPSTWPEIEGPLTVVLFEGWMLGFKPLPVEAVKGVDPQLETINKNLEAYYDAWDKYIKSWIVIKIKDPNCVFQWRLQAEIAMREAGKPGMTDDEVRDFVSRYLPAYYAYLPTLYSEGPSGSDPKHLLTIEIDEGRNPILAA

SEQ ID NO: 4015 - protein, 258 aa, Cajanus cajan
MEMEAFLWGDDIDGDAPKGKSDGFGGNNGVIGSGCGSSFSLVLDGERGELVEAPVKLERKGVSTERSIEALKSHSEAERRRRARINAHLDTLRSVIPGAIKMDKASLLGEVIRHLKELKKNAAQACEGLMIPKDNDEISVEEQEGGLNGFPYSIRASLCCEYKPGLLSDIRQALDALHLMIIRADIATLEGRMKNVFVIISCKEQNFEDAAYRQFLAGSVHQALRSVLNRFSVSQDLLGTRKRRRISIFSSSSLEDFL

SEQ ID NO: 4016 - protein, 704 aa, Cicer arietinum
FPFLFSHHNFTTTINVSRTSSFRVFCCQSEFKTEKVQIRRFSPLLESSLVSGNGAVALDEWKAVPDIWRTSAEKFGDNVALVDQYHDPPTTMTYKQLEDAILDFAEGLRVIGVKPDEKIALFADNSCRWLVADQGMMAIGAINVVRGSRSSIEELLQIYNHSESVALAVDNPEMFNRIAKPFYLKSSIRFIILLWGEKSCLVSEGNKEVPIFTFMEVIHLGRECRKALFECHDARQPYKFEAIKSDDIATLVYTSGTTGNPKGVMLTHHNLLHQIKHLTDVAPAEVGDIFLSMLPPWHAYERACEYFIFARGVEQIYTTVRNLKDDLGRYQPQLMVSVPLVYETLYSGIQKQISTSSLIRKFVALTFIRISLGYMEYKRIYEGKCLTSNQKPPSFLYSILDLIWARLIAAILYPIHMLANKLVYSKIRSTIGISKVAISGGGSLPSHVDKFFEAIGFNLQNGYGLTETSPVIAARRPGCDVIGSVGYPIKHTEFKVVDSETGEILPPGSKGILKVRGPPLMKGYYKNPSATSQAIDRDGWLNTGDIGWIVPYHSTGRSRNSGGVIVVEGRAKDTIVLSSGENVEPGELEEAALRSNLIQQIVVIGQDKRRLGAVVVPNKEGALKVARELSIIDSKSSDISQEKLTSLIYNELRTWTSEFPFQIGPILLVNDPFTIDNGLMTPTMKIRRDRVMAQFKDQIENLYK

SEQ ID NO: 4017 - protein, 511 aa, Medicago truncatula
MSFALTTTMFAFLLFTFMYFLFKLYLHPKQKTLNHKKPPGPSTLPIIGNLHILGKLPHRTLQSLSKKYGPIMSLQLGQVPTIIISSSKAAESFLKTHDIVFASRPKVQGSDLMSYGSKGMAFSEYGPYWRSVRKFCTLKLFSASKVEMFGPIRKEKLDVLVISLEKAALEGEVVNVSEVVENLIEDIVYKMMFGRSKYEQFDMNKLVLEAMALMGAFNLADYVPWLGVFDLQGLTRACKKTSKALDEVLEMIITEHEQTTNTDKTRNEDFVDILLSIMHQTIDVEGEQNLVIDRTNIKAILLDMIAASVHTSATTIEWALSELLRHSRVMKILQDEIQNEVGNKRMVEEKDLKKFNYLDMVVDETLRLYPVGPLLIPRECRESITIDGYFITKKTRVIVNAWAIGRDCNVWSENADEFYPERFIDKKMNYQGHEFESIPFGSGRRRCPGIQLGLIIVKLVIAQFVHCFNWELPHNISPSNLNMEEKFGLSIPRAQHLQAIPSYRLDDAKHE

SEQ ID NO: 4018 - protein, 502 aa, Medicago truncatula
MFAFLLFTFMYFLFKLYLHPKQKTLNHKKPPGPSTLPIIGNLHILGKLPHRTLQSLSKKYGPIMSLQLGQVPTIIISSSKAAESFLKTHDIVFASRPKVQGSDLMSYGSKGMAFSEYGPYWRSVRKFCTLKLFSASKVEMFGPIRKEKLDVLVISLEKAALEGEVVNVSEVVENLIEDIVYKMMFGRSKYEQFDMNKLVLEAMALMGAFNLADYVPWLGVFDLQGLTRACKKTSKALDEVLEMIITEHEQTTNTDKTRNEDFVDILLSIMHQTIDVEGEQNLVIDRTNIKAILLDMIAASVHTSATTIEWALSELLRHSRVMKILQDEIQNEVGNKRMVEEKDLKKFNYLDMVVDETLRLYPVGPLLIPRECRESITIDGYFITKKTRVIVNAWAIGRDCNVWSENADEFYPERFIDKKMNYQGHEFESIPFGSGRRRCPGIQLGLIIVKLVIAQFVHCFNWELPHNISPSNLNMEEKFGLSIPRAQHLQAIPSYRLDDAKH

SEQ ID NO: 4019 - protein, 510 aa, Medicago truncatula
MFSTTIIIPFILFTFTYLLFKFYLREKQNTINHKKPPGPPTLPIIGNLHMLGKLPHRTLQSLSKKYGSIMSLQLGQVPTIVISSSKAAESFLKTHDINFASRPKTQASQLIFYGSKGLAFSEYGPYWRSVKKLCTLKLLSASKVEMFGPIRKKELDVLVKSLEKVVLVGEVVNVSEIVENLIEDIVYKMILGRGKYEQFDLKKLVQEGMAMLGAFNLADYVSWLGPFDLQGFTRTCKKTGKALDEVLEMIITEHEQSTNVDKVRHEDFIDILLSIVHQTVDPENEQSGVIDRTNIKAILLDMIVAGIDTATTTIEWALSELFRHPRVMKKLQDEIQNEVGNKRMVEENDLKKLNYLDMVVDETLRLYPVGPLLLPRECRESITIDGYFIKEKTRVIVNAWAIGRDSNIWLENADEFYPERFSDKKMNYQGQQFESIPFGSGRRRCPGIQLGLVTVRFVVAQLVHCFNWELPHNISPSNLNMEEKFGVTIPRAQHLHAIPSYRLECDEKLE

SEQ ID NO: 4020 - protein, 277 aa, Glycine max
MEWAARAEHLRGIPRKLVIAAVGGFAKTVSSFLNTADVHNGDTLLRLVRSRPHRVPLITVSNHMSTLDDPVMWGFKGFPIFDTNLARWVLAAEDICFRNALYSYIFRVGKCIPITRGGGIYQEHMNEALERLNDGEWLHTFPEGKVYQEDAPIRQLKWGTASLIVRAPITPIVLPIVHHGFHEVMPENYMFGKRPPIPLWNKKIHIVIGDPIEFDLPAMRQKAISQSRNESFPTIGWPSTPDGLDEAAQRYLYTTISEQIRAAMERLRCLGKSFMKS

SEQ ID NO: 4021 - protein, 281 aa, Phaseolus coccineus
MSRTMEWAARTDHFRGIPRKIVIAVVGAFAKTVSSVLNTTSVHNADTLLHLVRSRPSRVPLVTVSNHMSTLDDPLMWGFKGFPIFDTKLARWVLAAEDICFRNALYSYIFRLGKCIPITRGGGIYQEHMNEALERLKNGEWMHTFPEGKVNQEEAPIRRLKWGTASLIVRAPITPIVLPIFHHGFHEVMPEKYMFDRRPPLPLWNKKVDIIIGDPIEFDLPAMRQKAISQSRSESFPTAGWPSTCDGLDEAAQRCLYATISEQIHAAMERLRCFGKSFLRS

SEQ ID NO: 4022 - protein, 277 aa, Cajanus cajan
MEWAARPDHLRGIPRKLVIAAVGAFAKTVSSLLNTTSVHNADTLLRLLRSRPRRVPLITVSNHMSTLDDPSMWGFKGFPIFDASLARWVLAAEDICFKNALYSYIFRLGKCIPITRGGGIYQEHMNEALERLNNGEWLHTFPEGKVYQEDAPIKRLKWGTASLIVRAPRTPIVLPIVHHGFHKVMPEEYMFGRRPLVPLWNKKINIIIGDPIEFDLPEMRQKAIFQSRNESFPTTGWPSTSDGLDEAAQRCLYSTISDQIRAAMERLRCLGKSFLKQ

SEQ ID NO: 4023 - protein, 282 aa, Glycine max
MEWAARAEHLRGISRKVVIAAVGAFAKTVSSLLNTAAVHNADTLLRLVRSRPNCVPLINVSNHMSTLDDPVMWGFKGFPIFDTKLARWVLAAEDICFKNALYSYIFRVGKCIPITRGGGIYQEHMIEALERLKDGEWLHTFPEGKVYQEDVPIRRLKWGTASLIVRAPITPIVLPIVHHGFHEVMPEKYMFGRRPPVPLWNKKIDIIIGDPIEFDLPAMRQKAISQSRNESFPTIGWPSTPDGLDELAQRCLYTAISEQIRAAMERLRCFSKSFVKSWVGSN

SEQ ID NO: 4024 - protein, 277 aa, Phaseolus coccineus
MEWAARTDHFRGIPRKIVIAVVGAFAKTVSSVLNTTSVHNADTLLRLVRSRPSRVPLVTVSNHMSTLDDPLMWGFKGFPIFDTKLARWVLAAEDICFRNALYSYIFRLGKCIPITRGGGIYQEHMNEALERLKNGEWMHTFPEGKVNQEEAPIRRLKWGTASLIVRAPITPIVLPIFHHGFHEVMPEKYMFDRRPPLPLWNKKVDIIIGDPIEFDLPAMRQKAISQSRSESFPTAGWPSTCDGLDEAAQRCLYATISEQIHAAMERLRCFGKSFLRS

SEQ ID NO: 4025 - protein, 323 aa, Trigonella foenum-graecum
MAVDFSSIPIIDISPLLAKSDDPKMAEDPGVLDVVAQLDKACTEAGFFYVKGHGIPDSLLKGVRDITRRFFELPYEEKAKIKMTRATGFRGYEKIGENITEGAPDMHEAIDCYREVTKGMYGDLGKVMEGCNQWPQNPPKFKFLMEEYISLCKDLARKIMRGIALALGGSPYEFEGDRAGDPFWIMRIIGYPGVSTDDIGCGAHTDYGLLTLLNQDDDVNALQVRNLSGEWISAPPVPGSFVCNIGDMLKIYSNGLYESTLHRVINNSSKYRVSVVYFYETNFDTAVEPLDTYKTRTNGDKKFERAVYGEHLVKKVLTNFVDE

SEQ ID NO: 4026 - protein, 324 aa, Cicer arietinum
MAADFSSIPIIDISPLLAKSDEPKMGEDSSVLDVVTQLDKACTEAGFFYVKGHGIPESLLKEVRDVTRQFFELPYEEKAKIKMTPANGFRGYEKIGENVTQGVPDMHEAIDCYREVTKGMYGDLGKVMEGCNQWPENPPKMKVLMEEYIILCKDLARKIMCGIALALGGSPYEFEGHRAGDPFWVMRIIGYPAVSTMNDIGCGAHTDYGLLTLLNQDENINALQVRNLSGEWISAPPIPGTFVCNIGDMLKIYSNGLYESTLHRVINNNTKYRVSVAYFYETNFDTAVEPLDTYKTRTNGHRKFERAVYGEHLVSKVLSNFIHE

SEQ ID NO: 4027 - protein, 329 aa, Cajanus cajan
MATDFSSIPLIDISPLLAKADDPKMAEDPGVLEVVRQLDKACTEAGFFYVTGHGIPDILLKEVRDVTRRFFELPYEEKAKIKMTPAAGFRGYERIGENITLGVPDMHEAIDCYREVTKGMYGDLGKVMEGSNQWPQNPPTFKALMEEYISLCTDLARKIMRAIALALGGSPDEFEGQRAGNPFWVMRLIGYPGVSSANGTNALKNDIGCGAHTDYGLLTLLNQDDDINALQVRNLSGEWISAPPVPGSFVCNIGDMLKIYSNGLYESTLHRVINKNSKYRVSVVYFYETNFDTAVEPLDTHKTRANGNKKFERPVYGEHLISKVLTNFI

SEQ ID NO: 4028 - protein, 331 aa, Glycine max
MATDFSSIPIIDISPLLAKADDPKMAEDPGVLEVVKQLDKACTEAGFFYVKGHGFPETLLKEVRDVTRRFFELSYEEKAKIKMTPAAGFRGYQRLGENITKGVPDMHEAIDCYREVTKDMYGDLGKVMEGSNQWPQNPPTFKVLMEEYVSLCRDLARKIMRGIALALGGSPNEFEGQRAGDPFWVMRLIGYPGVSSVNGTNVHKNDIGCGAHTDYGLLTLLNQDDDVNALQVRNLSGEWITAPPVPGTFVCNIGDMLKIYSNGLYESTLHRVINNNSKYRVSVVYFYETNFDTAVEPLDTHKTRANGNKEFKRAVYGEHLTGKVLTNFVDL

SEQ ID NO: 4029 - protein, 249 aa, Phaseolus coccineus
MTPAAGYRGYQRIGENITKGVLDMHEAIDCYREVTKGMYGDLGKTMEGSNQWPQNPPIFKVLMEEYISLCTDLARKIMRGIALALGGSPDEFEGQRAGDPFWVMRLIGYPCVSSVNGTHVLKHDIGCGAHTDYGLLTLLNQDDDINALQVRNLSGEWISAPPVPGSFVCNIGDMLKIYSNGLYESTFHRVINDNSKYRVSVPYFYETNFDTTVEPLDTHKTRANGNKKFERPIYGEHLVRKVLTNFVLE

SEQ ID NO: 4030 - protein, 332 aa, Arachis hypogaea
MATDFSSIPLIDVSALLAKCDDPKMGEDPGVLEVVRQLDKACTEAGFFYLKGHGVSDALLKEVKDITRRFFELPCEEKTKIKMTPAAGFRGYQRVGENITKGTPDMHEAIDCYKEVTRGMYGDLGKTMEGYNQWPQNPPKFKVIMEEYISICTELARKIMRGIALALGGSPDEFEGQRAGDPFWVMRLIGYPGLTTTNGTHEAMKNDIGCGAHTDYGLLTLLNQDEDINALQVRNLSGEWISAPPVPGTFVCNIGDMLKIYSNGLYESTLHRVINNSPKYRVSVVYFYETNFDTAVEPLDTIRTRKNGTKKFEKAIYGEHLVSKVLTNFVDV

SEQ ID NO: 4031 - protein, 327 aa, Vigna unguiculata
NFSSIPVIDISSLLAKADDPKMAEDPGVREVVRQLDKACIEAGFFYVKGHGVPETLLKEVRDVTRSFFELPYEEKAKIKLTPAAGYRGYQRIGENITKGVPDMHEAIDCYREVTKGMYGDLGKTMEGSNQWPQYPPTFKVLMEEYIRLCTDLARKIMRGIALGLGGSPDEFEGQRAGDPFWVMRLIGYPGVSTVNGTHVLKNDIGCGAHTDYGLLTLVNQDEDTNALQVRNLSGEWISAPPVPGTFVCNIGDMLKIYSNGLYESTFHRVINDNSKYRVSVAYFYETNFDTAVEPLDTHKTRANGNTKFERPVYGEHLIAKVLTNFVF

SEQ ID NO: 4032 - protein, 551 aa, Setaria italica
MRRSRSCLSCVPMGTAALPIEKQFVPPAALPSWPASAAVSDGGFAKGSIDLGGLEVRQITTFAKVWSTTQGGEDGVGATFFEPSPVPAGFSVLGHYAQPNSRPLFGHVLVARDTSGTGALLAAPVDYTLVWSSPDGAGNFWLPTAPEGYKAVGAVVTATSDKPSRDEVRCVRADFTDACETEESLLSSDKDGFSAATLRPSVRGIDARGVHAGTFLAQSNAASASTVACLKNNSASYTSSMPDLAQVNSLLAAYAPHVYLHPNEPYFPSSVTWFFENGALLYQKGSQTATPVAADGSNLPQGGGNDGGYWLDLPVDNKQREKVKRGDLASAKVYVQAKPMLGGTVTDLAVWIFYPFNGPARAKVGLLTIPLGEIGEHVGDWEHVTLRVSNFSGELLRMYFSQHSAGTWVEASQLEYLDAGDGGSRPVAYASLHGHALYPKAGLVLQGDARLGVGIRNDAARGSRLDTGGAGRCEVVSAEYLGVAEPAWLGFEREWGPRVEYDIGRVINRVARILPRSARERLAKLVEKVLVGDGPTGPKMHGNWRNDEREA

SEQ ID NO: 4033 - protein, 425 aa, Phaseolus coccineus
MAKKRSAPIGGRRENRVESSSVRVNSAFSGRNVVVFFIISSIIATVTYRFRQYSPSQYEESYVYEQGLVTTHANYQHVLTENSKVSENTSQRHYNYPVLGYITPWNSRGYELAKRFNSKFTHISPVWYDLKSQQTSLVLEGRHNADRGWISELRKTGEALILPRVVLEASPAVLLGKEKQRNKAINLIVTECKEMGYDGIVLESWSRWAAYGILHDPNMRNLALQFVKQLGDALHSIGSEKISGQKLQLVYVIGPPSSEKLQEHDFGPKDLEVLSAAVDGFSLMTYDFSNPHNPGPNAPLKWIQIVLKLLLGTSGNRAQSLAPKILLGINFYGNDFSLSRGEGGGGAIIGRDYLALLEKHRPELQWDKNSGEHFFFYNDDKDIKHAVFYPSLKSISLRLEEARSWGCGISIWEIGQGLDYFYDLL

SEQ ID NO: 4034 - protein, 425 aa, Cajanus cajan
MAKKRSGPSGGRRENRVEPSSARVDSASGRSKLVVLFIVSSIIAIIVTYRFRRSSQSEYKDSNVYEQGLVTTHANYHHVLTENSKVSENTSQRHYTYPVLGYITPWNSRGYELAKRFNSKFTHLSPVWYDLKSQQTSLVLEGRHNADRGWMSDLKKTGEALILPRVVLEASPAVLLRKEKLRDKAINLIVTECEAMGYDGIVLESWSRWAAYGILHDPNMRNLALQFVKQLGDALHSISSEKISGKQLQLIYVIGPPSSEKLLEHDFGPKDLETLSEAVDGFSLMTYDFSNPHNPGPNAPLKWIQIVLQLLLGTSGNRAQSLAPKILLGINFYGNDFSLSRDAGGGAVIGRDYLALLEKHRPELQWDEKSGEHFFLYSDDKDIRHAVFYPSLKSISLRLEEARSWGCGISIWEIGQGLDYFFDLL

SEQ ID NO: 4035 - protein, 273 aa, Vigna unguiculata
  misc_feature (135)..(135): Xaa can be any naturally occurring amino acid
  misc_feature (156)..(156): Xaa can be any naturally occurring amino acid
  misc_feature (165)..(165): Xaa can be any naturally occurring amino acid
  misc_feature (172)..(172): Xaa can be any naturally occurring amino acid
  misc_feature (183)..(183): Xaa can be any naturally occurring amino acid
MAKKRSAPVGVRRENRVESSTRRVNSSSGRRNIVFFFVISSIIAIVAYRFRKSSPSQYQESYVYEQGLVTTHANYQHVLTENSKVSENTSQRHYNYPVLGYITPWNSRGYELAKRFNSKFTHISPVWYDLKSQQXSLVLEGRHNADRGWISALRTXGEALILPRXVLEASPXVLLGKEKQRNXAINLIVTECKEMGYDGIVLESWSRWAAYGILHDPNMRNLALRFVKQLGDALHSIGSEKISGQKLQLVYVIGPPSSEKLQEHDFGPKDLRL

SEQ ID NO: 4036 - protein, 435 aa, Lotus japonicus
MAKKRDHRSAPSSGHRENRFQPPSRRNQRTDSTASSRSKLIALFIVSSVIAIVAYWLRQSSPSQSKHKESYVYQRGLVTTDANYQDIVTENSNVPENSSHRHYTYPVLGYITPWNSRGYELAKRFNSKFTHLSPVWYDLKSQQSSLVLEGRHNADRGWISDLRKAGEALILPRFVLEASPAELLGKKKQRNKAINLIVTECKEMGYDGIVLESWSRWAAFGILHDPDMRNLALQFVQQLGDALHSISSEKNSGQPLQLVYVIGPPSSEKLQEHDFGPRDLETLSGAVDGFSLMTYDFSNPHNPGPNAPLKWIQIILQLLLGTSSSRAQSVAPKILLGINFYGNDFSLSKGSNSGGGAITGRDYLALLEKHRPLLQWDNNSGEHVFFYTDDKGIKHAVFYPSLKSISLRLEEAHSWGCGISIWEIGQGLDYFFDLL

SEQ ID NO: 4037 - protein, 419 aa, Glycine max
MNEIDVPSFFLCPISLDIMKDPVTVSTGITYDRESIETWLFSKKNTTCPITKLPLIDYTDLTPNHTLRRLIQAWCSMNASHGIERIPTPKPPVNKNQISKLLKDASHSPLTCLRRLKSISSGSETNKRCMEASGAVEFLASIVINTNRNIDSSHEADSNDGSGFELKTSACDEALSLLHNLHLSEQGLKTLLSFRNGEFIESLTRVMQKGFFESRAYAVFLLKSISEVAEPVQLLHLRQELFVELVQVLKDQISQKTSKATLQTLIQFSPWGRNRIRAVEAAAVPVLIELLLDCKERKPCEMMLVLLELLCQCAEGRAELLSHAAGLAIVSKKILRVSTLANDRAVKIILSLSRFSATPHVVQEMLKLGVVAKLCLVLQVDSGNRAKEKAREILKLHARAWRNSPCIPNNLLNSYPNYV

SEQ ID NO: 4038 - protein, 337 aa, Glycine max
MAMALSLSQFPVRGSVSLPKRRLPRRSFCIRGMSETSSTSSVSTQQEQPTSDNASSVTIAPPPNFKPPEPKRFAIRPDKTSEVFGALLPLIFRFATGVFVSGYSFSIVSKDEIPTDEYALELNGVTIKETAKLGPRPEKPIEIYEFESCPFCRKVREIVAILDLDVLFYPCPRNGPNFRQKVLEMGGKLQFPYMVDPNTGASMYESDDIIRYLVDKYGDGNVPLSLSLGFLTTLTAGLGMLSRISKGTTYTPAKFPPKPLKLWAYEGSPFCKLVREVLVELELPHLLVSCARGSPKRHILYQKTGTFQAPFLEDPNTGIEMFESAEIIEYLRATYAL

SEQ ID NO: 4039 - protein, 331 aa, Cajanus cajan
MAGALSLSQFPLCGSISLPKRVPRRRFCVRAMSETSSVSTKQEPTSDASSVTISPPPNFKPPEPKRFAIRPDKTTEVLGALLPLLFRFATGVFVDGYSFSFVSKDEIPPDQFALEINGITVKETAKLGPRPEKPIEIYEFESCPFCRKVREIVAILDIDVLFYPCPRNGPNFRPKVLQMGGKLQFPYMVDPNTGVSMYESDDIIRYLVDKYGDGNVPLSLSLGFITALTAGLAMLSRISKGTTYTPAKFPPKPLKLWAYEGSPFCKLVREVLVELELPHLLISCARGSPKRHILYQKTGVFQAPFLEDPNTGIEMFESAEIIEYLKATYAL

SEQ ID NO: 4040 - protein, 342 aa, Phaseolus coccineus
MAAALSFSQFPVSGYICFPKRRLPSRSFYIRAMSETSSSTSVSSQQEQPTSDSSSASSSSVTIAPPPNFKPPEPKRFAIRPDKTGEVFGALLPLLFRFATGVFVSGYSFSFVSKDEIPPGQYALELNGIVIKETAKVGPRPEKYIEIYEFESCPFCRKVREIVAILDLDVVFYPCPRNGPNFRPKVLQMGGKLQFPYMVDPNTGVSMYESDDIIRYLVDKYGDGNVPLSLSLGFLTTLTAGLSMLSRIGKGTIYTPAKFPPKPLKLWAYEGSPFCKLVREVLVELELPHLLVSCARGSPKRQILFQKTGHFQAPFLEDPNTGIEMFESAEIIEYLRATYALQ

SEQ ID NO: 4041 - protein, 305 aa, Vigna unguiculata
MASALSLSQFPVSGYICFPKRRAPSRSFCIRVMSETSSSTSSSVTIAPPPNFKPPEPKRFAIRPDKIGEVLGAALPLLFRFATGIFVSGYSFSVVSKDEIPPDQYALDLNGITIKETSKLGPRPEKYIEIYEFESCPFCRKVREIVGILDLDVVFYPCPRNGPNFRPKVLQMGGKQQFPYMVDPNTGVSMYESDAIIRYLVDKYGDGNVPLSLSLGFLTTLTAGLGMLSRIGKGTTYTPAKSPPKPLKLWGYECLLSARLYVKYLWNWSCHTCLSVVLGVAQRDIYYIRKLDISRYPFWKIQTLG

SEQ ID NO: 4042 - protein, 325 aa, Vigna unguiculata
MASALSLSQFPVSGYICFPKRRAPSRSFCIRVMSETSSSTSSSVTIAPPPNFKPPEPKRFAIRPDKIGEVLGAALPLLFRFATGIFVSGYSFSVVSKDEIPPDQYALDLNGITIKETSKLGPRPEKYIEIYEFESCPFCRKVREIVGILDLDVVFYPCPRNGPNFRPKVLQMGGKQQFPYMVDPNTGVSMYESDAIIRYLVDKYGDGNVPLSLSLGFLTTLTAGLGMLSRIGKGTTYTPAKSPPKPLKLWGYEVSPFCKIVREVLVELELPHLLVSCARGSPKRHILYQKTGHFQVPFLEDPNTGIEMFESAEIIEYLRATYALQ

SEQ ID NO: 4043 - protein, 310 aa, Phaseolus coccineus
MSETSSSTSVSSQQEQPTSDSPSASSSSVTIAPPPNFKPPEPKRFAIRPDKTGEVFGALLPLLFRFATGVFVSGYSFSFVSKDEIPPGQYALELNGIVIKETAKVGPRPEKYIEIYEFESCPFCRKVREIVAILDLDVVFYPCPRNGPNFRPKVLQMGGKLQFPYMVDPNTGVSMYESDDIIRYLVDKYGDGNVPLSLSLGFLTTLTAGLSMLSRIGKGTIYTPAKFPPKPLKLWAYEGSPFCKLVREVLVELELPHLLVSCARGSPKRQILFQKTGHFQAPFLEDPNTGIEMFESAEIIEYLRATYALQ

SEQ ID NO: 4044 - protein, 375 aa, Glycine max
MDAEADPPQNPITRHKCLACYKQYKKKEHLIEHMKTSYHSVHQPRCGVCQKHCKSFESLREHLTGPLPRGICSKIFSQQGCQLCLALFDSPGSLIGHRETCRLSAPTCPGTSALPYIDSQFDCQDSSDENHAGEGPGGAVAIDCEMVGGGSDGSLELCARVCLVDEDERLIFHTYVQPEIPVTNYRYDITGLTEEHLKNAIPLKKVREKLLQILQNGESIGKVRLDGGKARLLVGHDLAHDLDCLKMNYPDHMLRDTAKYRPLMKTNLVSHSLKYLTRTYLGQYYCSLVYSYDIQSGTHDPYEDCISVMRLYKRIRSQLHPEEDHGTMTLSNNIVGMPDSWISRELDNLTPDELYAMSRSDYKCWCLDLIPRLSA

SEQ ID NO: 4045 - protein, 365 aa, Cajanus cajan
MDAEAGPPQNPTSRHKCSACYKQYKKKEHLIEHMKTSYHSVHQPRCGVCQKHCKSFESLREHLTGPLPKGICSKLFSQQGCQLCLALFDSPRSLNDHRETCCLSAPTRLGTSTVPDMDSQFDCQYSSDENHAGGFPGAVAIDCEMVGGGSDGSLELCARVCLVDEDENLIFHTYVKPGIPITNYRYDITGLTEEHLRDAMPLKEVREKILQILHNAESISKVRLDGGKARLLVGHDLAHDLYCLNMHYPDHMLRDTAKYRPLMKTNMVSHSLKYLTRTYLGYDIQSGTHDPYEDCISVMRLYKRIRGQIHAEEDHRTLTPRNNIVAIPDSWKSKELENLTPDELYAISKSDYKCWCLDLRPRLAA

SEQ ID NO: 4046 - protein, 364 aa, Phaseolus coccineus
MDAEADSTQIPNIRHKCPACYKQFKKKEHLTEHMKTSNHSVHQPACGVCQKHCKSFESLREHLTGPLPKGVCSKIFSQRGCQLCLVLFDSPGSLVSHRETCRLSAPTRLGTRKLPCIDSQFDCLDSSDENHAGWGPGGAVGMDCEMVGGGSDGSLELCARVCLVDEDENLIFHSYVQPQIPVTNYRYDITGLTEEHLRNAMPLYEVREKILQMLYNGESIGKVRLNGGKARLLVGHDLAHDLDCLKMNYPDHMLRDTAKYRPLMKTNFVSHSLKYLTRTYLGYDIQSGTHDPYEDCISVMRLYKRIRAQIHPEEAHETPSHNIVCVPDSWRSRELENLTPDQLYAMSKSDYKCWCLDLRPRLAS

SEQ ID NO: 4047 - protein, 812 aa, Glycine max
AKPNVLIPINPSVTVEKGKYSYDVETLINRLTALPPRGSIARCLDPFKNKLSLNDFALVFKEFAQRGDWQRSLRLFKYMQRQIWCKPNEHIHTIMITLLGREGLLDKCREVFDEMPSNGVVRTVYSYTAIINAYGRNGQFHASLELLNGMKQERVSPSILTYNTVINACARGGLDWEGLLGLFAEMRHEGIQPDVITYNTLLGACAHRGLGDEAEMVFRTMNESGIVPDINTYSYLVQTFGKLNRLEKVSELLREMECGGNLPDITSYNVLLEAYAELGSIKEAMGVFRQMQAAGCVANAATYSVLLNLYGKHGRYDDVRDLFLEMKVSNTDPDAGTYNILIQVFGEGGYFKEVVTLFHDMAEENVEPNMQTYEGLIFACGKGGLYEDAKKILLHMNEKGVVPSSKAYTGVIEAFGQAALYEEALVMFNTMNEVGSNPTVETYNSLIHAFARGGLYKEAEAILSRMNESGLKRDVHSFNGVIEAFRQGGQYEEAVKSYVEMEKANCEPNELTLEAVLSIYCSAGLVDEGEEQFQEIKASGILPSVMCYCMMLALYAKNDRLNDAYNLIDAMITMRVSDIHQVIGQMIKGDFDDESNWQIVEYVFDKLNSEGCGLGMRFYNALLEALWCMFQRERAARVLNEASKRGLFPELFRKSKLVWSVDVHRMSEGGALTALSVWLNNVHEMSMTGDDLPEVATVVVVRGHMEKTTDAQDFPIAKAAISFLQDNVPSSFAFPGWNKGRIVCQQSQLRRILSGTESSSSRKKMDKLISLSNTPLTTAGAITSKSDAQSGKANGVDSRTDSTRTELLTSAI

SEQ ID NO: 4048 - protein, 860 aa, Cajanus cajan
MTLSLLLSPAPSLSVPNPSPFPPALLNATTTTLRQLLFPRRRLHLQLRARAAKSKDIIPVNPSVTVEKGKYSYDVETLINRLTALPPRGSIARCLDPFKNKLSLNDFALVFKEFAQRGDWQRSLRLFKYMQRQLWCKPNEHIYTIMITLLGREGLLDKCREVFDEMPANGVVRSVYAYTAIINAYGRNGHFQTSLELLSGMKQERVAPSVLTYNTVINACARGGLDWEGLLGLFAEMRHEGIQPDVITYNTLLGACAHRGLGDEAEMVFRTMNESGIVPDINTYSYLVQTFGKLNRLEKVSELLREMESGGNLPDVTSYNVLLEAYAGLGSIREAMGVFRQMQAAGCVPNAATYSVLLNLYGKHGRYDDVRDLFLEMKVSNADPDAGTYNILIQVFGEGGYFKEVVTLFHDMVEENIEPNMETYEGLIFACGKAGLYQDAKKILLHMNENGIVPSSEAYTGVIEAYGQASLYEEALVAFNTMSEVGSSPTVETYNSFVHAFARGGLYKEVEAILFRMNEAGLKRDVHSFNGVIEAFRQGGQYEEAVKAYVEMEKENCEPNELTLEEVLSVYCSAGLVDESEEQFQEIKASGILPSVMCYCMMLALYAKNDRLNDAYNLIDEMTTMRVSDIHQVIGQMIKGDFDDESNWQIVEYVFDKLNSEGCGLGMRFYNALLEALWWMFQRERAARVLNEASKRGLFPELFRKSKLLWSVDVHRMSEGGALTALSVWLNNMQEMCLTGDDLPELATVVVVRGDMEKNTDAQDFPIAKAAILFLQDNVPSSFTFPRWNKGRLVCQQSQLKRILLGTESSSSRKKTDKLISLSNAPLTTAGVITSKSDGKANNVDSRTDSTRTELLTSAV

SEQ ID NO: 4049 - protein, 857 aa, Phaseolus coccineus
MTLSLSSPISVPNPSPFSPTLLNPTTALRQLFFATSPKRIFKFQSRATKFKELIPINPSVTVEKGKYSYDVETLINRLTALPPRGSIARCLDPFKNKLSLNDFALVFKEFAQRGDWQRSLRLFKYMQRQLWCKPNEHICTIMITLLGRESLLDKCREVFDEMPSNGVARTVYAYTAIINAYGRNGQFQASLELLDAMKQERVSPSILTYNTVINACARGGLDWEGLLGLFAEMRHEGIQPDVITYNTLLCACAHRGLGDEAEMVFRTMNESGIVPDINTYSYLVQTFGKLNRLEKVSDLLREMESGGNLPDITSYNVLLEAHAELGSIKDAMGVFRQMQAAGCVPNADTYSILLNLYGKHGRYDDVRELFLEMKVSNTDPDVGTYNILIQVFGEGGYFKEVVTLFHDMVEENIEPNMETYEGLIFACGKGGLYEDAKKILMHMKEKGIVPTSKAYTGVIEAFGQAALYEEALVAFNTMKEVGSNATLETYNSFVHAYARGGLYKEAEAILSRMNESGLKRDVNSFNGEIEAFRQAGQYEEAVKAHVEMEKANCEPNELTLEAVLSVYCTAGLVDESEEQFQEIKASGLLPSVMCYCMMLALYAKNDRSKDAYNLIDEMIKIRVSDVHQVIGQMIKGDFDDESNWQIVEYIFDKLTSEGCGLGMRFYNALLEALWWMFQRERAARVLNEASKRGLFPELFRKSKLVWSVDVHRMSEGAALTALSVWLNNMQEMFMISEDLPVLASVVVVRGEMEKTIDAQDFPIAKAAMSFLQDNVPSSSFTFPEWNKGRIVCQQSQLRQILSGTESSSSRKKMGKLISLSNSPLTTAGAKASKSDRKANDVDSRTDSTRTELLTSAV

SEQ ID NO: 4050 - protein, 184 aa, Nicotiana tabacum
  misc_feature (97)..(97): Xaa can be any naturally occurring amino acid
MSRHPAVKWAQRSDKLFITVELPDAKNVKLKLEPEGKFFFSAIAGADNVPYEVDLDLFDKINVDESKTSTTSRSIVYLVKKAEDKWWSRLIKQEGVXPVFLKVDWDKWVDEDEEDTKPGTDMDFGDIDFSKLNMGGGPSDFDADVPEGDDDSDTEEEEVKEEEDSAHNEPKAAVPPSTEPEAKA

SEQ ID NO: 4051 - protein, 365 aa, Solanum phureja
MILSKKLIFVLFLSISLFLVPASAIRGFVDKPRNIKIDGHLNYVESPEYRNSEECPILDSNLLICDPSLIHVAMTLDVKYFRGSVAAVHSVLKHSSCPENVYFHFVASKNKDFQELRQMVKSIFPSLSYKVYSFNEFRVKKLISSSIRQALDNPLNYARTYLAEIIQPCIERVIYLDSDVVLVDDIQKLWSISLTGSRIIGAPEYCQANFRTYFTNNFWSDPKLSNVFQGKKPCYFNTGVMVMDLGKWRKGDYTVKIEKWMKIQKEKRIYELGSLPPFMLVFGGEIEGIDHRWNQHGLGGDNLVNSCRTLHPGPVSLLHWSGKGKPWVRLDKGNPCPVDLLWMPYDLYRLSSIDSFDDQERRAMI

SEQ ID NO: 4052 - protein, 342 aa, Solanum phureja
MAEDICFFAKDSIIIKPPKKSPALLRMVVVAFTLIFGIYICSICLKQTSLENTSKYLNIEVIEKPCHNYDMDQSQIPYVHYPKPKTFSRAECSCNAVRRFAILSMQRSGSGWFETLLNSHMNVSSNGEIFSVKYRRENASSILRTLDTVYNLDFFTSASKNHCSAAVGFKWMLNQGLIEHHKEIVEYFNRKGVSVIFLFRKNLLRRMVSILSNSHDRYAKLLNGTHKSHVHSHEEAGTLAKYKPEINTTLLITDLKRMEVSATEALDYFNSTRHMILYYEDIVRNQAKLVDVLEFLRLPNMDLSSRQVKIHNGPLWKHIKNWDDVNKTLSGTAYEKFLRADY

SEQ ID NO: 4053 - protein, 342 aa, Solanum melongena
MAEEICFFTKDALIIKPPKKSPALLRMIVVVFAMVCGVYICSTCLKQTNTETTSKLLNIEVVERPCHEYDTDRLQIPYLHYPKPKTFSRAECACNPVRLFAILSTQRSGSGWFETLLNSHVNVSSNGEIFSVKERRENASSILRTLDMVYNLDLFTSASKNHCSAAVGFKWMLNQGLIQHHKEIVEYFNNKGVSVIILFRRNLLRRMVSVLANSYDRYARLLNGTHKSHVHSYEEASTLAKYKPEINTTLLITDLKKMEVSTKEALEYFNSTRNIFLYYEDLVRNHTKLVDILEFLRLPQMNLTSRQVKIHRGPLQEHIKNWDDVNKTLKGTTYESFLRSDY

SEQ ID NO: 4054 - protein, 342 aa, Solanum phureja
MAEEICFFTKDALIIKPPKKSPALLRMIVIVFAMVCGVYICSTCLKQTNTETTRKLLNIEVIERPCHEYDTDRSQIPYLHYPKPKTFSRAECSCNPVRLFAVLSAQRSGSGWFETLLNSHINITSNGEIFSVKERRENASSILRTLDMVYNLDLITSASKNHCSAAVGFKWMLNQGLIQYHKEIVEYFNNKGVSVIFLFRRNLLRRMVSVLANSYDRYARLLNGTHKSHVHSTEEASTLAKYKPEINTTLLITDLKRMEASTKEALDYFNSTRSIILYYEDLIKDHTKLEDVIEFLRLPQMNLTSRQVKIHSGPLQEHIKNWDDVNKTLKGTAYESFLRSDY

SEQ ID NO: 4055 - protein, 595 aa, Solanum phureja
GVDQQTNSEGGIRRRVCSCTKDDFLPEESFKSWGNYANALIQTPTRLIDRILTRSEDEEELESKSRSQNEMKKTLTWWDLIWFGMGAVIGAGIFVLTGLEANQEAGPAVVLSYVVSGVSALLSVFCYTEFAVEIPVAGGSFAYLRVELGDFVAFIAAGNILLEYVIAGAAVARTWTSYFATLLNFSSDKFLIKVDSLAEGYNELDPIAVGVCIIICIIAILSTKGSSRLNYIATIVHIFVIFFIIICGLIKSDTKNYTPFAPFKVRGIFKASAVLFFAYVGFDAVSTLAEETKNPGRDIPIGLIGSMVITTFLYCLLAITLCLMQPYQMIDTQAPFSVAFKSVGWNWAQYIVAAGALKGMTSVLLVGAVGQARYLTHISRTHMMPPWFSQVNAKTGTPVNATAVMSCATAIIALFTKLDILSNLLSISTLFIFMLVALALLVRRYYVHGETTIANRNKLITFLLIILASSVATATYWGLSKDGWIGYCITLPIWLLATIGLWYFVPQARKPKLWGVPLVPWLPSASIAINIFLLGSLDRASFMRFGVWTGFLLVYYLFFGLHASYDTAKEFERGRGWKNIEEGKGVDSKDIVPSA

SEQ ID NO: 4056 - protein, 1273 aa, Solanum lycopersicum
MGVEGVDQQTNSGVRRRVCSCTKDDFLPEESFKSWRNYANALIQTPTRLIDRILTRSEDEEELEAKSRSQNEMKKTLTWWDLIWFGLGAVIGAGIFVLTGLEANQEAGPAVVLSYVVSGVSALLSVFCYTEFAVEIPVAGGSFAYLRVELGDFVAFIAAGNILLEYVIAGAAVARTWTSYFATLLNFSSDKFLIKVDSLAEGYNELDPIAVGVCIIICIIAILSTKGSSRLNYIATIVHIFVIFFIIVCGLIKSDTKNYTPFAPFKVRGIFKASAVLFFAYVGFDAVSTMAEETKNPGRDIPIGLIGSMVITTFLYCLLAMTLCLMQPYQKIDTQAPFSVAFKSVGWSWAQYIVAAGALKGMTSVLLVGAVGQARYLTHISRTHMMPPWFSQVNAKTGTPVNATAVMSCATAIIALFTKLDILSNLLSISTLFIFMLVALALLVRRYYVHGDTTIANRNKLITSLLIILASSIATSTYWGLSKDGWIGYCITLPIWLLATIGLWYFVPQARKPKLWGVPLVPWLPSASIAINIFLLGSLDRASFMRFGVWTGFLLVYYLFFGLHASYDTAKEFKRGRGWKNIEEGNGVDSKDIVPSAPMMTQMDKGIENLMSARKCLRANFEKSKALGLSIEKAGPRFYEIIQRLPALEAAIRPIRAQKDALGAVGGHINRAVVPATAVLKVFDAIHGLEKSLSDPQSDLPGYLGVLKRLEEALRFLGENCEMAIQWLADIVEYLEDHAVADDRFTLSMKEALTSLRELHSGEEKGRLDGGLLEVALDRLESEFRRLLVENTIPLPMSDPALPGEQACIAPSPLPVIVIQKLQAILGRLIANNRLDKCISIYVEVRSSNVRTSLQALNLDYLEISVSEFNDVQSIEGHIAQWGKHLEFAVKHLFEAEYKLCNDVFERIGLDVWMSCFAKIAAQAGILAFLQFGKTVTESKKDPIKLLKLLDIFASLNKLRLDFNRLFGGTACLEIQNLTRDLIKSVIEGASEIFWELLVQVELQRQMPPPPDGTVPKLIIFITDYCNKLLGDDYKSILTQVLIIERSWKQEKFQERLLITELLNIMRAVDVNLETWSKAYQDVILSYVFLMNNHWHLYKHLKGTKLGGLLGDSWLKEHEQYKEYYSAFFLKESWGKLPALLSREGLILFSGGRATARDLVKKRLKAFNEAFDEMYKKQSNWVMLDKDLRDKTCQSIIQAIVPVYRSYMQNYGPLVEQEGSGKYVKYTAQSLEKVLNGLFHSKPVKHGSFKVRHPSGKFSNVVTDQNQTSPTVK

SEQ ID NO: 4057 - protein, 191 aa, Solanum phureja
MAKLILQIFTISIFLSLVAFPATGEEDTYSFGKSINKKPTRLKKEKFSHFRFYWHDILSGSKPTSMMIIPPSKNTTTGFGQMNMIDNALTLGPELSSKIVGRAQGFYGAASLNDVGLMMVMNFAFIEGKYNGSTFTILGRNPVFEKVREMAVIGGSGLFRFARGYVEASTHSWDFKTGDATVQYDAYVLHY

SEQ ID NO: 4058 - protein, 191 aa, Solanum phureja
MAKIILQIFTISIFLSLVAFPATGEEDTYIFGKSINKKPTRLKKEKFSHFRFYWHDILSGSKPTSMMIIPPSKNTTTGFGQMNMIDNALTLGPELSSKIVGRAQGFYGAASLNDVGLMMVMNFAFIEGKYNGSTFTILGRNPVFEKVREMAVIGGSGLFRFARGYVEASTHSWDFKTGDATVQYDALLRFY

SEQ ID NO: 4059 - protein, 191 aa, Solanum melongena
MAKLSLQIFTISILLFLVAFPATGEEDNYTFGKSINKKSMRLRKEKLSHFRFYWHDVLSGSKPTSMMIIPPPKNTTTGFGQMNMIDNALTLGAELSSKIVGRAQGFYAAASLNDVGLMMVMNFAFIEGKYNGSTFTILGRNPVFEKVREMAVIGGSGLFRFARGYVQASTHSWDYKTGDATVKYDAYVLHY

SEQ ID NO: 4060 - protein, 496 aa, Solanum phureja
MANKVFCPKLLKNLGFHVRRLNSAPSPLSAVPPLNFTGDFNAVEPAPQINTNHHDHHNTNNIINFDDVKELFYGVPTKKLIRSSMTLQMAAIDPMVDLGMWIMNSKLMEMPVFREVMLGFVKNTFYEHFCAGKDLTEVRRTVTNLSDSGLKAMLDYGVEHATDNESCEQSTAAFIQTIESTESLPESSASFVVAKITAICTPRLLKRMSDLLRWEQKDPSFNLPWKQESLPLFAESSPIYHTWSKPEPLTVEEERDLQLAHERLRKICEKCLEHQVPLLIDAEDTTIQPAIDYFAYSAAIKYHKDDQPLIFGTIQAYLKDAKERMVIAKKAAEKMGVPMGFKLVRGAYMCSEKELASTLGFKSPIHDSIEQTHACFNSCAEFMIEEIANGSGAVVLATHNIESGKLAATKAIDLGIKNERQNLQFAQLYGMADGLSFGLRNAGFQVSKYLPFGPVEQIMHYLMRRAEENRGMLSTSAFDRQLMRKELSRRLEVATS

SEQ ID NO: 4061 - protein, 502 aa, Solanum tuberosum
MANKVFCPKLLKNLGFHVRRLNSAPSPLSAVPPLNFTGDFNAVPNLVEPAPQINTTLHHHDHHNTNNIINFDDVKELFYGVPTKKLIRSSMTLQMAAIDPMVDLGMWIMNSKLMEMPVFREVMLGFVKNTFYEHFCAGKDLTEVRRTVTNLSDSGLKAMLDYGVEHATDNESCEQSTAAFIQTIESTKSLPESSASFVVAKITAICTPKLLKRMSDLLRWEQKDPSFNLPWKQESLPLFAESSPVYHTWSKPEPLTVEEERDLQLAHERLRKICEKCLEHQVPLLIDAEDTTIQPAIDYFAYSAAIKYHKDDQPLIFGTIQAYLKDAKERMVIAKKAAEKMGVPMGFKLVRGAYMCSEKELASTLGFKSPIHDSIEQTHACFNSCAEFMIEEIANGSGAVVLATHNIESGKLAATKAIDLGIKNERQNLQFAQLYGMADGLSFGLRNAGFQVSKYLPFGPVEQIMHYLMRRAEENRGMLSTSAFDRQLMRKELSRRLEVATS

SEQ ID NO: 4062 - protein, 347 aa, Solanum phureja
MGDSSDSVSVDMETISVAGKEHLVKTGRGYVSVAVFGDQDKPALITYPDLALNYMSCFQGVFYCPEAFSLLLHNFCIYHISPPGHELGAAVMSLDDPVLSVDDLADQIVEVLDYFRLGKVMCMGVTAGAYILTLFAIKYTQRVMGLILVSPLCKAPSWTEWLCNKVMTNLLYFCGMCTLVKELLLLRYFSKEVRGSVEVPESDVVQACRRLLGERQSPNVLRLLEAINERPDITQGLRKLKCRSLIFVGESSPFHSEALHMTSKLDRRFSALVEVQACGSMVTEEQPDAMLIPLEYFLMGFGFYRPSQCNVSPRSPLSPTSISPELFSPESMGLKLKPIKTRFSEEV

SEQ ID NO: 4063 - protein, 347 aa, Ipomoea nil
MGDSSDSVSVDIDTISLAGKEHIVKTGHGSLSVTVFGDQDKPALITYPDLALNYMSCFQGLFFCPEAFSLLLHNFSIYHISPPGHELGATTISPDEAVLSVDDLADQITEVLDYFGLGAVVCMGVTAGAYVLTLFAIKYTKRVMGLILVSPLCKAPSWTEWLCNKVMSNLLYFCGMCSLVKELLLMRYFSKEVRGSVEVPESDVVQTCRRLLGERQSPNVWRFLEAINERPDITEGLRRLHCRSLLFVGENSPFHFEALHMTSKLDRRFSALVEVQGCGSMVTEEQPDAMLIPLEYFLMGFGFYRPSQFSVSPRSPLSPTSISPELFSPESMGLKLKPIKTRISIEV

SEQ ID NO: 4064 - protein, 346 aa, Amsonia hubrichtii
MGDSSGESVSIDMETMSFAGKEHLVKTSRGSVSVAVFGDQDKPALITYPDLALNYISCFQGLFFCPEAFSLLVHNFCIYHISPPGHELGALAMSPDEPPLSVDDLADQIAEVLDYFGLGTVMCMGVTAGAYILTLFAIKYSRRVMGLILISPLCKAPSWTEWLCNKVMSNLLYFCGMCTLVKELLLIRFFSKDVRGSAEVPESDIVQACRRLLGERQSPNVLRFVEAMNERPDITDGLRKLKCRSLIIVGENSPFHSEALHMTSKLDRRFSALVEVQACGSIVTEEQPDAMLIPMEYFLMGYGFYRPPQLSASPRSPLSPTSISPELFSPESMGLKLKPIKTRMAL

SEQ ID NO: 4065 - protein, 346 aa, Tabernaemontana elegans
MGDSSGESVSIHMETMSFAGKEHLVKTGHGSVSVAVFGDQDKPALITYPDLALNYISCFQGLFFCPEAFSLLVHNFCIYHISPPGHELGALAMSPDEPALSVDDLADQIAEVLDYFGLGTVMCMGVTAGAYILTLFAIKYTHRVMGLILISPLCKGPSWTEWLCNKVMSNLLYFCGMCTLVKEILLVRFFSKEVRGSAEVPESDIVQVCRRLLGERQSPNVLRFVEAMNERPDISDGLRKLKCRSLIFVGENSPFHSDALHITSKLDRRFSALVEVQACGSIVTEEQPDAMLIPLEYFLMGYGFYRPPQLSVSPRSPLSPTSISPELFSPESMGLKLKPIKTKIAL

SEQ ID NO: 4066 - protein, 347 aa, Lippia dulcis
MADSSDSVSVDMESIPLAGKEHIVKTSQGAVSVAVFGDQDKPALITYPDLALNYMSCFQGLFDCPDGFSLLLHNFCIYHINPPGHELGAAVAAHDEPLLSVDDLADQIAEILNYFRLGPVMCLGVTAGAYILTLFAIKYSQRVMGLILVSPLCKAPSWTEWLCNKVMSNLLYICGMCGVVKELLLMRYFSKEVRGSVDVQESDIVQSCRRLLGERQSPNVLRFLEAMNGRPDITDGLRKLQCRSLIFVGENSPFHYEALHMTSKLDRRFSALVEVQACGSMVTEEQPDAILIPLEYFLMGYGFFRPSQYSASPRSPLSPTSISPELFSPESMGLKLKPIKTRIQEQV

SEQ ID NO: 4067 - protein, 346 aa, Vaccinium corymbosum
ADSSDSVSIDMETISLGGKEFLVKTGCGPVSVVVCGDPDKPALVTYPDLALNHMSCFQGLFFCPEAFSLLLHNFCIYHISPPGHELGAAIINPDDPVLSADDLADQIAEVLDYFGLGAVMCMGVTAGAYIVTLFAIKYPQRTLGLILISPLCKAPSWTEWLCNKVLSNILYYYGMCSLVKDLLLMRYFSKEVRGSLQVPESDIVQACRRLLDERQGPNVLQFLEAINGRPDITEGLKKLKCRSLIIVGENSPFHAEALHMTSKLDRRFSALVEVQACGSIVTEEQPHAMLIPLEYFLMGFGLYRPSQFNVSPRSPLSPTSISPELFSPESMGLKLKPIKTRMSVQV

SEQ ID NO: 4068 - protein, 347 aa, Mimulus guttatus
MADSSDSVSVDMESISLAGKEHIVKTGHGCVSVSVFGDQEKPALITYPDLALNYMSCFQGLFFCPEALSLLLHNFCIYHISPPGHELGAPVADPDEPSLSVDDLADQIPEILDYFGLGAVMCLGVTAGAYIITLFAIKYSQRAMGLILVSPLCKAPSWTEWLCNKMMSNLLYICGMCGIVKELMLMRYFSKEVRGGVDVPESDIVQSCRRFLGERQSPNVLRYLEAINGRPDISDSLRKLKCRSLIFVGENSPFHYESLHMTSKLDRRFSALVEVQACGSMVTEEQPDAMLIPLEYFLMGYGFFRPCQFNVSPRSPLSPTSISPELFSPESMGLKLKPIKTRIQAQV

SEQ ID NO: 4069 - protein, 347 aa, Triphysaria pusilla
MADSGDSVSVDMESAPFAGKEHIVKTGCGSVSVTVFGDQDKPALITYPDLALNYMSCYQGLLYCPEAFPLFLHNFCIYHISPPGHELGAAVAGPDEPSLSVDDLADQVAEILDYFGVGEVMCLGATAGAYILTLFAIKYSQRVMGLILVSPLCRTPSWTEWLYNKVLSNLLYMCGMCGLAKELLLIRYFSKEVRGSVNVPEEDIVQSCRRLLGERQSPNVLRFLEAINGRPDISKGLRKLKCRSLIFVGENSPFHSEALHMTSKLDRRFSALIEVQTCGSMVTEEQPDVMLIPLEYFLMGYGFYRPSQFSVSPRSPLSPTSISPELFSPESMGLKLKPIKTRILREL

SEQ ID NO: 4070 - protein, 346 aa, Theobroma cacao
MADSSDSVSIDMETISLGGKEYLVKTRHGTVSVAVFGDQDKPALITYPDLALNHVSCFQGLFFCPEASSILLHNFCIYHISPPGHELGAAPIGSDDLMPSVDDLADQIVEVLNFFGLGAVMCMGVTAGAYILTLFAMKYRQRVLGLILVSPLCRAPSWTEWLLNKVMSNLLYFYGMCGVVKELLLKRYFSKEVRGSAQVPESDIVQACIRLLDERQSINVWQFLEAMNGRPDLSDGLRKLHCRSLIFVGENSPFHSEALHMTSKLDRRYSALVEVQACGSMVTEEQPHAMLIPIEYFLMGYGLYRPTLSVSPRSPLSPSCISPELLSPESMGLKLKPIKTRISVEV

SEQ ID NO: 4071 - protein, 346 aa, Cirsium arvense
MADSSDSVSIDMEMSSLAGKEHIVKTSYGFVNVAVFGDQDKPALITYPDIALNHMSCFQGLFLCPEAFSLLVHNFCIYHINPPGHELGAAAMSYDDPMLSVDDLADQVAEILDYFGRGAVMCMGVTAGAYILTLFAIKYTRRVLGLILVSPLCKTPSWTEWLCNKVMGNVLYYYGMCGLIKELLLIRYFSKEVRGGAIIPETEIVHSCRRLLGERQSPNVLNFLEAINGRPDITDGLKRLQCRSLIFVGENSPFNSDSLHMTSKLDRRFSALVEVQGCGSMVTEEQPDAMLIPLEYFLMGFGFYRPSQMNVSPRSPLSPTSISPELYTPESMGLKLKPIKTRLSQI

SEQ ID NO: 4072 - protein, 346 aa, Lippia dulcis
MADSADSVSVDMESVPLAGKEHIVKTGHGTVSVAVFGDQDKPALITYPDIALNYMSCFQGLFFCPEACSLLLHNFCIYHISPPGHELGAAVADPDDPSLAVDDLTDQIADILDYFGLGAVMCFGVTAGAYILTLFAMKYSHRVMGLILVSPLCKAPSWTEWLYNKGMSNLVYMWGMCGLVKEMLLVRYFSKEIRGCVDILESDIVQSCRRLLGERQSPNVLRFLEAINRRPDITESLSKLRCRSLIFVGESSPFHHEALHMMSKLDRRFSALVEVQACGSIVTEEQPGAMLIPLEYFLTGYGFHKPSQFNVSPRSPLSPTSFSPELFSPESMGLKLKPIRTRIQEV

SEQ ID NO: 4073 - protein, 348 aa, Valeriana officinalis
MADSSDSVSIDMDSISLGGKEHHIKTSHGSVSVVVFGDQDKPALITYPDVALNYMSCFEGIFSCPEAFSLLLHNFCIYHISPPGHELGAAILSSENPVLSVDDLADQVAEILDYFGLDAVMCMGVTGGAYILALFAIKYTRRVLGLILVSPLCQAPCWTEWLYNKVMSNLLYYYGMCGLVKDLLLMRYFSKEVRGGVVQVTESHIVQVCRRLLDERQSPNVLRFLEALNERPNITEGLKKLKCRSLIFVGENSPFHNEALHMTSKLDRRYSALVEVQACGSMVTEEQPDAMLIPIEYFLMGYGYYRPSQFNASPRSPLSPTCISPELFSPESMGLKLKPIKTRIHMEC

SEQ ID NO: 4074 - protein, 350 aa, Prunus persica
MGDSSDSVSVDMEGVSLGGKEHLVKTCLGYVSVAVLGDQDKPALVTYPDLALNHMSCFQGLLFCPEACSLLLHNFCIYHISPPGHELGASAISLDDSVYSVDDLVDQIAEVLDFFGLGAVMCMGVTAGAYILTRFAMKYRSRVMGLILVSPICKAASWTEWLYNKVMSNLLYFYGMCGVVKEILLKRYFSKEVRGGVHIPESDIVQACRRSLDERQSSNVWRFLEAMNGRPDISEGLRKLQCRSLIFVGDSSPFHSEALYMTSKLDRRYSALVEVQACGSMVTEEQPHAMLIPIEYFLMGYGLYRPSQSSVSPRSPLSPSCIAPELLSPESMGLKLKPIKTRVRDPHERS

SEQ ID NO: 4075 - protein, 124 aa, Sarracenia psittacina
MADSNDSVSVDMETIYLGGEEHTVRTGRGPVSVIVYGDQDKPALVTYPDLALNHMSCFQGLFFCPEAASLLLHNFCIYHINPPGHELGAAAICPDDPVPSVDDLADQIIEVLNYFRLGAVMCMG

SEQ ID NO: 4076 - protein, 379 aa, Solanum phureja
MTELKKDQENHQQQQQEPQRRHLCDFCGNNTALLYCRADSAKLCFTCDREVHSTNQLFTKHTRWLLCNLCDSSPASILCCTESSVLCQNCDWESHNKQLSLHERRPLEGFSGCPSVSELLSILGFEDLGKKELLYGGDGSYGFSDWVIWDTPSVVSLDDLIANNDSEHNFQAIGVPPLPKNRNAACGKHKEEILSQLRELSKLEPNSGDDQDETVPTIGFQSMEPVQNCPLRFKGLGFMQNSDQHVVPSSEGSAFHWHGDTGEFADQGFSSSLMDCFIETKCLLPNRDSDVCDASGGANEEQSHNPPTTETFQMVPKVVHRELNSQERETAVSRYKEKKKTRRYEKHIRYESRKARAETRTRIKGRFAKMDYRDSSVHQ

SEQ ID NO: 4077 - protein, 376 aa, Solanum tuberosum
MTELKKDQENHQQQEQEPQSQHLCDFCGNNTALLYCRADSAKLCFTCDREVHSTNQLFTKHTRWLLCNLCDSSPASILCCTESSVLCQNCDWESHNKQLSLHERRPLEGFSGCPSVSELLSILGFEDLGKKELLYGGDGSYGFSDWVIWDTPSVVSLDDLIANNDSEHNFQAIGVPPLPKNRNAACGKHKEEILSQLRELSKLEPNSGDDQDETVPTIGFQSMEPVQNCPLRFKGLGFMQNSDQHVVPSSEGSAFHWHGDTGEFADSSSLMDCFIETKCLLPNRDSDVCDASGGANEEQSHNPPTTETFQMVPKVVHRELNSQERETAVSRYKEKKKTRRYEKHIRYESRKARAETRTRIKGRFAKMDYRDSSVHQ

SEQ ID NO: 4078 - protein, 470 aa, Solanum phureja
MTVEMQCEATQVAEVVVPQEELVAANKVEVNEKVKKDEEEESKPNTIEKSSSYREESNFLSDLKENEKKALNELKSIVEEAILGNTLFKKEETNKSPEEEGKNEENRDTVEGKEEEKEGDLDVVEVDREISIWGVPLLPSKGDEKTNVVLLKFLRARDYKVNESFEMLKKTLQWRKDFNIQSILEEDLGSDLAPAAYMSGVDNQGHPICYNIFGVLDDEEIYNKTFGTEEKRNQFLRWRVQLMEKGIQQLDFKAGGVSSLLQINDLKNSPGPSKKEVRVATKQAVDLLQDNYPEFVAKNIFINVPFWYYAVHSLLSPFLTQRTKSKFVFVRPAKVTETLLKYIPIHEIPIQYGGLKRENEFEFSVSDCEALEILLKAGSTETIEIPAVDVESTFIWDVTIVGGEVSYKEEFVPEDETSYTIIIQKDKKVSSTIHNTFKNTEAGKVVLTIKNSSSKKKKAFYRHKINKSAI

SEQ ID NO: 4079 - protein, 306 aa, Solanum tuberosum
MDNDTPSMIHDPLIDSTGEGGYALSGKIMLSAIVILFAVVVFMVGLHLYARWYLLSQRRRELLRRRRVHHRRTHIVFYVDNPGSGLSDANRGLEPVVLNSLPVFVYSDKTHPEPLECAVCLSEFEENEKGRVLPKCNHSFHSECIDMWFHSHSTCPLCRSPVEAVLIEPNNNRVEVAVTVNEPTEPGSSSGLCSSCEENSSHSNMTPLGCRRKGLDLTGVRIEVPRRNDFEADLEMGVRVSSPAIQSRSPATRLMSLRRILSMNRKTPTGTSHSPSGSCAAELDLESGGSNGGGKIQVGGERITTP

SEQ ID NO: 4080 - protein, 306 aa, Solanum phureja
MDNDTPSMIHDPLIDSTGEGGYALSGKIMLSAIVILFAVVVFMVGLHLYARWYLLSQRRRELLRRRRVHHRRTHIVFYVDNPGSGLSEANRGLEPVVLNSLPVFVYSDKTHPEPLECAVCLSEFEENEQGRVLPKCNHSFHSECIDMWFHSHSTCPLCRSPVEAVLIEPNNNRVEVAVTVNEPTEPGSSSGLCNSCEENSSHSNMTPLGCRRKGLDLTGVRIEVPRRNDFEADLEMGVRVSSPAIQSRSPATRLMSLRRILSMNRKTPTGTSHSPSGSCAAELDLESGGSNGGGKIQVGGERITTP

SEQ ID NO: 4081 - protein, 517 aa, Solanum phureja
MNPLLSQKIPISSSQIMNHNSLPNKRRRRRKETPTNSTGGAENNDDFGSENQGAVKTKELKQILTSLLLLEEQEKSEQEEFAKEEEENKHLFEANHKKTTKVMWDYYSNVQQHHSDLEQLDGVRKRKGRGNSAAVTATASACALASAAEEEVVSSNKSSEKGAPHRRLWVKNRSKAWWDLCNSPDFPEEEFKKAFRMGKDTFELICNELSSVVAKENTMLRDAVPVKQRVAVCIWRLATGEPLRLVSKRFGLGISTCHKLVLEVCTAIRTVLMPKYLQWPDEKKMRDIKDEYEDMSGITNVVGSMYTTHIPIIAPKISVAAYFNKRHTERNQKTSYSITVQGVVDPRGVFTDVCIGWPGSMPDDQVLEKSALFQRANTGLLNNVWIVGSSGYPLMDWILVPYTQQQLTWTQHAFNEKIGEVQRVAKEAFVRLKRRWSCLQKRTEVKLQDLPVVLGACCVLHNICQMRNEEMDPELNFELIDDEMVPEIQLRSTNARLARDAIAHNLLHHNHAGTSLL

SEQ ID NO: 4082 - protein, 391 aa, Solanum phureja
MRAASVFGGVFLVLAVYCGLDPFKHSAISEFPNFESFKVEMPAWSEIPVEKDSQNLLQKSEIKFLDQIQGPESIVFDPQGRGPYTGIADGRVVFWDGEKWNDFAYTSANRSGLCDPKPSPLSYMKNEHICGRPLGLRFDKRTGDLYIADAYLGLMKVGPEGGLAESLTTEAEGIPIGFANDLDVDDEGNVYFTDSSTKYQRRNFVQLVFSAEDSGKVLKYNPRTKETTVLIRNLQFPNGLSLSKDGSFFIFCEGSKGRLRKYWLKGEKAGTSEVIAILPGYPDNVRANERNEFWVAIHCRRTIYSYINAIYPQLRQFLLKLPISAKLQYLIHIGGRFTAVVVRYSSEGKLLQILEDRQGKVVRAVSEVEERDGKLWMGSVLMSFISVYQLE

SEQ ID NO: 4083 - protein, 614 aa, Solanum phureja
MAKTVSPDAISTILANPSPDSSSDLPEIIVQVVDLKPTGNRYMFSANDGKMKIKGILQSSLSSEVISGSIQNLGLIRIIDYTLNDIPTKNEKYLIVTKCESVSPALEAEYKAEVKSEDTGIVLKPKQEETGILLKPKQEYQTKSAAQIVHEQSGNMAPSARMAMTRRIQPLVSLNPYQGNWTIKVRVTSKGNMRTYKNARGEGCVFNVELTDEDGTQIQATMFNEAAKKFFDKFELGKVYYISKGTLRVANKQFKTVQNDYEMTLNETSQVEEACNEEAFIPETKFNFVPIDELGPYVNGRELVDVIGVVQSVSPTMSIRRKSNNETVPKRDITIADETKKTVVVSLWNDLATHVGQELLDMADKSPVVAIKSLKVGDFQGVSLSALSKSNIVVNPDLPEAKKLRSWYDSEGKETSLASIGSGMSPSAKSGARSMYTDRVSLLHITSNLSLGEEKPVFFSLKAYISFIKPDQTMWYRACKTCNKKVTEAFGSGYWCEGCQKNEAECSLRYIMALKVSDASGEAWLSTFNEQAEKILGCSADELDKLKSEEGEIAYQMKLKEATWVPHLFRVSVAPQEYNNEKRQRITVRAIAPVDYAAESKYLLEEMSKMNIAM

SEQ ID NO: 4084 - protein, 604 aa, Ipomoea nil
MERSVTPDAISAILANPSPDSGSDLPELIVQVVDLKQAGNRYMFTANDGKMKLKAILQSSLSSEVISGSIQNLGLVRILDYTLNDIPMKNEKYLIVTKCDAVSSPLEAEYKTGVKTEENGIVLRPKQEFVAKSAAQIVHEQNGNIVPPARLAMTRRIHPLVSLNPYQGIWTIKVRVTSKGNMRFYKNARGEGCVFNVELADQDGTEIQATMFNQAARKFYDKFELGKVYYISKGTLRVANKQFKTVQNDYEMTLNENSEVEEAINEAAFVPETKFNFVAIDELGSYVNGRELVDVIGVVQNVSSTMSIRRKSNNEMIPKRDITIADETKKTVVVSLWSDLATNVGQELLDMADKSPVVAIRSVKVGDFQGLSLSAITRSTVLVNPDMPEAKKLRSWYDCEGKETSLTSVGSGLSSSAKGVLWSMYSDRVSLLHITSNPNLGEDKPVFFSIKANISFIKPEQAMWYRACKTCNKKVTEAIGSGYWCEGCQKNDTDCSLRYIVAMRVSDTSGEAWLSVFNEQAEKIIGCSADELDRLRSQDGDSSAYQMKLKEATWVPYLFRVSVTPQEYNNEKRQRITVRAAAPVDFAAESRYFLEEMAKMNICV

SEQ ID NO: 4085 - protein, 444 aa, Unknown
  Sequence found in Organisms: Solanum tuberosum, Solanum phureja
MAAAKRVLDNSNPDTNQPNYKRMRSTTPSFASVIKEAMKANFLENLSSALEPMLRRVIPEEVENGLRRYSCRSLARSPSLRIKALEPSNLRLIFNKKLSQPIFTGSKVVAGGDDGQSLQILLVDTSGEGMVPTTLPYPIKVELVVLNGDFPSGDTETNWSREEFDKHVVKERTGKRPLLTGELNFTMRDGVVSVGEIEFTDNSSWIRSRKFRIGAKVVQIGNNQTTVRITEAVTESFVVKDHRGESYKKHYPPALGDEVWRLEKIGKDGTFRKKLSSKGINTVQDFLKLATIDTPQIRTILGTGMSDKMWEVTYKHAKTCEMGSKLFMARGPNYVLILTPICQLVRAVIDGQIYPTHDLPGIQKAYIQNLVKEAYGNWSSLEEVDGLVNETALLTQGEPMVDEYPNVHQQQQPMIRSYQQNTILTDASEQLVEYNDWIGNPNYI

SEQ ID NO: 4086 - protein, 703 aa, Solanum phureja
MAYQGGNLKSTAINGVKMYTVAGQHRSVATWLAPKKLRALRKDPGYMQRVDLIQDLRFETATTRIKVTPDGEYLIASGIYPPQVKVYELRELSLKFERHLVSEIVNFQVLGDDYSKIAFLCADRSVCLHAKYGSHHKLRIPRMGRDIIYDSWSCDLLCAASSPDLYRINLEQGRFLSSLSTQSPALNVVSRSKVHGLVACGGEDGALECFDMRARSSVGRINAVAPAGDGDQEVTAIEFEGDGGYLMAVGSSDGKVLIYDLRSSQPMRIKDHMYGSPILNIKWHKTLNTERTKLITADSHIVRVWDPETGEGMTSIEPTGGRINDLCAFTGSGLMLLALDSSQIPSYFIPSLGPAPKWCSYLENLTEELEEQPQTTIYDDYKFLTKEDLEKLNLTNLIGTNLLRAYMHGYFIDYRLYKKAHAASNPFAYDEYIEQRKKEKFEKERDSRITIKRRLPKVNRTLVEQLLENEEAENVKEDVDDVDAKKTSKKKKGLTMDVLEDERFKRIIENKDFEIEEDSHEYRALHPMPSLKRPSLVEEHFEPVMEGEEASDSDAQSSEDEQVNDKNSRKKARVPRMYEVKDDRHAEAFSNHLSLAKEDALSLGERVAGLSNGRASHDMNNIKVGPGGSREVSFFSRSSAKYVEDDGEKETRTEKRRGVQSLKLKPERSGFQGSGSRGRGRGGRGRGMGRGRGTGRGRGRGRG

SEQ ID NO: 4087 - DNA, 2000 bp, Wheat SPA Promoter
ttttctcttgcgagagccgctcacctcaaggccccccgccattcctgctgtgaactatagccagcggctggggatgatacaagcaggggcaaccaacgaccaccggagttgccacggttgtcactgatgttgcggtggcgccaccatgaagaccatgtccatgcggtggttggtgcagtttccagcggtgctacaaccgcggaacactaatgctgcaaccggtagcaggagctgttgcgaccgacgacgaaatttgctgccttgaggctgatggtaatggacaagacgagggcggacgccttggtgctacaaccagcatccggtgttgccggaacgacaaccgccatttgctgcaaccggcaatcatgcaacacagagaggaagataccgcgtgctgggatcggccgtcaccctgggcgcgacaaaaagctgcaaccattcgttggtaaagcttcaacctcctgatgaatttcctggaaccagtattcaattttgcttgaactggataattttttgctacaatcgatcaacgagagttcttgctggtaagttgtttttgctagaaccggtgttcaattttgctagaactatattttgctacaatcgatcaccccgagagttcttcttgatgagttgttttgctcgaaccagtattcaattctgctggaactgagtaattttttgcttcaaccaacaaatggtggatttgctgctttccaagttttttgttgggcacgactgtgcaagtcaacgatcgcggcggcgccgatggtgctccaaccatggtgaacgcgcgatggaaccagccgggccggagctgcaatggcctggttcccgagctatggacgcggcgtgcggtgactgcaagcttcagcagaagggtggcagggggctggatgatggtgctgcaaccagtagcggtgcaaggggacggggtgctgccgcccctcgatggagcgcacatgcatgggaccgagagcagagatgctcacggggaacaggaaggaggggatttcctgctcacgttgaccaaagcgagaggaaggagatgattcggtgaccgactacaaatcatcatatcaaacaattgggggccgaccggccaaaacgttcggtcggcgtgctagtggctaataatggcctaccggtatggaccacgttagtcaaatggtaagcgacgcatgtatataaggtatattaatgcgaccaactcgcaaggtccgtcacctatattcggagaacatatttctgtaatatataaatttaataggtaaagtcacatttatcattctcaaaagagggtggcccgtgtgaggaactcgtcctgagcaaagacgaggaggtttccactcaaccgttgtcactctagctatagtgtatattagaagttaagtgtttccgttaccttttcatatacaacaacaatttaaagttagaaaccctgtaaatcacatggaagcgtatggatcgcaacgagtcaaaataaacatggcgcattagtgacacgtattttaaactttctgttaacactttttgttctttcattaaaggatatttgtttgcattagcgttgtcatgctagacgagcacatacattacaacattattatgtgtttgttgtggtttctagagacaagacatgaacacctaaataaagaggacatggacgaaaaggttaaccgtaatagctcatgcaagatgacaagcaaaacatttcattgtatgaggttccgtggatcacacttctctatgtactctcagaaacgaaaacacttgtctagacgatggtagaccgtcggaataggtgaacatcttttgtacaacagaaagtatgactaacgtggcgccgcggccgaaactgcattatcagttcagctgaatttgtactgtatgtcatatctatctcgagtattcaagacagaaaaaccttgtgcagtagtagtactactgaaataaaatagacatgagaggatcgcaccctcaacccatctcattcagca

SEQ ID NO: 4088 - DNA, 1919 bp, Wheat LMW Longer Promoter
  misc_feature (1306)..(1316): n is a, c, g, or t
  misc_feature (1649)..(1649): n is a, c, g, or t
tatcatgatgacatttctatgtgctaaagattcttctacaaagccggttcaaatacaaaacaaatatgccaaaaaactacttaaattaccagtagcgagtgtacaaaagttagcagcagcgcctcaatagcagtagagcgtccggccaaagagcgctagcgctactagcggtagcgagcttctcataaccgcgctgctgctacacttgtgtagcagtagcgcgggtgctcacgcgttactgctatgagttagctgtagcgccgtattagtagcgcgggtacccgcactactgatacatctaaaacccgcgctgctgctagccttttccctagtagtgctagtcgatgtatctccccacaacctcacctctacaccggactacaaggaagtcttctgacggcgggaattgccgaagcacgcttgaccccacttgttcctcgccggacaaaagacatctagcgcggcataattcaaacgccacgctggaaccaatagtcgtagcggggcggtcaggaactgcgtcatctcgcttattaggcatgcttttcatatttttacttgcgaccctacagcacggttccgtgtcaatatcatagacttctagttgtggagttttgttttttcgtcgtcgacatgagaaatatatggtccacctgcttagcgcgcatagggggaaatttgatgattattggaacttttgaagtgaaattctcagaaagcacatagttatattcagctactaaagccacaaatgtacattactgtcaggcttcccagctgaattctgatgcctgaccctcctaatccgtgcagctagcatggagatgggtctgcctctcggatttatgtgcattgaatcgttggaagagacagacgaaacaaatcgataccttgtgttgatggggaggtcggagtggctgccgtcgacgtacggcccacaatcgacggaggagcttcaaaagtgaccttttttgtcgagcggtggtggtggtggtggggggccggatgttgagggtgggagggaggctgacgtctccgctgccgcggaggtacgtggaggggccgcgagcggtgggcgtccgggagaggctgcgacggcgagcggtccggccggcgaggaggacgaggaagggagggacgcagatccgcggagtgtgggctgggcttgtgtcgttggggcctacgagaactatagcccaaatcgaattggtgccctaacacacggcacttatgttgggcctaatctctcgctccaggctgggggcctctgttccagccccatctatcatttccccctagcgtcatnnnnnnnnnnnaaaaaaatccccctagcataaaaaaactatcatttcccccaaaaaaacccttcacaaatagatgaaactgatgatttatctaaaaaaataggcgaaactgatgatgacgtgtcaagagttaggaccggatatatgctagtaggagtagcttgtaagcaattaccatcctttacatgtaaagggaattcgatgagtcatgtcatgctctataggcgtcggttcatctaatcattttagaggaaaaatacaaagttagttctacacttagtcctacacaagttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4089 - DNA, 326 bp, Wheat LMW Promoter
  misc_feature (56)..(56): n is a, c, g, or t
agttttgcctttcttgtttatggatgacagcctatacaaggttccaaactcggttnacaaggttccaaactcggttgcaaaagtgatactatccagataagtgtgtgacatgtaaagtgaataaggtgagtcatatataccaaacatcaaggtttctgtactttatgtgtgatcatatgcacaactaaaaagcaactttgatgatcaatccaaaagtacgcgtgtagctagtgcaacctaacacattgtaccaaaaatcattttagatgcatccaaacagaattattaaagctaatgcaaagaagaaaagaggtggtgcccgggct

SEQ ID NO: 4090 - DNA, 2000 bp, Wheat HMW glutenin-1 longer Promoter
cctaccattagaagaacgtccggcaaagagatgcactgcaacatatgaccaaaacgtcatccatgatcgagtacaatttcttagtgcctttttcatcaaagttatatttgaaacattttagaaaatttgtcttaaattttttcccatggcgtttcgatcaaaaaaatgccttaaaacctacctatataaaggcaataagggaaaacacttcaggataccttcgaatctaaggtgtctttctttagatggtatgctaaactgttcttcatggcgcctcaaatcatcattctgcaagtaaagactaaaaataacgctaaatatggagttaaaggtttacaaacgacgagcggaaaaggagtcttatataattccagtagcatttattccattttgcttcacatagaaaatgtagctgaggtggtcgatgtttattttgactcgcgtgaggtcgccggttcgatctcagaagcaacgctggaatatcccatatagatttatttttcaggctgagtgatgctcgggtacctccagcgtatgggctgaaattcgccccccctgcaaatcatgggccctgtgacgttcgcacgggttgcacatgccttggcccgggcctactaggagtgtacctggattatgttggacgacgggagatgaaagggatgtattaattaacaaagataatgaagcttaattttcttatatgttgttaatattgacaagaaacaagctgctaactcaaagttacggttacatagtcgcaaccttttatatctaaataatatctctctctcaacatgcaaacatgccacctcagcatgtagcatgcatggaaattgtccacttcaacatgcaaccatgcatcaaaatttccattttactaggctatttatttgataaaatttcacaaatatacaataatcaaacacaatagatcatatgtgttttcagttttggttctcacattattactccaaatataaatgtttcgtataaccaaatttcattcaaatatactgcaaaacatttccgtgaaaacatgtggggtacatctagttataaggaaatattagtgatgtcctgcaagtgataaggccaaggagagaagaagtgcaccatctacagaggccagggaaagacaatggacatgcagagaggcgggggcggggaagaaacacatggagatcatagaagaacataagaggttaaacataggaggaggatataatggacaattaaatccacattacctgaactcatttgggaagtggaaaaatcccctattctggtgtaaatcaaactaattgacgcgagttttctctgaagattctatgttaattttagacatgaatgaccaaaggtttcagttagttgagttttgtcatcgaaaggtgtttacataagtccaaaaattctaccagcttttggtacggcgcgtcatagaacagataaatgttgtgagtcattggatagatattatgagtcatagcatggatttgtgttgcctggaaatctaactatgacaagaaacaaaacataaatgggcttttgaaagatgatttatcaacttaccttatccatgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 4091 - DNA, 425 bp, Wheat HMW glutenin-1 Promoter
catgcaagctaccttccactagtcgacatgcttagaagcttttagtgaccgcagatttgcaaaagcaatggctaacagacacccaaaccccaagaagcataaccacttctcttagataaaaatagcagatcgatatacaaacgtctacacttctgcaaacaatacccagaagccagaattaggattgaaccgattacgtggctttagcagaccgtccaaaaatctgttttgcaaagctccaattgctccttgcttatccagcttcttttgtgttggcaattgttcttttccaaccgactttattcttttcacatttcttcttaggctgaactaacctcgtcgtgcacacaaccattgtcctgaaccttcaccacgtccctataaaagcccaaccaatctccacaatttcatcatcacccacaaca

SEQ ID NO: 4092 - DNA, 595 bp, wheat alpha gliadin (B genome) Promoter
tcaagcttgtctagttacagtaacaacttgtggaacattacaaaatttatgtttgctagtaacttctagaacactacaacacttgacatgtataaggaatttgatgagtcatggcctactaaagcaagttatattactactcttatctatcttaacaggtcacacaagattacaaactaagttctgtatcagccatgcttatctagtttatgcataacaatttgcagaacattacaaacttagtttcggaaaaataggcaatctagattagtgtttgagctataaagtgaataagatgagtcatgcgtgttatcacacctctttggtggtggaatgatagtgcaacaacatgaaacttcagtgactagtccaagaatacacatgtaagtagtgccaccaaacacaacataccaaattatgattttgggaagcatccaagcactttccagacaagaaaatgccaattgtgaaagagatcataccatgggaactataaaaagccttgtagcatgatcatcatccttcctcacccatcattctcataagtagagcgcatcattcaagccaagcaagcagtggtcaatacaaatccacc

SEQ ID NO: 4093 - DNA, 1238 bp, wheat gamma gliadin Promoter
  misc_feature (1231)..(1231): n is a, c, g, or t
atacttatatagggtagcgatattcacttgggaggtcggggttgtgctcggggaagcaggggcttgccggacgcaaggctcggacggcctccacgcctctgttccgtgaacagaggagatgggatcctccaagtgggcggggccacaatagtttatagtaggcccatgtgcacagcaggtcttccatattttccctttttatctcctgtaatatttccaccactctattgcatttagtttatgcagcaaacgacttttgctataactgaaacttggcacataaatcaagcacacaattttggggtggcacaaaaagtttggggccaaattgaaatcacttaaattataattgcatttaaaagagctaaaagggtgtcgttggtccacagtttaatattcataggcattttaaaagtttccagaaaaaactttgctaatgtatgacagttatgtagtgaatattttcaacctaaggaacatttttaatttattttttataaaattataattcgacttggcattcgaatttggatttgagttttggtttgaaacggaaagaggattagtaaaatgattatgatgacatagcatcattaggcatgagattactgtagcatgacatcgggggtgttacacttgtacaatattcctacccttgacataaaaggagaatttgatgagtcatgtattgataacgtatacaacattactacccttgacataaaaggagaatttgatgagtcatgcattgataacatgtacaagattactatcagcttgttcatcttaccatcatattatacaacactacaagttagttttagaaagaacaagagtccacaacaaatatcagaatacttgcctgatctatcttaacaacatgcacaaggacacaaatttagtcccccgcaagctatgaagatttggtttatgtctaacaacttgtacagatccaaaaggaatgcaatccagataattgtttgacatgtaaagtgaataagatgagtcaatgccaattatcagtattcctcactcttagatgatatgtacaataaaaagacaactttgatgatcactctgaaattacgtttgtatgtagtgccaccaaacacaacataccaaataattagtttgataagcatcaaatcacttttaaaaaagaaagcaataatgaaaagaaacctaaccatggtagctataaaaaggcctacaatatgtagactccataccnactccat

SEQ ID NO: 4094 - DNA, 2162 bp, wheat TdPR60 longer Promoter
agaagaagaaggagcaccaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 4095 - DNA, 2147 bp, wheat TdPR60 Promoter
accaatacaatggagtttcacccggcttcacagccctgttacttttcccagagccccaaaaactctcctcaacaaatacactcgtggtcatggctttgtaggggcacaacaacgcagcgcccacgtttccttgtgcgcatgtacgcacgccgcctagctagcaaccctgcatgcaatcccatcagcccggccatgcgcactacatgcgcgctacgcacacgacgcggccatctccaccggtcactgctaacaatcatctaactaactcacacgcatcaagcaaacttggccggcacacttgccaacgccctgctctacgtgccagactcgagagtatacacgctacacacacatgcgccacgcttctgcgtcccgtacgtcccgcccgtcccgcatgtcatcgacgcgcccgtcaagcccgacgagcccgacggcaccagtgtgtcccgcctgtcccacgcgcacccgacgcgcccgacgagcccgatcacacatgtcgtggcttattccaaaacacaccccttaagccacggcctagaggagtccgtcatcgtcgacgttggcgccggctaagagtgcatgctccgccgccggtcctttccgcagctgcgggcactcgcgccggaagtgcccgtgctccccgtacttgtagcagcgcctgcgcctgtcgccgccgctccccgacgccacgctgcgcccgtcgtcgtcgtcccgagcaccgccgtgtcgacgctcccatgctgcccactgcgccaccgtcatgagcagctgctcacctccgcgctcgccgccgtcttgtccacagcgccgaacccgctcgtcgaacgcacgcagccgcccgagcgcttcgtcgaacgccatcgtcgtcacgtcgtggaactgctcgataccggcgacgacggggaagaggcgatccgacaccgtatcccagcaacttcttgacaagtgccgtgtcgcccagtgtctccccgaggttggcatacctcgccgccatcgccgcgagcctcccgccgtacacgtcgagctcctcgccgtccaccatcttcatccggtcgaatttgccatgcagcgtccccggcctcgctgcgcgtacccgatcagcgcggacgaacctcaccttcagggagtcccatacctccctgacggtgagcttcgtcgataccagcagcagcacatcctccggcaacgccccgagaagcaacgtgcgcaccatcttgtccttccgcgcgttcaccaccgcgtcgcccggcgccaccgcctcccatacggtgtggacgtcgaggatcgcctacgccttgatggcccagaccgtgtagttgtccgcggtcagcaaaggcatcgccatcgtcgccgattccgcccgcgccgccgccgtgtgggacgggcgccatggtcgccggtgatcgcccgaaccaaagctctgtatatcaattgttggaagcgctctctcacactgatggatggagatagaagaagaaggagcacacagtacaatggagtttcacccggcttcacagccctgttacttttcccagagccccaaaaactctcctcaacaaatacactcgtggtcatggctttgtagtggcacaacaacacaacgcccacgtttccttgtgcgcacgtatgcacaccgcctagctagctaccctgcatgcaatccatcagcccggccatgcgcactacatgcgcgctatgcgcatgacgcggccatctccaccggtcactgctaacaatcagctaactaactcacacgcatcaagcaaacttggccggcacacttgccaacgccctgctctatgtgctagactcgagtgtatacacgctacacacacatatgccacgcttctgcgtcccgcatgtcccgcacgtcaccgacgcgcctgacaagcccgacgagcccgacggcaccagtgtgtgccgcccgttccgcgtgcacccgatgcgctcgacgagcccgatcacacacgccgtggcttattccaacacctagatgtataattaatgtatacattaattgtctgacacggtgctatatcttcatgatatacaactggtgtatgcgtctgtatcatcatctcaaagaaggctatatataccaagacatagctagcgaagtcatgtatcccacacattcacagaagcca

SEQ ID NO: 4096 - DNA, 1992 bp, maize Ub1 Promoter (cultivar Nongda 105)
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 4097 - DNA, 1358 bp, Ub1 Promoter (cultivar B73)
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 4098 - DNA, 1266 bp, rice actin 1 Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 4099 - DNA, 2199 bp, rice GOS2 longer Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 4100 - DNA, 1024 bp, rice GOS2 Promoter
ggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 4101 - DNA, 2103 bp, arabidopsis Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 4102 - DNA, 901 bp, rice ExpB5 longer Promoter
gttgatgggccgtagaggagtataatggcaacgtttgacgagacatctagaaattataaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataattaaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 4103 - DNA, 844 bp, rice ExpB5 Promoter
taaaaataaaacccaacgtgacaataaactctaaaaactataaaatctattttttaaaggttccaagaagtatgaatagaaatagtgatagatcgagcaagcaaataaagaagaagatgacataaggggtagtaattggtgtgacttttaaaaactatataataaaaacacgagaatgatatggtttggtctttcaaagtcttaagataatgagatagctatttaacaaattttgaataaatcatattaaaatagataattttgtatgggtgctaattgcgcgggctacccagctagttcgattgaattgctgccactaagtgttactatacaacattctcctctaaaagaactatatatatttctccaaaagaaaaaggaactatatatgtaccatatgtacaaacattcgagtggccgggcatgatactcgctactttgctaggcacgttgcgcacgtacagctcacgctcaagtcgtacacattatggagtagccatttgacaaacgtacggatgacacaagacgaatatcaaattgcgaattttcaaagcgtttctaaccaacacaactaccttgtgagaatagtttatccaaacccttgcggctgcgtgatcacctccttcatgcaaggacctccgtaaagtccacaagtatactcttcgatcccacacacacatagttgacatacacatcaacacatgtacaaattcaagttgccacgttcacctcaataatgcttgggtacacataatttgctaccacgtttgtgaccgctaatcttccctataaataccaaccaaatcaaatcatcttaaaaatcaccgagcaatctccgcttaac

SEQ ID NO: 4104 - DNA, 602 bp, barley ExpB1 Promoter
cgtggagttgaaactggttcggggtttgcgtcgtcgcccaactcgcttgtccgtcggctccggccggtggtaaagacgaggagatggcaccgcaggaaaacaaggctgtcttcgatggccgacgacttgagacaccgttattttgatgaaggcaccatgaaggctttcggtgtcgctttaccttcgggggacatcgtttttggagtagctacaggctagagggatgggtcaggatggaccgtttatgaaacgtgcgaacattttatttgaagggtacgaaacattttgaaggctgcataggatggaccgttgaaccccacgtgcacgcaatcacgcaacaaacccggccggatgagtcctctttatccaaaatctccggagttgaaagagccttcagcgccatggctccgtcatcaaaggatcggccggctccgtctcagttgaccacagtgcaaagtatgtatgcgcaccctctccgtgaacaagttgccgccacgttcgcctccataattcgtgtgtgcacgactaaacgtattcgctcccacgtttataacacctagaccttccttatcctatatataccaaccaaccgaaccacccca

SEQ ID NO: 4105 - DNA, 1729 bp, Barley SS2 Promoter
gaattgtagtaagtcacgggtgtttatttgatccagactcttttgtaaactaaaggcctctacctacatataaaggagagccctcgagttagaaagatcaagtaaacaactctcgagagctaggttagtgattacgcatccttgtagttgagatccccatcaacatagacaccaaagcaggacgtaggcttttatctccattgaaggggccgaacctgggtaaatccacctctcgttcccgattaacctcttcgagtcgccacaccgccatgatggcctcaacactaagtccgttcacgagctaggtcatgtcgtttggtgacattggccctagactcggagcccgacatcatggggacgaggctccatcgctagggttgcgctccaccccgtgtagttagtcgccactctacctacaaccaatgctcaccacctccattccgtcgcgctcacgcaccttgagttgtcgacgccgctggaaccgagccccactcttgtggatgcaatggggccagagtgactccgacaacggagctcgagtttcctctcgggactagcaaagtgccagctggacgactaactcctcctcgtccgcacatgaggacgaggtcccacccgatggatccagagttgtcaaattcaggctcgctattggccatgtcagaaaagggtggagatcactagagaggagttgggggtggagcggagtggactcggagtgggtggttagggtttcgtttggatagggacacattatgaggccgaggtgggttggtcggggcaagattcaatgtgaagaatgtgtcggggcacctcatatgacatatatgaccggtttaagggtccgattagatggcattttcgtgactagaccgtccgctcagacataaatggacgtgttaagtgcaagacaagttacaaaccaacatgtatatcaaatttaagttctaaactacactcatgcttatatttttcttaaattatttcaaaccttccaacgatgcgacttcaccaggagatgtttctgtcatgaacatatatgcaaatgtattttgcgttaccgtgtttcaaaaagaaaaaagtattccatccgtttttaaatataaaaccttttagagattttactgtagactacgtactgcgatggaaattaaaatgcaaaccacatggcagcggcatacgagagccattcatcgctacaggacactttgcatcggtagccagctagtttccgacggtaccgacgagccgcagagaacttctaaatgcggtttttatgtgcagggacaaacgcgggtttctctgtctgcggaacagaaaaacaaattcggttcccagcaaaaacaaaacaaaacaaagaaacaaaaaaactgcggttgcacgtagtaacaaagtctgtcgcgcacggagcatctcatgcagccgatgatggctcgccagcacgaaaacacttgtcacggcgcgctcccacgaaccggaaacacttggcgcggtgcgtccctccgaaccgaagcacctgtctctaccgcctcgggaaccgggcgctaatctccaaatcaggccggaggcctccacggccgtcgatgcgatgccgccaagagccagtgcggaaaagagagtgtccttttcccccggccgcccggcgagaggaggtggcagcggcgcctgacgcacgcctcctgctggcagctcctccggcgcgccgcgtgtataaataggggcgcagcgc

SEQ ID NO: 4106 - DNA, 879 bp, rice PG5a Promoter
aagcttgcgcgcggaatacggtggtggagatgggttgggaaccctggattccaaacacagcccaagtctatccaaaatgtttagacaagaaaatacgtaacaagttggtttacagaaatagcaattagatcaatcctgcactacaagtagagtaaagtggtgatttctcttaaatctctcgaatggtgatttaagaattcagtgcaaaccaaatccttgctataatcaaatgttcggtaccccatcaacggaacaataaaaagcgcctggctaccataattttgtcattcttcttcaatttgtaatttaagatgcatgaggccacacgaccttaatgttcaacgtgtcatgcattagtgaaataatagctcacaaaacgcaacaaatatagctagataacggttgcaatccttaccaaactaacgtataaagtgagcgattagtcatatcattatctcccgcctgctaaccatcgtgtacaccatccgatccaaaaatgacaacttctagggatgaacctggacaaggtttagggtttagggatgaatctggacaatgattgttcaggttcatccctagatgttgctttctccttacgggacggagggagtatatgtgatggacacaaaagttactttcatgatgaaaggaaaggggatttgttggggcactaatagaacatctgtccaaatggcatgactcacttatatcctaataggacatccaagaaaaactaacactctaaagcaaccgatgaggaattgaaagaaaatacgtgccaccgcatctataaatggacaagcgcaatggaaaccctcctcatcgttcacacagttcaagcattatacagcaaaatagaaagatctatgtcccagagca

SEQ ID NO: 4107 - DNA, 666 bp, CaMV 35S (QFNC) Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 4108 - DNA, 781 bp, PJJ 35S from Brachypodium Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 4109 - DNA, 877 bp, CaMV 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 4110 - DNA, 2322 bp, Arabidopsis At6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 4111 - DNA, 2318 bp, Arabidopsis At6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 4112 - DNA, 1321 bp, RBCS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 4113 - DNA, 1599 bp, Arabidopsis AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 4114 - DNA, 1774 bp, Arabidopsis AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 4115 - DNA, 1127 bp, Brassica napus NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 4116 - DNA, 916 bp, Arabidopsis AT1G61720 (BAN) Promoter
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 4117 - DNA, 3965 bp, Arabidopsis ABI3 (AT3G24650) longer Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgt

SEQ ID NO: 4118 - DNA, 4074 bp, Arabidopsis ABI3 (AT3G24650) Promoter
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaacttt

SEQ ID NO: 4119 - DNA, 1700 bp, Arabidopsis (AT1G69120) APETALA 1
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 4120 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 4121 - DNA, 2432 bp, arabidopsis ATTPS-CIN (AT3G25820) Promoter
atgtcaattttcatggcacatcgaggagaaactgtttccttgtggtaatcctttataatctctgttgctaggaggagatttttcattaatagtctatctttcacaaaggcagattgatttgaagagatgaacttgggaagaatgattttgagtctgtttgcaagaatcttcgatatcaccttatagagaacattacagcatgatatcggtctatagtccttcatcatcacagcttcttttctcttgggtatcaaggccaaaatagtggagtttactcctttgggtaggaagcctgtcttaaaaaaagattggatggctaccacaaaatcgtttcctactatcgaccatgtctcgttaaagaactcacaagtatatccgtcagggcctggggatttatttgaaggcattgagaagagaactttccgcacctcctctgcagtgacttctagtgtgagcttgtcttgtcattctcatcacatctataatccagtagagtttccagttcctcccgcgaccaatccacgtagtctggcggtttgagcgttaaaaagtctctgaagtatcgaactgcctctgcttttatttgctgctgatttgatgcaatatgtccatcatcacacttaatctctctaacattgttacgaacctcccgaatctttgcagcattgtagaaagttttattattttggtctcctatcttcatccaatgcagttttgctttttgcctaaggtagctttcctcaatacccgacagccttaaccacttctcatatgcgtccgcttcagctaccactgcctgtgaagatggccttgtcatagtttctgcttgcttttcacataaagttttataggcttcttttgctttttttgagatatcaccaagtaactgcttccccatctttctgaaatgtggcttcagaccttttaatttttttgataagcggtgcatggctgaggtagaatgaaagagaggctgagttgtcttccaaagctcttctgtctcacttctgaaatccgaatacgaaattaaagcatttataaatttaaaaggcctcttgactcgttgttcctgctccataatatagaatcgacatcttaggtgatctgaacaaccgcctgattcaaagacgctgtaggactgttcatactattgcatccattgcttgctaatcagtaccctatccagcttcttacatattactccttcctttctcttgttacaccatgtgtatctctggccttggtagctcatatctgttaattcacaatgtctgattaagtcttgaaaatctctcatcccttggagaacgaatggagatgattcatagagtgaatggtcctctccttctaatatctcattaaagtctccacatattaaccaagctttgttatagaacaaaggggaatcatgatgatatttaatatcactccacaaatcctttctttctgctgcaaaatttgatgcataaacaaacgacacaaagaactcttcttgtcttccttctaataagacagagcaagtgatgagttgtgacgtcttatatattggagatacacgcacgttatcttctattatctttcaatagtaatttgatataaattaagataatgtgcagtgaacgagtggcgattgttaagccaagtgaacattatatactttattttatactttctccaagcttcgaatggagaatttatttccatacgactaactctacctaaaagggccatgtttgtttgccaacataacacgacgatcacgagatacacataacatttagaatttggagaagatacattttgtttgacttcactttttgtgcgaatggctgttctacctgaaggggccattagtataatttttttgtacataataacgtcaccaaatataacacgagaatcacgaggtacacaaatcatttaggcttggacattatctaatcaaataagctatgatatcaaatttacatacatatagtggcctcgtgggtataattacacaaggagcttttggagaaaaagaagtgtgtgatttaaatgacaattatacaaatgtgtacaattatcagatccaaagttcatgttttaaatcatcaaaaaaataataattgatgagttaaatgatatttttttcatttagatttagttagattagttgtacggttgtaccattatttaataatttaaaagttgaaatgattataatgtataaaagttgaaaatattgtaacagatatagattaagcatttttgcggtcaatatattataaaagcttttttagctattaattgaaaaatattttacacccttagatcttttgatctcctaattatataaaatattttcttctaccgtttgtctatataaccatatgtgttgtctagtgcatgtattcagccacgaataagagaatagtctactaaatcaatgg

SEQ ID NO: 4122 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 4123 - DNA, 30 bp, Artificial Sequence
  Primer
aaagtcgactttgaagcaacataacaaacg

SEQ ID NO: 4124 - DNA, 31 bp, Artificial Sequence
  Primer
aaagtcgacgtctgaagaaagaaaccgaatc

SEQ ID NO: 4125 - DNA, 33 bp, Artificial Sequence
  Primer
aaaggatccaatcagagagagagcttctgagac

SEQ ID NO: 4126 - DNA, 31 bp, Artificial Sequence
  Primer
aaaggatccactgcagtctcttcttgtttcg

SEQ ID NO: 4127 - DNA, 35 bp, Artificial Sequence
  Primer
aaaggatcctcatttctctctagtctatatcgctc

SEQ ID NO: 4128 - DNA, 28 bp, Artificial Sequence
  Primer
aaaggatcccacacctccaaatttgctc

SEQ ID NO: 4129 - DNA, 31 bp, Artificial Sequence
  Primer
aaagtcgacctaatggaatctttcgagcatc

SEQ ID NO: 4130 - DNA, 31 bp, Artificial Sequence
  Primer
aaagtcgacaaacctagtttccttgtgcttc

SEQ ID NO: 4131 - DNA, 31 bp, Artificial Sequence
  Primer
aaaggatccctcatctttctcgtctctgaac

SEQ ID NO: 4132 - DNA, 31 bp, Artificial Sequence
  Primer
aaactcgagaactgagccacaatgatgatac

SEQ ID NO: 4133 - DNA, 30 bp, Artificial Sequence
  Primer
aaaggatccacgaactctacaccacattcc

SEQ ID NO: 4134 - DNA, 30 bp, Artificial Sequence
  Primer
aaaggatccgggtttcttctcccttcctac

SEQ ID NO: 4135 - DNA, 33 bp, Artificial Sequence
  Primer
aaaggatccagtttcaacaaacaatatcaatgg

SEQ ID NO: 4136 - DNA, 32 bp, Artificial Sequence
  Primer
aaagtcgactaagacagagacacaaaggcgag

SEQ ID NO: 4137 - DNA, 35 bp, Artificial Sequence
  Primer
aaaggatccagttacaattttctgtgttctttctg

SEQ ID NO: 4138 - DNA, 28 bp, Artificial Sequence
  Primer
aaaggatccctgcaatggcgtctcttca

SEQ ID NO: 4139 - DNA, 31 bp, Artificial Sequence
  Primer
aaaggatccacactgacatggactgaaggag

SEQ ID NO: 4140 - DNA, 29 bp, Artificial Sequence
  Primer
aaaggatccgagaaacccatctccccttc

SEQ ID NO: 4141 - DNA, 31 bp, Artificial Sequence
  Primer
aaaggatcccccttattcttctcccagaacc

SEQ ID NO: 4142 - DNA, 31 bp, Artificial Sequence
  Primer
aaagtcgacggccttgtagaaccttcctttg

SEQ ID NO: 4143 - DNA, 26 bp, Artificial Sequence
  Primer
tttgaattcacctcgatgggccactg

SEQ ID NO: 4144 - DNA, 31 bp, Artificial Sequence
  Primer
aaagtcgacggttgagagagtgaagcgaaag

SEQ ID NO: 4145 - DNA, 35 bp, Artificial Sequence
  Primer
aaaggatccctctctggaactctcatcatcttatc

SEQ ID NO: 4146 - DNA, 30 bp, Artificial Sequence
  Primer
aaactcgagatccatcaaacaaacaccacc

SEQ ID NO: 4147 - DNA, 31 bp, Artificial Sequence
  Primer
aaaggatccgtttatcgcaatccacttcgtc

SEQ ID NO: 4148 - DNA, 36 bp, Artificial Sequence
  Primer
aaaggatccgtttaactgaacaaactagtaatggct

SEQ ID NO: 4149 - DNA, 32 bp, Artificial Sequence
  Primer
aaagtcgacgcatcatttgaagttggtagtcc

SEQ ID NO: 4150 - DNA, 32 bp, Artificial Sequence
  Primer
aaaggatccaagatcttaattctccttccgag

SEQ ID NO: 4151 - DNA, 31 bp, Artificial Sequence
  Primer
aaaggatcccatgttatcttccacaatccag

SEQ ID NO: 4152 - DNA, 30 bp, Artificial Sequence
  Primer
tttggatccccacaatggttaggttttcct

SEQ ID NO: 4153 - DNA, 33 bp, Artificial Sequence
  Primer
aaactcgagcacataaaaaatggcttcagcttc

SEQ ID NO: 4154 - DNA, 27 bp, Artificial Sequence
  Primer
aaaggatcccaaggtgcagtaccaacg

SEQ ID NO: 4155 - DNA, 29 bp, Artificial Sequence
  Primer
aaaggatccatcgccaccttacccttatc

SEQ ID NO: 4156 - DNA, 32 bp, Artificial Sequence
  Primer
aaaggatccccaatctagggttagcttcattc

SEQ ID NO: 4157 - DNA, 31 bp, Artificial Sequence
  Primer
aaaggatccatagaccgaagcaaattctctc

SEQ ID NO: 4158 - DNA, 33 bp, Artificial Sequence
  Primer
aaagtcgacgttcttgtcttcctatattgcgtg

SEQ ID NO: 4159 - DNA, 33 bp, Artificial Sequence
  Primer
aaaggatccgggacatcaattctagtgaagaag

SEQ ID NO: 4160 - DNA, 32 bp, Artificial Sequence
  Primer
aaaggatccagcaaagttcataatccaagaag

SEQ ID NO: 4161 - DNA, 32 bp, Artificial Sequence
  Primer
aaaggatccgctttgtttcaactcattcattc

SEQ ID NO: 4162 - DNA, 28 bp, Artificial Sequence
  Primer
aaagtcgacatcattccagcttcattgc

SEQ ID NO: 4163 - DNA, 32 bp, Artificial Sequence
  Primer
aaaggatcccacatactcaaagtgacaagtcc

SEQ ID NO: 4164 - DNA, 31 bp, Artificial Sequence
  Primer
aaaggatccaatcacgtttgtggagctaaag

SEQ ID NO: 4165 - DNA, 31 bp, Artificial Sequence
  Primer
aagtcgacaccttcaacaactgaggtcatag

SEQ ID NO: 4166 - DNA, 31 bp, Artificial Sequence
  Primer
aaagtcgacaagattgaagcggtgagtttac

SEQ ID NO: 4167 - DNA, 29 bp, Artificial Sequence
  Primer
aaagtcgacaccaaaatggcattctcatc

SEQ ID NO: 4168 - DNA, 31 bp, Artificial Sequence
  Primer
aaaggatccagaataggcaaagattacgtgg

SEQ ID NO: 4169 - DNA, 31 bp, Artificial Sequence
  Primer
tatggatccccacaaacaactctcctttttc

SEQ ID NO: 4170 - DNA, 33 bp, Artificial Sequence
  Primer
aaagtcgacccctaaaccctagcaaattacctg

SEQ ID NO: 4171 - DNA, 34 bp, Artificial Sequence
  Primer
aaaggatccccaaagggtggtagtagtagtattg

SEQ ID NO: 4172 - DNA, 31 bp, Artificial Sequence
  Primer
aaaggatccgttctctgcattcattccattc

SEQ ID NO: 4173 - DNA, 35 bp, Artificial Sequence
  Primer
aaaggatccgtagacatgtcttttgcagtaacaac

SEQ ID NO: 4174 - DNA, 29 bp, Artificial Sequence
  Primer
tttgaattccggtagtgggaaaaatgtcg

SEQ ID NO: 4175 - DNA, 35 bp, Artificial Sequence
  Primer
tttgtcgacccaaaaatgacttcttcctcttcttc

SEQ ID NO: 4176 - DNA, 26 bp, Artificial Sequence
  Primer
tttctcgagcatcaatggcggttcct

SEQ ID NO: 4177 - DNA, 33 bp, Artificial Sequence
  Primer
aaagtcgacactcctcaacattaatcacacttg

SEQ ID NO: 4178 - DNA, 30 bp, Artificial Sequence
  Primer
aaaggatccaatcaatcgaacatgaacatg

SEQ ID NO: 4179 - DNA, 33 bp, Artificial Sequence
  Primer
aaagaattccacacactccacctaatcttcttc

SEQ ID NO: 4180 - DNA, 31 bp, Artificial Sequence
  Primer
aaaggatcctctgatcaactggtgagtttgg

SEQ ID NO: 4181 - DNA, 30 bp, Artificial Sequence
  Primer
aaagaattcgattcccttcgcttcctactc

SEQ ID NO: 4182 - DNA, 30 bp, Artificial Sequence
  Primer
aaagtcgaccaaatccttctcgagcaacag

SEQ ID NO: 4183 - DNA, 31 bp, Artificial Sequence
  Primer
aaaggatcccccactatctccctaaccactg

SEQ ID NO: 4184 - DNA, 31 bp, Artificial Sequence
  Primer
aaaggatcccccacataccaagaacagtgtc

SEQ ID NO: 4185 - DNA, 30 bp, Artificial Sequence
  Primer
aaaggatcccttcctcgtcacttcccaatc

SEQ ID NO: 4186 - DNA, 31 bp, Artificial Sequence
  Primer
aaaggatcccttcctcaacactcaacacagc

SEQ ID NO: 4187 - DNA, 31 bp, Artificial Sequence
  Primer
aaaggatccgcccgctataaactggactagg

SEQ ID NO: 4188 - DNA, 31 bp, Artificial Sequence
  Primer
aaactcgagccgccaaggatacatacgatac

SEQ ID NO: 4189 - DNA, 26 bp, Artificial Sequence
  Primer
aaaggatccctggtagccatggaccg

SEQ ID NO: 4190 - DNA, 29 bp, Artificial Sequence
  Primer
aaaggatccaatcacggtagcagaagcag

SEQ ID NO: 4191 - DNA, 34 bp, Artificial Sequence
  Primer
aaaggatccgctctccatataatttccaaactcc

SEQ ID NO: 4192 - DNA, 26 bp, Artificial Sequence
  Primer
aaagtcgacgcaccggaagctggatc

SEQ ID NO: 4193 - DNA, 27 bp, Artificial Sequence
  Primer
aaagtcgacgccaccatgagggtcttg

SEQ ID NO: 4194 - DNA, 27 bp, Artificial Sequence
  Primer
aacggatcctttctctctccccgcgat

SEQ ID NO: 4195 - DNA, 30 bp, Artificial Sequence
  Primer
aaaggatccgttccagaccacatacagagg

SEQ ID NO: 4196 - DNA, 31 bp, Artificial Sequence
  Primer
aaaggatcctctattggagagaagcaaccac

SEQ ID NO: 4197 - DNA, 36 bp, Artificial Sequence
  Primer
aaagtcgacggtacactactcactaatcatcatcac

SEQ ID NO: 4198 - DNA, 34 bp, Artificial Sequence
  Primer
aaaggatcctgacctcattgttgatagttgatac

SEQ ID NO: 4199 - DNA, 28 bp, Artificial Sequence
  Primer
aaaggatcctgaaggagttgcagtccag

SEQ ID NO: 4200 - DNA, 28 bp, Artificial Sequence
  Primer
aaagtcgaccacgataggaggcactacg

SEQ ID NO: 4201 - DNA, 29 bp, Artificial Sequence
  Primer
aaaggatccctcccacggaagacttcaac

SEQ ID NO: 4202 - DNA, 31 bp, Artificial Sequence
  Primer
aaaggatcccctacacactttcttccaatgg

SEQ ID NO: 4203 - DNA, 29 bp, Artificial Sequence
  Primer
aaagtcgacctctccaatccatcgctatc

SEQ ID NO: 4204 - DNA, 32 bp, Artificial Sequence
  Primer
aaaggatcctcctcactattcacttcctcaac

SEQ ID NO: 4205 - DNA, 32 bp, Artificial Sequence
  Primer
aaaggatcccctccaaaggttgttatggatag

SEQ ID NO: 4206 - DNA, 32 bp, Artificial Sequence
  Primer
aaactcgagttctaccttctccaaaaccatcc

SEQ ID NO: 4207 - DNA, 30 bp, Artificial Sequence
  Primer
aaaggatccttcatcacaccaaatttgacc

SEQ ID NO: 4208 - DNA, 34 bp, Artificial Sequence
  Primer
aaaggatccgatacagataacgtgaaactgaaag

SEQ ID NO: 4209 - DNA, 31 bp, Artificial Sequence
  Primer
aaaggatccataaccgaaccacaaaagggtg

SEQ ID NO: 4210 - DNA, 31 bp, Artificial Sequence
  Primer
aaagtcgacttcttcttgaatccctcaaacc

SEQ ID NO: 4211 - DNA, 31 bp, Artificial Sequence
  Primer
aaaggatccttaatgttgtcgaattctggtg

SEQ ID NO: 4212 - DNA, 31 bp, Artificial Sequence
  Primer
aaagtcgacaggaagtttctgaagcaatagg

SEQ ID NO: 4213 - DNA, 33 bp, Artificial Sequence
  Primer
aaagtcgacctaacaccagctactactccctcc

SEQ ID NO: 4214 - DNA, 33 bp, Artificial Sequence
  Primer
aaagtcgacatctatctacatggacatgaacga

SEQ ID NO: 4215 - DNA, 40 bp, Artificial Sequence
  Primer
aaagtcgacgaaaaatgggaggaagaatgcacacgaaatc

SEQ ID NO: 4216 - DNA, 29 bp, Artificial Sequence
  Primer
ttaggatccccaaaaccgaatccacttct

SEQ ID NO: 4217 - DNA, 31 bp, Artificial Sequence
  Primer
aaaggatcccgaatccaattctctctctctc

SEQ ID NO: 4218 - DNA, 34 bp, Artificial Sequence
  Primer
aaagtcgacaagagttctaagctttgtctgtgac

SEQ ID NO: 4219 - DNA, 30 bp, Artificial Sequence
  Primer
aaaggatccgagtcatgactatggctggag

SEQ ID NO: 4220 - DNA, 31 bp, Artificial Sequence
  Primer
aaagtcgacagtgttagcggttctggttctg

SEQ ID NO: 4221 - DNA, 34 bp, Artificial Sequence
  Primer
aaaggatcctctgtggttctgttgtgttatgttc

SEQ ID NO: 4222 - DNA, 34 bp, Artificial Sequence
  Primer
aaaggatcccagtaagtaaagagaagcagtttcc

SEQ ID NO: 4223 - DNA, 28 bp, Artificial Sequence
  Primer
aaaggatccctgctgcgtcttcttcatc

SEQ ID NO: 4224 - DNA, 31 bp, Artificial Sequence
  Primer
aaaggatccacgttctcactcaaacctcttc

SEQ ID NO: 4225 - DNA, 33 bp, Artificial Sequence
  Primer
aaaggatccaaaccattagcaaactagtgacag

SEQ ID NO: 4226 - DNA, 31 bp, Artificial Sequence
  Primer
aaagtcgacagagtcttgtgttgttcacctg

SEQ ID NO: 4227 - DNA, 30 bp, Artificial Sequence
  Primer
aaaggatccaaagaactcgaaagaaggagg

SEQ ID NO: 4228 - DNA, 30 bp, Artificial Sequence
  Primer
aaaggatccattcattccaccacactctgc

SEQ ID NO: 4229 - DNA, 29 bp, Artificial Sequence
  Primer
aaagtcgacgtaccttcccttgctccttc

SEQ ID NO: 4230 - DNA, 34 bp, Artificial Sequence
  Primer
aaaggatccgagcgtgttaacaagaaatttagag

SEQ ID NO: 4231 - DNA, 33 bp, Artificial Sequence
  Primer
aaaggatccgcagttgttatctctcaattttcc

SEQ ID NO: 4232 - DNA, 33 bp, Artificial Sequence
  Primer
aaaggatcctgattcaaatttcttttgctatgg

SEQ ID NO: 4233 - DNA, 31 bp, Artificial Sequence
  Primer
aaaggatccatctgaattgaaagagaccagc

SEQ ID NO: 4234 - DNA, 31 bp, Artificial Sequence
  Primer
aaaggatccatcttgatgcttcccagtttac

SEQ ID NO: 4235 - DNA, 31 bp, Artificial Sequence
  Primer
aaagtcgacacgtttcgtccaatcaaatatc

SEQ ID NO: 4236 - DNA, 35 bp, Artificial Sequence
  Primer
aaaggatcccttcttcttcatcactcactgtaatg

SEQ ID NO: 4237 - DNA, 33 bp, Artificial Sequence
  Primer
aaagtcgacttggtaatcaatcaccagaaagtg

SEQ ID NO: 4238 - DNA, 31 bp, Artificial Sequence
  Primer
aagtcgacactctgagggtatgcaaagaatc

SEQ ID NO: 4239 - DNA, 30 bp, Artificial Sequence
  Primer
tttggatcctttgtgggcttttatcagttg

SEQ ID NO: 4240 - DNA, 31 bp, Artificial Sequence
  Primer
aaaggatccacattatgttctcatgccacac

SEQ ID NO: 4241 - DNA, 34 bp, Artificial Sequence
  Primer
aaaggatccaatatttaacaacgaaagttgatcg

SEQ ID NO: 4242 - DNA, 30 bp, Artificial Sequence
  Primer
aaaggatccccattcttcaccaactgactc

SEQ ID NO: 4243 - DNA, 28 bp, Artificial Sequence
  Primer
aaaggatccgttgcatggccaataaagt

SEQ ID NO: 4244 - DNA, 31 bp, Artificial Sequence
  Primer
aaaggatcctcttatctccaaacgccataac

SEQ ID NO: 4245 - DNA, 28 bp, Artificial Sequence
  Primer
aaaggatccgagagaagtacggccaatg

SEQ ID NO: 4246 - DNA, 31 bp, Artificial Sequence
  Primer
aaaggatccctctttcattccctatttggag

SEQ ID NO: 4247 - DNA, 31 bp, Artificial Sequence
  Primer
aaaggatcccgtgccctagttgtgtatactg

SEQ ID NO: 4248 - DNA, 31 bp, Artificial Sequence
  Primer
aaagtcgacttaatgtctccactctttctgg

SEQ ID NO: 4249 - DNA, 31 bp, Artificial Sequence
  Primer
aaaggatccaaacccatgtctcatctttctc

SEQ ID NO: 4250 - DNA, 30 bp, Artificial Sequence
  Primer
aaaggatcccaaagcaacctcattcaactc

SEQ ID NO: 4251 - DNA, 32 bp, Artificial Sequence
  Primer
aaaggatccccaattctaaccgctttacttgc

SEQ ID NO: 4252 - DNA, 33 bp, Artificial Sequence
  Primer
aaagtcgacatcaagaactttcctccttctctc

SEQ ID NO: 4253 - DNA, 29 bp, Artificial Sequence
  Primer
aaagtcgacttcaacaggcccaaagtctc

SEQ ID NO: 4254 - DNA, 31 bp, Artificial Sequence
  Primer
aaagtcgaccgtacgcgttacactatctctc

SEQ ID NO: 4255 - DNA, 36 bp, Artificial Sequence
  Primer
aaaggatcctcaatggagattgtatcttaaatcctg

SEQ ID NO: 4256 - DNA, 32 bp, Artificial Sequence
  Primer
aaagtcgacaccttgttagatagccaacattc

SEQ ID NO: 4257 - DNA, 27 bp, Artificial Sequence
  Primer
aaagtcgacaaacaatggcgaaaatgg

SEQ ID NO: 4258 - DNA, 32 bp, Artificial Sequence
  Primer
aaaggatcccactttttcttcattcaccatgg

SEQ ID NO: 4259 - DNA, 31 bp, Artificial Sequence
  Primer
aaagtcgactcctgtcacccttactcttacc

SEQ ID NO: 4260 - DNA, 35 bp, Artificial Sequence
  Primer
aaagtcgaccacaacatctactgagaatttactcc

SEQ ID NO: 4261 - DNA, 34 bp, Artificial Sequence
  Primer
aaaggatccatcaaacaaaacctatcttttctcc

SEQ ID NO: 4262 - DNA, 36 bp, Artificial Sequence
  Primer
aaaggatccaacactagagaagaagaagatcatcaa

SEQ ID NO: 4263 - DNA, 30 bp, Artificial Sequence
  Primer
aaaggatccttctccctctttggaattcag

SEQ ID NO: 4264 - DNA, 30 bp, Artificial Sequence
  Primer
aaaggatcctaacaaacaatttcaccgtgc

SEQ ID NO: 4265 - DNA, 33 bp, Artificial Sequence
  Primer
aaaggatccacctctagtgttgtgtacctatgg

SEQ ID NO: 4266 - DNA, 30 bp, Artificial Sequence
  Primer
aaagtcgacggtcactctgttcttctgtgc

SEQ ID NO: 4267 - DNA, 33 bp, Artificial Sequence
  Primer
aaaggatccctaacactcgagaactactgcgac

SEQ ID NO: 4268 - DNA, 30 bp, Artificial Sequence
  Primer
aaaggatccccgtacagaaattacatgcag

SEQ ID NO: 4269 - DNA, 32 bp, Artificial Sequence
  Primer
aaaggtaccgaaatcaaaccgaagttgataag

SEQ ID NO: 4270 - DNA, 34 bp, Artificial Sequence
  Primer
aaaggtacctctaagcccttaatgttacaacaac

SEQ ID NO: 4271 - DNA, 31 bp, Artificial Sequence
  Primer
aaaggtaccttaccggttataatacagcacg

SEQ ID NO: 4272 - DNA, 34 bp, Artificial Sequence
  Primer
aaaggtaccttcataatcaagaatcgaacagtag

SEQ ID NO: 4273 - DNA, 33 bp, Artificial Sequence
  Primer
aaagaattctgaatttcatctactttgcttctc

SEQ ID NO: 4274 - DNA, 33 bp, Artificial Sequence
  Primer
aaaaggccttggattaaatttaccaaagcagag

SEQ ID NO: 4275 - DNA, 31 bp, Artificial Sequence
  Primer
aaaggtaccaccgaacaactgtcaataactg

SEQ ID NO: 4276 - DNA, 31 bp, Artificial Sequence
  Primer
aaagaattcatacaatatgatgggcattgag

SEQ ID NO: 4277 - DNA, 32 bp, Artificial Sequence
  Primer
aaaggtaccggagctaaatattgtattcgtcg

SEQ ID NO: 4278 - DNA, 30 bp, Artificial Sequence
  Primer
aaaggtacccaacctcggattcattatttg

SEQ ID NO: 4279 - DNA, 31 bp, Artificial Sequence
  Primer
aaaggtacctttaacctatctcgaccattcc

SEQ ID NO: 4280 - DNA, 31 bp, Artificial Sequence
  Primer
aaagaattcccggagaacctaagatcctttc

SEQ ID NO: 4281 - DNA, 34 bp, Artificial Sequence
  Primer
aaaggtaccctatgagagatacgaaggactttga

SEQ ID NO: 4282 - DNA, 37 bp, Artificial Sequence
  Primer
aaaggtaccctaaaagaagcggttgtcaatacaattt

SEQ ID NO: 4283 - DNA, 30 bp, Artificial Sequence
  Primer
aaaggtacctcttccgatctccaacaaaac

SEQ ID NO: 4284 - DNA, 31 bp, Artificial Sequence
  Primer
aaaggtaccctggctgctcctaacaagaaac

SEQ ID NO: 4285 - DNA, 31 bp, Artificial Sequence
  Primer
aaaggtacctgtccatccaacacaagctaac

SEQ ID NO: 4286 - DNA, 32 bp, Artificial Sequence
  Primer
aaaaggcctaaatgttcagtttggtgctcaag

SEQ ID NO: 4287 - DNA, 34 bp, Artificial Sequence
  Primer
aaaggtacctcattgactcaacactaccaacatg

SEQ ID NO: 4288 - DNA, 31 bp, Artificial Sequence
  Primer
aaaaggcctactcaaccacacactgatcacc

SEQ ID NO: 4289 - DNA, 31 bp, Artificial Sequence
  Primer
aaaggtaccatccataacatggctactctgc

SEQ ID NO: 4290 - DNA, 37 bp, Artificial Sequence
  Primer
tttgaattcttagaataactagttgccaagagatccc

SEQ ID NO: 4291 - DNA, 31 bp, Artificial Sequence
  Primer
aaaggtaccagctcgttcacatgccactaag

SEQ ID NO: 4292 - DNA, 31 bp, Artificial Sequence
  Primer
aaaggtaccgggtggaataatcagaaacaaa

SEQ ID NO: 4293 - DNA, 32 bp, Artificial Sequence
  Primer
tttgaattcctaggcctaaagagaatcggtgg

SEQ ID NO: 4294 - DNA, 30 bp, Artificial Sequence
  Primer
aaaggtaccttatgttccttctcggcatac

SEQ ID NO: 4295 - DNA, 31 bp, Artificial Sequence
  Primer
aaaggtacctgaattgatacccatgtttcag

SEQ ID NO: 4296 - DNA, 36 bp, Artificial Sequence
  Primer
aaaggtaccttaccagattccactcatcaaagtaac

SEQ ID NO: 4297 - DNA, 32 bp, Artificial Sequence
  Primer
aaagaattcatcaacctgcccataatcactac

SEQ ID NO: 4298 - DNA, 31 bp, Artificial Sequence
  Primer
aaaggtaccctgctactttgagcgattactg

SEQ ID NO: 4299 - DNA, 31 bp, Artificial Sequence
  Primer
aaaggtaccatctctaccaaagcaatgcaag

SEQ ID NO: 4300 - DNA, 31 bp, Artificial Sequence
  Primer
aaaggtaccgcaatttgtaacagctcatttg

SEQ ID NO: 4301 - DNA, 31 bp, Artificial Sequence
  Primer
aaaggtaccggcaacatattaccatctcgtc

SEQ ID NO: 4302 - DNA, 32 bp, Artificial Sequence
  Primer
aaagaattcacaaagttgttgtttacatgtgc

SEQ ID NO: 4303 - DNA, 31 bp, Artificial Sequence
  Primer
aaaggtacctatgtcgatatatgccaactcg

SEQ ID NO: 4304 - DNA, 31 bp, Artificial Sequence
  Primer
aaaggtaccaactaacaatcgatcagctgtg

SEQ ID NO: 4305 - DNA, 31 bp, Artificial Sequence
  Primer
aaaggtacctaccaaactgaacaggacacac

SEQ ID NO: 4306 - DNA, 31 bp, Artificial Sequence
  Primer
aaagaattcaaccaggtcaccatttattctc

SEQ ID NO: 4307 - DNA, 35 bp, Artificial Sequence
  Primer
aaaggtaccactttcatttatgtgagcagaatatc

SEQ ID NO: 4308 - DNA, 34 bp, Artificial Sequence
  Primer
aaaggtaccccttcaacttctgaaatcacataac

SEQ ID NO: 4309 - DNA, 31 bp, Artificial Sequence
  Primer
aaaaggcctaaatatccatgccaatcaattc

SEQ ID NO: 4310 - DNA, 31 bp, Artificial Sequence
  Primer
aaaaggcctagttgctctggaagctacaaac

SEQ ID NO: 4311 - DNA, 31 bp, Artificial Sequence
  Primer
aaaggatcccttacctctgaatcctctggac

SEQ ID NO: 4312 - DNA, 30 bp, Artificial Sequence
  Primer
aaagaattcttctgtggttcctacatccag

SEQ ID NO: 4313 - DNA, 40 bp, Artificial Sequence
  Primer
aaaggtacctcacaaattacttgacaaaggaacttataag

SEQ ID NO: 4314 - DNA, 31 bp, Artificial Sequence
  Primer
aaagaattcagggtacattctttcgacatgc

SEQ ID NO: 4315 - DNA, 34 bp, Artificial Sequence
  Primer
aaaggtaccagatactccctcatgataactatgc

SEQ ID NO: 4316 - DNA, 31 bp, Artificial Sequence
  Primer
aaaggtaccgtacgagtctattgtgccactg

SEQ ID NO: 4317 - DNA, 37 bp, Artificial Sequence
  Primer
tttggtacctcattgaaactattcaagcttagcatca

SEQ ID NO: 4318 - DNA, 39 bp, Artificial Sequence
  Primer
tttggtacctcataggtggggtttaacttaagacttcag

SEQ ID NO: 4319 - DNA, 31 bp, Artificial Sequence
  Primer
aaaggatccccaagccatgaatcataacaac

SEQ ID NO: 4320 - DNA, 33 bp, Artificial Sequence
  Primer
aaagaattgtcattagttcacagcaacctcagc

SEQ ID NO: 4321 - DNA, 31 bp, Artificial Sequence
  Primer
aaagaattctgtctctgtgttgtatttgacg

SEQ ID NO: 4322 - DNA, 37 bp, Artificial Sequence
  Primer
tttggtacccctctctctaatgtagtaattgatatgc

SEQ ID NO: 4323 - DNA, 31 bp, Artificial Sequence
  Primer
aaaaggccttaatctagctcgctcccaactc

SEQ ID NO: 4324 - DNA, 32 bp, Artificial Sequence
  Primer
aaagaattcaatcgttcaaattatgcttgtcc

SEQ ID NO: 4325 - DNA, 33 bp, Artificial Sequence
  Primer
aaaaggccttcacgaagcaatcagtaattaacc

SEQ ID NO: 4326 - DNA, 31 bp, Artificial Sequence
  Primer
aaagaattctattgagacagaagccttgacg

SEQ ID NO: 4327 - DNA, 32 bp, Artificial Sequence
  Primer
aaaggtacctcatatctgtgcacacaacttcc

SEQ ID NO: 4328 - DNA, 30 bp, Artificial Sequence
  Primer
aaaggtacccatttgagccatggtggtaag

SEQ ID NO: 4329 - DNA, 30 bp, Artificial Sequence
  Primer
aaaggtaccaaatgcccttcacgctaagac

SEQ ID NO: 4330 - DNA, 31 bp, Artificial Sequence
  Primer
aaaggtaccacattgctcagcagttcatcac

SEQ ID NO: 4331 - DNA, 31 bp, Artificial Sequence
  Primer
aaaggtaccgctccaagaatgttcagtctcc

SEQ ID NO: 4332 - DNA, 34 bp, Artificial Sequence
  Primer
aaagaattcctacatgcatgcaatccttaatctg

SEQ ID NO: 4333 - DNA, 30 bp, Artificial Sequence
  Primer
aaaggtacctcatcaggaccatccgtagac

SEQ ID NO: 4334 - DNA, 31 bp, Artificial Sequence
  Primer
aaaggtacctgaattcaacagcatagagagc

SEQ ID NO: 4335 - DNA, 34 bp, Artificial Sequence
  Primer
aaaggtaccaatttatatataggtgggtcggtcg

SEQ ID NO: 4336 - DNA, 35 bp, Artificial Sequence
  Primer
tttgaattctcatgccaggatttacagttgaattg

SEQ ID NO: 4337 - DNA, 33 bp, Artificial Sequence
  Primer
aataggcctttaacgaatgggatgagctttacc

SEQ ID NO: 4338 - DNA, 30 bp, Artificial Sequence
  Primer
aatggtacctgacgagggagcgattagttt

SEQ ID NO: 4339 - DNA, 31 bp, Artificial Sequence
  Primer
aaaggtaccattcaacatgagatccaatcac

SEQ ID NO: 4340 - DNA, 33 bp, Artificial Sequence
  Primer
aaaggtaccgagcattttctttacacttcaatg

SEQ ID NO: 4341 - DNA, 31 bp, Artificial Sequence
  Primer
aaaggatccgtagacacgatctaccatgtgc

SEQ ID NO: 4342 - DNA, 31 bp, Artificial Sequence
  Primer
aaaggtaccacgaacagacatgaaggatttc

SEQ ID NO: 4343 - DNA, 30 bp, Artificial Sequence
  Primer
aaaggtaccaaatcctgaatgaatcacacg

SEQ ID NO: 4344 - DNA, 31 bp, Artificial Sequence
  Primer
aaaggatcctgaactaactgcacatttcctc

SEQ ID NO: 4345 - DNA, 32 bp, Artificial Sequence
  Primer
aaaggtacctgattagatcaagccataagcac

SEQ ID NO: 4346 - DNA, 31 bp, Artificial Sequence
  Primer
aaaggtaccgtctgcactctagtgaaaggag

SEQ ID NO: 4347 - DNA, 29 bp, Artificial Sequence
  Primer
aaagaattctagcaaatgcaaatccaacc

SEQ ID NO: 4348 - DNA, 31 bp, Artificial Sequence
  Primer
aaaggtaccctgatacccagatccttattcc

SEQ ID NO: 4349 - DNA, 31 bp, Artificial Sequence
  Primer
aaaggtaccattctgtaatccaatccagtcc

SEQ ID NO: 4350 - DNA, 33 bp, Artificial Sequence
  Primer
aaagaattctgtctacatcaaaagttgacgagg

SEQ ID NO: 4351 - DNA, 31 bp, Artificial Sequence
  Primer
aaaggtacccttgatcacccaatttatttgc

SEQ ID NO: 4352 - DNA, 31 bp, Artificial Sequence
  Primer
aaaggtacccaggtcaatcatgtacaactcc

SEQ ID NO: 4353 - DNA, 30 bp, Artificial Sequence
  Primer
tatggtacctagacagacacggcaaaattg

SEQ ID NO: 4354 - DNA, 35 bp, Artificial Sequence
  Primer
aaagagctccgtcagtctcatttcacaaataaacc

SEQ ID NO: 4355 - DNA, 30 bp, Artificial Sequence
  Primer
aaaggtaccgctacattgatcacaaagcac

SEQ ID NO: 4356 - DNA, 32 bp, Artificial Sequence
  Primer
aaagaattcgatttacaaatctccaatgttcc

SEQ ID NO: 4357 - DNA, 33 bp, Artificial Sequence
  Primer
aaagaattctctagcacattgactgaggagatg

SEQ ID NO: 4358 - DNA, 35 bp, Artificial Sequence
  Primer
aaaaggccttcaaattctcgttttgtttcacacat

SEQ ID NO: 4359 - DNA, 35 bp, Artificial Sequence
  Primer
tttggatccttatcacttgtagacacaggaatccg

SEQ ID NO: 4360 - DNA, 35 bp, Artificial Sequence
  Primer
aaaggtaccttaacagaatgcctatagtccaaaca

SEQ ID NO: 4361 - DNA, 30 bp, Artificial Sequence
  Primer
aaaggtacctcgcatgacattctctgttac

SEQ ID NO: 4362 - DNA, 32 bp, Artificial Sequence
  Primer
aaaaggccttggaagaactatgagcaatcttc

SEQ ID NO: 4363 - DNA, 36 bp, Artificial Sequence
  Primer
tttggtaccttatcctatcataggcatcacttactg

SEQ ID NO: 4364 - DNA, 31 bp, Artificial Sequence
  Primer
aaagaattctgctgcgataggtgatagaatc

SEQ ID NO: 4365 - DNA, 33 bp, Artificial Sequence
  Primer
aaaggtaccctatctcttgtggcattgaagagg

SEQ ID NO: 4366 - DNA, 31 bp, Artificial Sequence
  Primer
aaaggtaccacatttctcttcggtctgtctc

SEQ ID NO: 4367 - DNA, 31 bp, Artificial Sequence
  Primer
aaaggtaccgctccatcataaagcacctatc

SEQ ID NO: 4368 - DNA, 36 bp, Artificial Sequence
  Primer
aaaggtaccctacaaatccttgttccgtttattaag

SEQ ID NO: 4369 - DNA, 32 bp, Artificial Sequence
  Primer
aaaggtaccaaatgtcttgttaccgaatcatc

SEQ ID NO: 4370 - DNA, 31 bp, Artificial Sequence
  Primer
aaagaattcatcctactagcctatgtggtcg

SEQ ID NO: 4371 - DNA, 30 bp, Artificial Sequence
  Primer
aaaggtaccctactgcaaggaaaccaactg

SEQ ID NO: 4372 - DNA, 36 bp, Artificial Sequence
  Primer
aaaggtaccctaaatattggtgacgacagacaactg

SEQ ID NO: 4373 - DNA, 31 bp, Artificial Sequence
  Primer
aaaggatcctacagatcgacatattgccaag

SEQ ID NO: 4374 - DNA, 31 bp, Artificial Sequence
  Primer
aaaggtaccttaggcaacaattgatcacaac

SEQ ID NO: 4375 - DNA, 31 bp, Artificial Sequence
  Primer
aaaggtacccatggatttccacatgttattg

SEQ ID NO: 4376 - DNA, 34 bp, Artificial Sequence
  Primer
aaaggtacctggatctaagttctcacttcttcac

SEQ ID NO: 4377 - DNA, 31 bp, Artificial Sequence
  Primer
aaaggtaccaatttcgactgatcttcagagg

SEQ ID NO: 4378 - DNA, 33 bp, Artificial Sequence
  Primer
aaaggtaccgacactgttcatttcatttacacc

SEQ ID NO: 4379 - DNA, 34 bp, Artificial Sequence
  Primer
aaaaggcctctaagtgattaactgttgcagggag

SEQ ID NO: 4380 - DNA, 34 bp, Artificial Sequence
  Primer
ataggtacctttccaactaatcatatacaaggct

SEQ ID NO: 4381 - DNA, 34 bp, Artificial Sequence
  Primer
aaagaattcgctaggaacgtaacattgtgctatc

SEQ ID NO: 4382 - DNA, 31 bp, Artificial Sequence
  Primer
aaagaattcccttgaacaacacaagtactgc

SEQ ID NO: 4383 - DNA, 33 bp, Artificial Sequence
  Primer
aaaggtaccctaatcgtcgacatttaacaaagg

SEQ ID NO: 4384 - DNA, 31 bp, Artificial Sequence
  Primer
aaaggtacccaagatgtaacatttcacccag

SEQ ID NO: 4385 - DNA, 31 bp, Artificial Sequence
  Primer
aaaggtaccacattactgctccatgtttctg

SEQ ID NO: 4386 - DNA, 33 bp, Artificial Sequence
  Primer
ataggtaccaaaaagtcaacaaatgtctaccct

SEQ ID NO: 4387 - DNA, 28 bp, Artificial Sequence
  Primer
tttggtacccagtagtcggcgatgtttc

SEQ ID NO: 4388 - DNA, 31 bp, Artificial Sequence
  Primer
aaaggtacctacagcagttagtaccgacacc

SEQ ID NO: 4389 - DNA, 31 bp, Artificial Sequence
  Primer
aaaggtacctccactttctatttcccaattc

SEQ ID NO: 4390 - DNA, 31 bp, Artificial Sequence
  Primer
aaaggtaccaagatcaagtttctggcctatg

SEQ ID NO: 4391 - DNA, 31 bp, Artificial Sequence
  Primer
aaaggtaccatgagcttagctataacgctgc

SEQ ID NO: 4392 - DNA, 34 bp, Artificial Sequence
  Primer
aaaggatccctaatgatcttcaagcagaatgtcc

SEQ ID NO: 4393 - DNA, 30 bp, Artificial Sequence
  Primer
aaaggtacctagaagcaaacacattgaacg

SEQ ID NO: 4394 - DNA, 34 bp, Artificial Sequence
  Primer
aaaggtaccgagagatcatattcttccttgtagg

SEQ ID NO: 4395 - DNA, 31 bp, Artificial Sequence
  Primer
aaaggtacctgccatccttgtagtcataacg

SEQ ID NO: 4396 - DNA, 32 bp, Artificial Sequence
  Primer
aaaggatcctctgtcagtcaagtcactgtttc

SEQ ID NO: 4397 - DNA, 36 bp, Artificial Sequence
  Primer
aaaaggcctaatacaatatttgtctgcagtgtatgc

SEQ ID NO: 4398 - DNA, 31 bp, Artificial Sequence
  Primer
aaagaattctagaagtgggatgacttgacag

SEQ ID NO: 4399 - DNA, 31 bp, Artificial Sequence
  Primer
aaaggtaccaacggcaagaaactacaactgg

SEQ ID NO: 4400 - DNA, 34 bp, Artificial Sequence
  Primer
aaaggatccctatccaatggagaagtaattgatg

SEQ ID NO: 4401 - DNA, 29 bp, Artificial Sequence
  Primer
tttggatcctaagcaaaggcaatgagaca

SEQ ID NO: 4402 - DNA, 31 bp, Artificial Sequence
  Primer
aaaggtacctagcgaaggccctataatgttc

SEQ ID NO: 4403 - DNA, 36 bp, Artificial Sequence
  Primer
aaaaggcctctattggctccatacatcacttaatac

SEQ ID NO: 4404 - DNA, 31 bp, Artificial Sequence
  Primer
aaaaggccttactattgccagaccacacatc

SEQ ID NO: 4405 - DNA, 34 bp, Artificial Sequence
  Primer
aaaggtaccgcttaataaacaatggagatacacg

SEQ ID NO: 4406 - DNA, 34 bp, Artificial Sequence
  Primer
aaaggtaccctaccacagagagaaacagaggatg

SEQ ID NO: 4407 - DNA, 31 bp, Artificial Sequence
  Primer
aaaggtaccagccagaagctatttcagacag

SEQ ID NO: 4408 - DNA, 33 bp, Artificial Sequence
  Primer
tttggtaccttaaaatcatcctctccctcttcc

SEQ ID NO: 4409 - DNA, 31 bp, Artificial Sequence
  Primer
aaaggtacctactgacatttaccaagggttg

SEQ ID NO: 4410 - DNA, 31 bp, Artificial Sequence
  Primer
tttgagctcctcggtgcaaatatgttacatg

SEQ ID NO: 4411 - DNA, 34 bp, Artificial Sequence
  Primer
tttgtcgacttaagggtttagagacttttagggt

SEQ ID NO: 4412 - DNA, 30 bp, Artificial Sequence
  Primer
aaagtcgacattcaatttcaacgtctcgtc

SEQ ID NO: 4413 - DNA, 34 bp, Artificial Sequence
  Primer
aaaggatccgcttctgagacataaacatcaattc

SEQ ID NO: 4414 - DNA, 30 bp, Artificial Sequence
  Primer
aaaggatccagtctcttcttgtttcgatgg

SEQ ID NO: 4415 - DNA, 35 bp, Artificial Sequence
  Primer
aaaggatcccctccaaatttgctctataaatacac

SEQ ID NO: 4416 - DNA, 31 bp, Artificial Sequence
  Primer
aaagtcgacttcttagagcctcttgatccac

SEQ ID NO: 4417 - DNA, 31 bp, Artificial Sequence
  Primer
aaagtcgactcttcatggatcatcaacaaag

SEQ ID NO: 4418 - DNA, 32 bp, Artificial Sequence
  Primer
aaaggatcccgtctctgaacctcttctctaag

SEQ ID NO: 4419 - DNA, 31 bp, Artificial Sequence
  Primer
aaaggatcctactagtgaccatccacctctc

SEQ ID NO: 4420 - DNA, 31 bp, Artificial Sequence
  Primer
aaaggatcctatcaatggcgaattcagagtc

SEQ ID NO: 4421 - DNA, 31 bp, Artificial Sequence
  Primer
aaaggatcctctcgttaagtcctaggggaag

SEQ ID NO: 4422 - DNA, 28 bp, Artificial Sequence
  Primer
aaaggatccaacccatctccccttcctc

SEQ ID NO: 4423 - DNA, 31 bp, Artificial Sequence
  Primer
aaaggatccaatccagacttgactcctcagc

SEQ ID NO: 4424 - DNA, 31 bp, Artificial Sequence
  Primer
aaagtcgacaccttcctttgggttagggttc

SEQ ID NO: 4425 - DNA, 31 bp, Artificial Sequence
  Primer
aaagtcgactgtgctaatggcttcttcagac

SEQ ID NO: 4426 - DNA, 33 bp, Artificial Sequence
  Primer
aaaggatcccatcatcttatcatctcccgtaac

SEQ ID NO: 4427 - DNA, 31 bp, Artificial Sequence
  Primer
aaaggatcccacttcgtctttcgaagctcac

SEQ ID NO: 4428 - DNA, 31 bp, Artificial Sequence
  Primer
aaaggatccctagtaatggctatcgcacgtc

SEQ ID NO: 4429 - DNA, 28 bp, Artificial Sequence
  Primer
aaaggatcctccttccgagtttgctttc

SEQ ID NO: 4430 - DNA, 31 bp, Artificial Sequence
  Primer
aaaggatccctccaattcaagataacccatc

SEQ ID NO: 4431 - DNA, 30 bp, Artificial Sequence
  Primer
aaaggatccgcacgttagcaaactctcttc

SEQ ID NO: 4432 - DNA, 29 bp, Artificial Sequence
  Primer
aaaggatccccttatcttcttccgatggc

SEQ ID NO: 4433 - DNA, 31 bp, Artificial Sequence
  Primer
aaaggatccacatctacttccaatttccgtg

SEQ ID NO: 4434 - DNA, 31 bp, Artificial Sequence
  Primer
aaaggatccatccaagaagttgtgaagattg

SEQ ID NO: 4435 - DNA, 32 bp, Artificial Sequence
  Primer
aaaggatcccattcattcactctttgattgtg

SEQ ID NO: 4436 - DNA, 27 bp, Artificial Sequence
  Primer
aaaggatcctccatgtcccatgaaacc

SEQ ID NO: 4437 - DNA, 32 bp, Artificial Sequence
  Primer
aaaggatccggagctaaagaagcaaccaatac

SEQ ID NO: 4438 - DNA, 31 bp, Artificial Sequence
  Primer
aaagtcgacaggtcatagaacgagaacgaac

SEQ ID NO: 4439 - DNA, 36 bp, Artificial Sequence
  Primer
aaagtcgaccacattcttcatcttcctatatacacc

SEQ ID NO: 4440 - DNA, 29 bp, Artificial Sequence
  Primer
aaaggatccggctaagatcctttgctgac

SEQ ID NO: 4441 - DNA, 31 bp, Artificial Sequence
  Primer
aaaggatcccactttgctatggaaatggaag

SEQ ID NO: 4442 - DNA, 29 bp, Artificial Sequence
  Primer
aaagtcgacttaatcacacttggccactc

SEQ ID NO: 4443 - DNA, 35 bp, Artificial Sequence
  Primer
aaagaattctaatcttcttctcctcacacattcac

SEQ ID NO: 4444 - DNA, 27 bp, Artificial Sequence
  Primer
aaagatatcttggcatggattctggtg

SEQ ID NO: 4445 - DNA, 29 bp, Artificial Sequence
  Primer
aaagaattcacctttcccatccctagctg

SEQ ID NO: 4446 - DNA, 27 bp, Artificial Sequence
  Primer
aaagtcgacggcaaattcgagacgagg

SEQ ID NO: 4447 - DNA, 31 bp, Artificial Sequence
  Primer
aaaggatccgtggagtggactggttatcgtc

SEQ ID NO: 4448 - DNA, 34 bp, Artificial Sequence
  Primer
aaaggatccgaacagtgtcactctagcttcttcc

SEQ ID NO: 4449 - DNA, 30 bp, Artificial Sequence
  Primer
aaaggatccccaaaccctaaccctaggcac

SEQ ID NO: 4450 - DNA, 26 bp, Artificial Sequence
  Primer
aaaggatccggaagatgtcgtcgctg

SEQ ID NO: 4451 - DNA, 35 bp, Artificial Sequence
  Primer
aaaggatcctccagtctcgatctaatctaaagagc

SEQ ID NO: 4452 - DNA, 31 bp, Artificial Sequence
  Primer
aaaggatccagtgatcttcgttcttctgtgg

SEQ ID NO: 4453 - DNA, 31 bp, Artificial Sequence
  Primer
aaaggatccgaagcaaccaccaaattaaaag

SEQ ID NO: 4454 - DNA, 31 bp, Artificial Sequence
  Primer
aaagtcgaccatcactaacaccagtgaggag

SEQ ID NO: 4455 - DNA, 28 bp, Artificial Sequence
  Primer
aaaggatcctccagcgttgatcagaatc

SEQ ID NO: 4456 - DNA, 29 bp, Artificial Sequence
  Primer
aaagtcgacgtcgtttgcggtgttagaag

SEQ ID NO: 4457 - DNA, 31 bp, Artificial Sequence
  Primer
aaaggatccaatatcactcttccatggttgc

SEQ ID NO: 4458 - DNA, 31 bp, Artificial Sequence
  Primer
aaagtcgacccaatccatcgctatctctatc

SEQ ID NO: 4459 - DNA, 27 bp, Artificial Sequence
  Primer
aaaggatcccacttcctcaaccgatcc

SEQ ID NO: 4460 - DNA, 31 bp, Artificial Sequence
  Primer
aaactcgagaaccatccaactctcatgttcg

SEQ ID NO: 4461 - DNA, 29 bp, Artificial Sequence
  Primer
aaaggatccaaatttgaccaattccaacc

SEQ ID NO: 4462 - DNA, 29 bp, Artificial Sequence
  Primer
aaaggatccggaaaatggcactctcagtc

SEQ ID NO: 4463 - DNA, 31 bp, Artificial Sequence
  Primer
aaaggatccaaaagggtggttgaagttgaag

SEQ ID NO: 4464 - DNA, 31 bp, Artificial Sequence
  Primer
aaaggatcctggtggaccaagaaagacttag

SEQ ID NO: 4465 - DNA, 31 bp, Artificial Sequence
  Primer
aaagtcgactggacacagtttaggatcattg

SEQ ID NO: 4466 - DNA, 30 bp, Artificial Sequence
  Primer
tttgtcgactggacatgaacgaaatcgatg

SEQ ID NO: 4467 - DNA, 29 bp, Artificial Sequence
  Primer
aaaggatccaactaatgggcgtgttcagc

SEQ ID NO: 4468 - DNA, 32 bp, Artificial Sequence
  Primer
tttggatcctgaatagtgatgttcctctcgag

SEQ ID NO: 4469 - DNA, 29 bp, Artificial Sequence
  Primer
aaagtcgactgtctgtgactggtgagagc

SEQ ID NO: 4470 - DNA, 31 bp, Artificial Sequence
  Primer
aaaggatcctgtgttatgttcagttcgttgc

SEQ ID NO: 4471 - DNA, 29 bp, Artificial Sequence
  Primer
aaaggatccagaagcagtttccagtctcc

SEQ ID NO: 4472 - DNA, 29 bp, Artificial Sequence
  Primer
aaaggatcctcttcatccgtggtgttagg

SEQ ID NO: 4473 - DNA, 33 bp, Artificial Sequence
  Primer
aaaggatccaacctcttctatctcattgtctcc

SEQ ID NO: 4474 - DNA, 27 bp, Artificial Sequence
  Primer
aaaggatccggaagaatgcaaatggca

SEQ ID NO: 4475 - DNA, 30 bp, Artificial Sequence
  Primer
aaaggatccagaaagggaagggaaggtaac

SEQ ID NO: 4476 - DNA, 30 bp, Artificial Sequence
  Primer
aaagtcgactgctccttctcacttcacaac

SEQ ID NO: 4477 - DNA, 31 bp, Artificial Sequence
  Primer
aaaggatcccaagaaatttagagatggctgg

SEQ ID NO: 4478 - DNA, 28 bp, Artificial Sequence
  Primer
aaaggatccctcaattttcccgtctgtg

SEQ ID NO: 4479 - DNA, 31 bp, Artificial Sequence
  Primer
aaaggatccactaggagctaagatggctgag

SEQ ID NO: 4480 - DNA, 36 bp, Artificial Sequence
  Primer
aaaggatccccagtttactcttcagtaatttgaatc

SEQ ID NO: 4481 - DNA, 32 bp, Artificial Sequence
  Primer
aagtcgacagacatgagaactgtttgtgtacg

SEQ ID NO: 4482 - DNA, 29 bp, Artificial Sequence
  Primer
aaaggatcctcactcactgtaatgcgagc

SEQ ID NO: 4483 - DNA, 31 bp, Artificial Sequence
  Primer
aaagtcgacctggtgaatttgttgttgaaag

SEQ ID NO: 4484 - DNA, 31 bp, Artificial Sequence
  Primer
aaaggatcctcaactctagtcactgctgctg

SEQ ID NO: 4485 - DNA, 33 bp, Artificial Sequence
  Primer
aaaggatcctgttaccagttcagtagaaaccac

SEQ ID NO: 4486 - DNA, 32 bp, Artificial Sequence
  Primer
tttggatccgtaatcatggaagatctaccagg

SEQ ID NO: 4487 - DNA, 33 bp, Artificial Sequence
  Primer
aaaggatcccaaagaatttacttccattccatg

SEQ ID NO: 4488 - DNA, 31 bp, Artificial Sequence
  Primer
aaaggatccaacgccataactctgaattctc

SEQ ID NO: 4489 - DNA, 27 bp, Artificial Sequence
  Primer
aaaggatccaagtacggccaatgggag

SEQ ID NO: 4490 - DNA, 31 bp, Artificial Sequence
  Primer
aaaggatcccagaagaaccgagtggataaac

SEQ ID NO: 4491 - DNA, 31 bp, Artificial Sequence
  Primer
aaaggatcctggtcccatagatctctctttc

SEQ ID NO: 4492 - DNA, 31 bp, Artificial Sequence
  Primer
aaaggatccatacatctgcacgtttctgttc

SEQ ID NO: 4493 - DNA, 32 bp, Artificial Sequence
  Primer
aaaggatccgatccaacacttgtgtaattgtg

SEQ ID NO: 4494 - DNA, 30 bp, Artificial Sequence
  Primer
aaaggatcccgctttacttgctccctgaac

SEQ ID NO: 4495 - DNA, 31 bp, Artificial Sequence
  Primer
aaagtcgacagatagtccatctcattggcag

SEQ ID NO: 4496 - DNA, 30 bp, Artificial Sequence
  Primer
aaagtcgacacaggcccaaagtctctatgc

SEQ ID NO: 4497 - DNA, 31 bp, Artificial Sequence
  Primer
aaagtcgaccactatctctcgaagcaacctc

SEQ ID NO: 4498 - DNA, 31 bp, Artificial Sequence
  Primer
aaaggatccgttgcagatttgtacgttcgtg

SEQ ID NO: 4499 - DNA, 31 bp, Artificial Sequence
  Primer
aaagtcgacagccaacattctttcacaattc

SEQ ID NO: 4500 - DNA, 30 bp, Artificial Sequence
  Primer
aaaggatccttcttcattcaccatggaagg

SEQ ID NO: 4501 - DNA, 31 bp, Artificial Sequence
  Primer
aaagtcgacataaactctcgtgaacagcctc

SEQ ID NO: 4502 - DNA, 28 bp, Artificial Sequence
  Primer
aaagtcgacttacagaaatggcagcagc

SEQ ID NO: 4503 - DNA, 34 bp, Artificial Sequence
  Primer
aaaggatcccctataccctttccataataaatcc

SEQ ID NO: 4504 - DNA, 35 bp, Artificial Sequence
  Primer
aaaggatcccagtgtatagtatgagtgtcatcagc

SEQ ID NO: 4505 - DNA, 27 bp, Artificial Sequence
  Primer
aaaggatccccctctttggaattcagc

SEQ ID NO: 4506 - DNA, 32 bp, Artificial Sequence
  Primer
aaaggatcctgtacctatggctagtgaacctg

SEQ ID NO: 4507 - DNA, 27 bp, Artificial Sequence
  Primer
aaagtcgactttccaatgcaaaaacgg

SEQ ID NO: 4508 - DNA, 34 bp, Artificial Sequence
  Primer
aaaggatccctaaactttaagtagcttcggttgc

SEQ ID NO: 4509 - DNA, 33 bp, Artificial Sequence
  Primer
ataggatccttataactacccatcgtctccaga

SEQ ID NO: 4510 - DNA, 31 bp, Artificial Sequence
  Primer
aaaggtaccattaaaccaaaccaaaccgaag

SEQ ID NO: 4511 - DNA, 31 bp, Artificial Sequence
  Primer
aaaggtaccaaccagaaagacgttgtgaaag

SEQ ID NO: 4512 - DNA, 33 bp, Artificial Sequence
  Primer
aaaggtaccacagtagaaacatgagagaacacc

SEQ ID NO: 4513 - DNA, 34 bp, Artificial Sequence
  Primer
aaagaattcactttgcttctctgattctatatcc

SEQ ID NO: 4514 - DNA, 34 bp, Artificial Sequence
  Primer
aaaaggcctccaaagcagagtactatacaaatcg

SEQ ID NO: 4515 - DNA, 31 bp, Artificial Sequence
  Primer
aaaggtaccagtaggctaccaaaccaatcac

SEQ ID NO: 4516 - DNA, 35 bp, Artificial Sequence
  Primer
aaaggtaccctatgttgagatcaaacaagtattgg

SEQ ID NO: 4517 - DNA, 31 bp, Artificial Sequence
  Primer
aaaggtaccgaccattccaattatccaggag

SEQ ID NO: 4518 - DNA, 34 bp, Artificial Sequence
  Primer
tttggtaccttatcatgcagctaactgaatctcg

SEQ ID NO: 4519 - DNA, 32 bp, Artificial Sequence
  Primer
tttggtacctacatttatcaagcgttctggtg

SEQ ID NO: 4520 - DNA, 31 bp, Artificial Sequence
  Primer
aaaggtaccatctgctaagttgcattccacc

SEQ ID NO: 4521 - DNA, 31 bp, Artificial Sequence
  Primer
aaaggtaccaatgattggcttattgctttgc

SEQ ID NO: 4522 - DNA, 31 bp, Artificial Sequence
  Primer
aaaaggccttggtgctcaagtaaagacatcg

SEQ ID NO: 4523 - DNA, 31 bp, Artificial Sequence
  Primer
aaaaggcctaccttgggaaacaaatgatgag

SEQ ID NO: 4524 - DNA, 33 bp, Artificial Sequence
  Primer
aaaggtacctcatccagcacaataatactttcc

SEQ ID NO: 4525 - DNA, 31 bp, Artificial Sequence
  Primer
aaaggtaccaggtctacgtttgccacaaatc

SEQ ID NO: 4526 - DNA, 31 bp, Artificial Sequence
  Primer
aaaggtaccatacaaggcaacgatcacaata

SEQ ID NO: 4527 - DNA, 31 bp, Artificial Sequence
  Primer
aaaggtacctggatacataaacacacccaac

SEQ ID NO: 4528 - DNA, 31 bp, Artificial Sequence
  Primer
aaaggtaccagcccttcctaatgaaatatcc

SEQ ID NO: 4529 - DNA, 34 bp, Artificial Sequence
  Primer
aaaggtaccctacaagaaaggcaataattggttc

SEQ ID NO: 4530 - DNA, 34 bp, Artificial Sequence
  Primer
aaaggtaccctaaacacccataattacgttcctg

SEQ ID NO: 4531 - DNA, 34 bp, Artificial Sequence
  Primer
aaaggtaccctacaaccatagatgtaggcacaac

SEQ ID NO: 4532 - DNA, 31 bp, Artificial Sequence
  Primer
aaaggtaccgaatttccaaacaagaaagtgg

SEQ ID NO: 4533 - DNA, 33 bp, Artificial Sequence
  Primer
aaaggtaccctaaaacttgcagttcaaacaagc

SEQ ID NO: 4534 - DNA, 33 bp, Artificial Sequence
  Primer
aaaggtaccgagcagaatatcagctatcaacag

SEQ ID NO: 4535 - DNA, 34 bp, Artificial Sequence
  Primer
aaaggtaccctaaataactgaaatgcaatgcaac

SEQ ID NO: 4536 - DNA, 31 bp, Artificial Sequence
  Primer
aaaaggcctacatttcctagcttgcttcttg

SEQ ID NO: 4537 - DNA, 36 bp, Artificial Sequence
  Primer
tttaggcctttaagacaataagagatgacaaaatgc

SEQ ID NO: 4538 - DNA, 30 bp, Artificial Sequence
  Primer
aaagaattcaaagcatttggcattgttatg

SEQ ID NO: 4539 - DNA, 39 bp, Artificial Sequence
  Primer
aaaggtaccctatgacaaaggaacttataagaaattttc

SEQ ID NO: 4540 - DNA, 31 bp, Artificial Sequence
  Primer
aaagaattctagtagatttggacatgcaagc

SEQ ID NO: 4541 - DNA, 31 bp, Artificial Sequence
  Primer
aaaaggcctaagctccagctacttcacaagc

SEQ ID NO: 4542 - DNA, 35 bp, Artificial Sequence
  Primer
tttgaattctcattaaatctttgcaaattcaagcg

SEQ ID NO: 4543 - DNA, 31 bp, Artificial Sequence
  Primer
aaaaggcctactttgatgtgatgcactctcg

SEQ ID NO: 4544 - DNA, 31 bp, Artificial Sequence
  Primer
aaagaattcttctgggaagacaccctaaatc

SEQ ID NO: 4545 - DNA, 34 bp, Artificial Sequence
  Primer
aaaggtaccctagtacggatcagctttgctcaag

SEQ ID NO: 4546 - DNA, 31 bp, Artificial Sequence
  Primer
aaaggtacctaccatccattcacccaaagtc

SEQ ID NO: 4547 - DNA, 31 bp, Artificial Sequence
  Primer
aaaggtaccggcaacagatgattaaaggagc

SEQ ID NO: 4548 - DNA, 31 bp, Artificial Sequence
  Primer
aaaggtacccaacagtttgacaaagccatag

SEQ ID NO: 4549 - DNA, 35 bp, Artificial Sequence
  Primer
aaaggtaccctatcactcacagttacacgcagaag

SEQ ID NO: 4550 - DNA, 35 bp, Artificial Sequence
  Primer
aaaggtaccttattgttttattgaggcgtatttgc

SEQ ID NO: 4551 - DNA, 31 bp, Artificial Sequence
  Primer
aaaggtaccttctgtgaacttcgagagagtc

SEQ ID NO: 4552 - DNA, 33 bp, Artificial Sequence
  Primer
aaaggtaccctatattattttcctcggcaggtc

SEQ ID NO: 4553 - DNA, 31 bp, Artificial Sequence
  Primer
aaaggatccaaagttcaacaatcaacaatgc

SEQ ID NO: 4554 - DNA, 30 bp, Artificial Sequence
  Primer
aaaggtaccctaacaaggcagttgaacacg

SEQ ID NO: 4555 - DNA, 31 bp, Artificial Sequence
  Primer
aaaggatccaataaacattaacatgggccac

SEQ ID NO: 4556 - DNA, 36 bp, Artificial Sequence
  Primer
aaaggtaccggcatattacagattacagagtcaagc

SEQ ID NO: 4557 - DNA, 27 bp, Artificial Sequence
  Primer
aaagaattccaaatccaaccgaattgc

SEQ ID NO: 4558 - DNA, 31 bp, Artificial Sequence
  Primer
aaaggtacctccttattcctaacaatgggtg

SEQ ID NO: 4559 - DNA, 31 bp, Artificial Sequence
  Primer
aaagaattctgacgaggaaaagtaaacctgc

SEQ ID NO: 4560 - DNA, 31 bp, Artificial Sequence
  Primer
aaaggtacctcgttccaactattgagcatac

SEQ ID NO: 4561 - DNA, 31 bp, Artificial Sequence
  Primer
aaaggtaccaaccaggaacagtaacttgagg

SEQ ID NO: 4562 - DNA, 33 bp, Artificial Sequence
  Primer
tttggtaccttgcctatcccttttacttgattc

SEQ ID NO: 4563 - DNA, 31 bp, Artificial Sequence
  Primer
aaaggtacctcaaatttacacatcaagggtg

SEQ ID NO: 4564 - DNA, 33 bp, Artificial Sequence
  Primer
aaagaattcgaatcaggaagtcaaatttctagg

SEQ ID NO: 4565 - DNA, 35 bp, Artificial Sequence
  Primer
tttaggcctttacgttttgtttcacacataattcg

SEQ ID NO: 4566 - DNA, 36 bp, Artificial Sequence
  Primer
aatggtaccttatgcctatagtccaaacaatacacc

SEQ ID NO: 4567 - DNA, 35 bp, Artificial Sequence
  Primer
aaaggtaccctagaacaaatgaatcagaatcaacc

SEQ ID NO: 4568 - DNA, 31 bp, Artificial Sequence
  Primer
aaaaggccttcttcaagacttccaagttgag

SEQ ID NO: 4569 - DNA, 32 bp, Artificial Sequence
  Primer
aaaggtaccctattgaagaggcacatcctgag

SEQ ID NO: 4570 - DNA, 31 bp, Artificial Sequence
  Primer
aaaggtacctctgtctcccgaagaataaatg

SEQ ID NO: 4571 - DNA, 31 bp, Artificial Sequence
  Primer
aaaggtacctgctccattctcatagttcttg

SEQ ID NO: 4572 - DNA, 30 bp, Artificial Sequence
  Primer
ttaggtaccttatcaaccagatgtgcatgc

SEQ ID NO: 4573 - DNA, 32 bp, Artificial Sequence
  Primer
aaaggtaccatgctacatgataatcagcaacc

SEQ ID NO: 4574 - DNA, 30 bp, Artificial Sequence
  Primer
aaaggtaccaactgcaaccttgtagtcctg

SEQ ID NO: 4575 - DNA, 31 bp, Artificial Sequence
  Primer
aaaggatccctccttggatttcatcttgaac

SEQ ID NO: 4576 - DNA, 32 bp, Artificial Sequence
  Primer
aaaggtacctgatcacaacattagttgcattg

SEQ ID NO: 4577 - DNA, 31 bp, Artificial Sequence
  Primer
aaaggtacccatcaaacatttcctgcactac

SEQ ID NO: 4578 - DNA, 31 bp, Artificial Sequence
  Primer
aaaggtaccttccaagttgagagtacaccag

SEQ ID NO: 4579 - DNA, 30 bp, Artificial Sequence
  Primer
aaaggtaccaacgaattccacttgtgtagg

SEQ ID NO: 4580 - DNA, 34 bp, Artificial Sequence
  Primer
aaaaggcctctaactcatgcacttgatttgattg

SEQ ID NO: 4581 - DNA, 35 bp, Artificial Sequence
  Primer
aaaggtaccaaagaatcacttaaatcaaccttgtc

SEQ ID NO: 4582 - DNA, 31 bp, Artificial Sequence
  Primer
aaagaattcaagttcagatgagaggaagtgg

SEQ ID NO: 4583 - DNA, 36 bp, Artificial Sequence
  Primer
aaaggtaccctaatttaacaaaggaagacaccaaag

SEQ ID NO: 4584 - DNA, 35 bp, Artificial Sequence
  Primer
aaaggtaccggaattggttattggtacagatagag

SEQ ID NO: 4585 - DNA, 34 bp, Artificial Sequence
  Primer
aaaggtaccctaagaaattgagatggatggtttc

SEQ ID NO: 4586 - DNA, 36 bp, Artificial Sequence
  Primer
tttggtaccgtctaccctttttatgaataattttgg

SEQ ID NO: 4587 - DNA, 38 bp, Artificial Sequence
  Primer
tttggtaccttactgaatatgaatttaagaagtagcca

SEQ ID NO: 4588 - DNA, 31 bp, Artificial Sequence
  Primer
aaaggtacccgacacctacacgttacacttc

SEQ ID NO: 4589 - DNA, 31 bp, Artificial Sequence
  Primer
aaaggtaccaccctccctcttcctctataac

SEQ ID NO: 4590 - DNA, 31 bp, Artificial Sequence
  Primer
aaaggtaccaagtaaacatacccaaagcagc

SEQ ID NO: 4591 - DNA, 31 bp, Artificial Sequence
  Primer
aaaggtacctataacgctgcataatgctcag

SEQ ID NO: 4592 - DNA, 31 bp, Artificial Sequence
  Primer
aaaggtaccgcaaacacattgaacgtaattc

SEQ ID NO: 4593 - DNA, 35 bp, Artificial Sequence
  Primer
aaaggtaccaaataatcaagtatatgaaccaccac

SEQ ID NO: 4594 - DNA, 34 bp, Artificial Sequence
  Primer
aaaggtaccctaaacaattgacagaacatgcagc

SEQ ID NO: 4595 - DNA, 31 bp, Artificial Sequence
  Primer
aaaggatccagtcaagtcactgtttctcctg

SEQ ID NO: 4596 - DNA, 33 bp, Artificial Sequence
  Primer
aaaaggcctcatccgtttgcacactaacttaac

SEQ ID NO: 4597 - DNA, 31 bp, Artificial Sequence
  Primer
aaagaattctgaccttcagtctattgcaaac

SEQ ID NO: 4598 - DNA, 34 bp, Artificial Sequence
  Primer
aaaggtaccttggtgacgtgatacagagacatag

SEQ ID NO: 4599 - DNA, 34 bp, Artificial Sequence
  Primer
aaaggatccctagtaattgatgatgagccaaagc

SEQ ID NO: 4600 - DNA, 37 bp, Artificial Sequence
  Primer
tttggatccctcattaaatagcaatgttcatcttaga

SEQ ID NO: 4601 - DNA, 31 bp, Artificial Sequence
  Primer
aaaggtaccgatcataatccgcaatagctgc

SEQ ID NO: 4602 - DNA, 33 bp, Artificial Sequence
  Primer
tttaggcctttaacaaactcagctacaagcagg

SEQ ID NO: 4603 - DNA, 31 bp, Artificial Sequence
  Primer
aaaaggcctgcttcaatccttcattgtcttc

SEQ ID NO: 4604 - DNA, 31 bp, Artificial Sequence
  Primer
aaaggtaccaatccatctactgcaacaatcc

SEQ ID NO: 4605 - DNA, 34 bp, Artificial Sequence
  Primer
aaaggtaccctagaggatgaacagaaaacagagg

SEQ ID NO: 4606 - DNA, 31 bp, Artificial Sequence
  Primer
aaaggtaccctctccttgcttgtactgactg

SEQ ID NO: 4607 - DNA, 31 bp, Artificial Sequence
  Primer
aaaggtaccaccaagggttgttctgctatac

SEQ ID NO: 4608 - DNA, 35 bp, Artificial Sequence
  Primer
aaagagctcctacacgcttacataaactacggttc
